United States Patent 7,411,051 (ANTIBODIES TO HDPPA04 POLYPEPTIDE) - sequence listing, part 2

SEQ ID NO: 1129 - DNA, 1200 bp, Homo sapiens
ggcacgaggagagagaagatgatgaaaagactgttgatgaccgaactgtgaaattctccccttgtcacctggaagatggcatggtgccttctgtccgtcttctttcttcgggctttgtgtgctcactctagcacagcatacaagtgtgtgctttgttcgcccaggtctccatggttagttgaagccaatttctggcttgacttttatgggaaaagttattttatgtctcctaagcattagagtttttctattactctatgtagttgagacaggatttgataagtctaggaaaagaaagatgggaaaacgggattccttttcagaagtacctgtgtgtatctgttaataaccacaggggttaatatgatgtaggatcttttactatcaatttcaaccatttgattttgtatgattgaaacttgcaccgagctttgactgtttgttaaagagtcatttttaatgaaagaataattctttattgctggtttttcatttacactgataaatacacagatcttaataaagtctttaacattcatttgtattcagatgtgagtagaagaactaaaaaaagaaagttacatatcactatgactgaaggtacttcagcttaatctgaaatataatttaacttgtgaactccttggatatgatattatttggaataaacagaatttatcattgaacccaaagtaggaaatgatagcttacattgtctaaaaatccttacaaggttaagatgattcaatatcaagaatattcagaaaattatttctaaagttgatcgattcatgtcgtattgatagaatcttgaccagaagaaattttgctctttttatatagtttcaagaaatgtgtttttaaatttttattaatgcacttgaacaactttgcaggaataaagcaaccccctaaccacaaaatatccctctaaattagttccctagctttctcaatgaatacacacatatttttacatagctatgatcgttgtgtacattctcctttgttttacttctcggcctaacacttgtctcctcttgtcaacacagattctactctcaccaatttaaatgtctttatatccatgttacatgggtaacctcacttcaccccattattagatatttgagttatatctaatttttcactcttataaatagtgctgctatgaatgtctgtaaaaaaaaaaaaaaaaaa

SEQ ID NO: 1130 - DNA, 2100 bp, Homo sapiens
ggcacgaggactggaggcagatgacaaacctgctccttccagttggttcctgtgagagcaaaagtctatcagtggggcatcagcaacattccttcagcttggcagcagcaattctttcaggatgtgacaagctgaatacagcttgtagtgtacagtttacacgtatcagcgtgaccctctcccgcccaccctcatttccctttcagagatctgctcctgcttcatgggcctcttccccaagcttctaagtttaatatttcagattgtttatttccttccctcagctctagagatgacagttgcttcacccagttgccacttctgtgatgccttagagtctctctttttctctaattaacaaaatgtatacttagttaacaattatttatggtactttctctctgttcaaataacttcttcctgactacatcctaactaacagagagagaatgggatgattccacttgtgctgttcaatgtggtagcttctactcactttggttacttagatgtaaatttagttaattaaacataaataaaatataaaaactgtttctcagttacactagtcacatttcaagcactcaatagccacacgtggctactggctactgtattggacagtggagatacagaacgtttctgtcatcacgtaaagttccatcagagagtgctgggctagaggaatgaagagttcttaaggtggaggggaaatatgagtaaaagaacttcattagaaccaggaaatgaaatacaagagactcagcatgagcttcctcaagaaaagagaacatatatatatatatatttgcatacatatatatgttattttcattgctgatgttaagacagagacagcaaaacctagcacttttagtcattagcataatcacaaaattgaaaaatatagtttctctgatcacagtgctgttaaaatcccatatatttaaaaattaatgatatgataaaattatagtgaaatattgcataaataaagtagttataaataaagtagtccttagaggacatttagagccttaactaaatatttcagaaaagatgaaggtgcaattagaaatttatgtgtccagctcaagaagttagaaaaagaacaaaaagtgaaatacgaagatggcagaaactttagaaaatcagaaagataccataaattaattagacatcaaagatagaagaaaatacaaagccagtaattagttattttgaaggattaataaagttggtaagctcctgggaagaatgatgaggaaaaaatagagaaggcacaaataatgtcagtaaataaccatagaactgatagagatgagaaaggtaagatatttttaacaacccaagtccaataaacttggaaatttagaagaaatggacctatttctagaaaaaaatttaccaaactggccttaaaaaagtagagtatgtaagtggttctttaagtattaaacaattggttcatatttgaatacttcgttcaaagataacttcaggctcacatagcttcactattgagttctgtcccattttttaaaaaggcttaatggccatcatttacaaattcttccaaaaaatagtaataggggaacaatcagccatctcattttatgatgttctccaaactttgattttaaaaccagacaaaggaagaaaaattacaggacaatctcacatattaacaatggtccaaaactcctaaacaaaataatccctaaccaaatataacaatatattacaccacaattaagtttttttatgttctaggaatgcgagattagtttaaaatttgatcataaaccaatgtagtccatcacattaaaaaacaaaagataaaaatattataaatatataaaataatttgagaaaatttatgattaaaaattcttagtatagatagtttatatagaaaaaattcacaatctgataaagaagagttaccccaaatcctccagctaacattttatgtaaaagtaaaatagtaagaactttgcctttgagattaggaacaagtaaagcttgcccaatttactgttcaacatgttagtggaagtttttttatcatttccagaaggcaaaaaaaaaaaaaaaaaa

SEQ ID NO: 1131 - DNA, 1624 bp, Homo sapiens
  misc_feature (117)..(117): n equals a,t,g, or c
atatgtttctgaatagatccagttgaatagtctcattcaatttgagactgttgaacaactgttgttttctcacatacatttaaagtcagggcacatgcgtcactgcttatttttcgnacttgacatattccctgcatttccatgtctgcctgtcctttagataaacagtaaaagtttcccatgtgccagtatttctcaaatggtttacatcagaatcacctggaggacttttaagctagattgtttggtcccatcccagggattctgaatcaacaggtttgcgatgggtccagatagtttacttttccaagtttactaacaagtttgccaagttcccccagtttattaccattagaccatacctttttgtccaatcatttaaamcaaatttttatataataagttttatttgtatgtaataaattttattatataaaaataagttttaatatatattatataaaaagttttaataaatacctaatatattatttaatatgataaaacttatattaaatgaaattttatgctgtyctcttgtcaatctgtcttttgttatcttgctggtgtgcctgtcatgtgagggactgcaatctgatatgcctattttccacagtcaaagcaattacaagagaattgttacaattacccagttatgtcaagagatttttttttaattcactaaggtagagataaggagaatgtattaaaataggatattttaattataaatgcatgactggggagggggtattgtttttgaataaaatatgaggttatttgccatgacaaaaaaaaaaagaagtaggaaaatcccatggaaatttatgttccttctaacttttaaaactacctaaaaaatataattgatttaaattatatctcaatattccccattcttttatatccccttaaataggtacccatgaagagattatgaactacttgaaggtggagactgtacggtggtgtgttggagctggcttgtaatgtcttatgagtgacaatcgttagtttgaggaattttgtgagacagttgtcaaattgttgctagcttgaaatctgcggcaattggagtatttacaccatagaaatgctataagtgaagrcctacctttcccttaagagctagttgttaaacctttaccagcataccactggaccttgtctaaaatttctttgtgttcccagtgtcttgcccagtagatacaagataaatattgccagaatcagatatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaagtgttgtacatgtctctggtttcagaattaaaagaattcagagttaaaaaaaaaaaaaaaaaaaaaaaaaactcgta

SEQ ID NO: 1132 - DNA, 3696 bp, Homo sapiens
cctgaaggtcccggtgctcacttggacatgaactctcttgatagagcccaagcagccaataataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttatacgtgcaaaagcccatgagaagctagacaataagaaggaatgtttagaatatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaagtgcagattgcttgtatgtaaaacccaaataaaggtagagtaagtgtgatatatgggagtattaaaatagcttaaaatttctcgtgaaggacatgtggctaaagggtcaaaaaggatgtaagacttggagccagagcatagtatttcctgaaataacaagtttagtgctttaactatggctacatgtgcttaaggaattttgagccacttatttttgaagatgctgaggacatgtagagtgctttttgtagtgagctaaccttgatctctaaggactaactacccaggtccaggtcttcactaggggtactgacagtgtttaagctttactccacctccttacttagaaatcactttacgatttatttccattttccacttttatagaccatccttttgcttatatgctagatttttctggtgagggaagggttgtgttcttcaggggtcttttgttttgaaatactcaggatggggagaggtttatttaagaacgaattataattatggtttacactgttgcgagtaaaggagcatttttacaccccttaagggtgcttaattctgttgaaaccaaaaagatttgtctacaaatgctatcttttttagaaactattagaaatgactccctttcaaagtcaatctttggaaaatattgaggaggtcactaattagtttgtgcacttaatataattcaagatgatttggatgatgggaagtttgagaccgctgcattttgttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacattcaaaaaaaaaaaaaaaaaaaaaaaaaaaaaaaaaaaaaaaaaaaaaaaaaaaaaaaaaaaaaaaaa

SEQ ID NO: 1133 - DNA, 1349 bp, Homo sapiens
  misc_feature (105)..(105): n equals a,t,g, or c
  misc_feature (394)..(394): n equals a,t,g, or c
tttatttaaataaacttatacagctaaagaaactgactttcacttcctcagtgacttaatttcactacatgctgatttgtcctttgcagtatttagctcagaccnagacagaattgtatgtgctattagatttgcaaattgctgatctcccagtgactttccctcttagatcccagttgagtatggttaccttgagaactgtggtattagccatgttagagcatgctccactggggagttctgtgcagtctatttttaatgctatttaatgaaggagcgagcgcctcacttcagcaataaaagaagcatgagggaagacagagcagtgcatggttatggatactggacaaggatatttggaaaggtaaaggctgaccattggatatggyaattntaatgaagtcctaatatatcatakgaawggaaatakggattttkgttagagaattatacatgaatagttcaataggtgttttcgtaaacctcttcactagttcttagaaagaagactcaataatttgagtttttaaaacttgagggacatactaaccagggagttcctgcatgcagactatttttaatacaagctgtcatattcttgggtggtgagaastacagaaataatttcaaattcctaaaatattgttcggtgaaaggtttggagcttgtaaaacgttctgcgaataaaataactaatatgcttctaagatactacaataacctgaagctctgccttgtgaattgcttcattttcttttatgaacttggagtctaggtccagaattgtcacaactaagagaagcagaakttttgtttggacttgatagaatatttggggtgttttctctccttagaattaagataagccctacagattatcttactgaartctaaatattttaaaaatataagtagcagaggcagcactggtaacttttgtaatgtcacaataaagggcaaaatatcttaacattatagtgtgtacaatgcaagaagccatctgtctgcaacatttgtatatatgcagaacacctgtcttgaggtagaaagtgagaatgttcaatcagaaaggtcttgtgttgattttcatattaacaacatactataatcaggttattcttttgttcagagtaaagctaattagacaaaatgcttaagtagttgcaaggttaataaacataagagaaagtaagcagtttctattaaatggggaagttagtcatataatttttaaatgaagctgttagaacaatgtgcaaagttgatctggatttttgccaattcctatgaaaaataatccccagaaataaactactaaggaaaataaaaaaaaaaaaaaaaaaactcga

SEQ ID NO: 1134 - DNA, 1015 bp, Homo sapiens
ggcacgagcagtattttcactcttggaggggcctaacactatcatgttgccctgatttgtgcctaacgctcattcataaaatgatcctgacttaaagtggtatgtttggtgctttctttttctgtttgctttttaaatcctttctaaatggcggcccatttcatttacatctctcatttcccctgaagtctttgaagccttttttgtaatgtgcctttaacaaataagtctctcttttttctccagcagtgtgaggcttctcaaatatttgtgttatgagttacggacaaggcatttcctgacctgtttccttaaaaaatccatttttagacaacctatagcattaagattgaaatccaaactatgggagtttacctgaagctgcaagctttcaaactgtaattttgtggtattggtagagccatgaaagtggaagtgaaacctttttaattaattttctttggcagttgaaaatggcccatgttttagctggtagcaatgtaagtttacatatgagcccaactaagctggttcattattctcttcagttgtttgaaagttggcagccatcatcacaacagcagctggatacaagataacctagccagtgttggcacatgttgaggcatatgggaatttattaaatcatgcaacctttgcaaagaagagcgtctaaatgacttaatatactaatttaaaacagctggccatgagcaatcatatgacttaaattattctattcagatttattaatccaattgaacattaactgagtaatttgatgtttttatctaaatggataagatgattttttgaagtataaaatgggatttgtagggataggggaagaaactatatagaacaaagcaagcggtgcaattctggttttagaaataatctgtgtttggctgggtgcagtggctgacacctgtaatcccaatactttgggaggctgaggtaggaggatcacttgagcccaggagttccagaccagcctgtgagaccgtatctctac

SEQ ID NO: 1135 - DNA, 1558 bp, Homo sapiens
  misc_feature (17)..(17): n equals a,t,g, or c
  misc_feature (1514)..(1514): n equals a,t,g, or c
  misc_feature (1551)..(1551): n equals a,t,g, or c
  misc_feature (1556)..(1556): n equals a,t,g, or c
tgggtatccattcctgnaattactttacttaggataatggcctccagctccgtccaagttgctgcaaaaggtattatttcgttcctttttgtggctgagtagtattccatggtgtatatataccacattttctttatccactcattgcttgatgggcagttaggttggttccacatctttgcaattgtgagttgtgctgctccagatatcatctttaactcctttgccttctccacatacatttccaagtcctgttcattctacctccaaaatgtatcttgtatccattcatctctctccatcttcaatctatttcaatgccccatcatctcttgcatggaggagtgtaataattggctaactggcctgttcttacattttaaaatcaaaagatgtgacaggtgaaatgcctatttcagtgtccattgatggttctgcttacacaccacctggctgcctggtgtcgcagtggcagagttgagcagtgtgaaaaagactgcttggccctttacagggaaagcaggtccactgtggcctgtgaggacgagagctctgggcaggctcggacactggcagaccctggtcctggctggccaaggcagcagggtatgtgtttcgggtcactcacagggctcagcaccactcctcatggcttccttactgtttcggcagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaaaaaaaaaaaaaaaaaaaaaaaanaaaaaaaaaagggggccgctctagaggtccaagttangacgngg

SEQ ID NO: 1136 - DNA, 1345 bp, Homo sapiens
  misc_feature (635)..(635): n equals a,t,g, or c
gtgcggccggcccctcttcgccacctactcgggcctctggaggaagtgctacttcctgggcatcgaccgggacatcgacaccctcatcctgaaaggtattgcgcacgatgcacggccatcaagtaccacttttctcagcccatccgcttgcgaaacattccttttaatttaaccaagaccatacagcaagatgagtggcacctgcttcatttaagaagaatcactgctggcttcctcggcatggccgtagccgtccttctctgcggctgcattgtggccacagtcagtttcttctgggaggagagcttgacccagcacgtggctggactcctgttcctcatgacagggatattttgcaccatttccctctgtacttatgccgccagtatctcgtatgatttgaaccggctcccaaagctaatttatagcctgcctgctgatgtggaacatggttacagctggtccatcttttgcgcctggtgcagtttaggctttattgtggcagctggaggtctctgcatcgcttatccgtttattagccggaccaagattgcacagctaaagtctggcagagactccacggtatgactgtcctcactgggcctgtccamagtgcgagcgactcctgaaggggnaacagcgcggagttcaaggagtccaagcacaaagcggtcttttacattccaacctgttgcctgccagccctttctggattactgatagaaaatcatgcaaaacctcccaacctttctaaggacaagactactgtggattcaagtgctttaatgactatttatgcgttgactgtgagaatagggagcagtgccatgggacatttctaggtgtagagaaagaagaaactgcaatggaaaaatttgtatgatttccatttatttcagaaagtttgtatgtaacaattacccgagagtcatttctacttgcaaaaggattcgtaacaaagcgagtataattttcttgtcattgtatcatgcttgttaaattttaatgcagcatcttcagaacttgtcctgatggtgtcttattgtgtcagcaccaaatatttgtgcattatttgtggacgttccttgtcacaggaagattcttcttctgttgccttattgtttttttttttttaagtctcttctctgtctttgtactggaatcgaaatcataagataaacagatcaaacgtgcttaagagctaactcgtgacactatgcagtattgtttgaagacctgttgttcaacctctgtctctttatgttaactggatttctgcattaaatgactgcccccttgttaaaaaaaaaaaaaaaaaaaaaaaaaaaaaaaaaaaaaactcgta

SEQ ID NO: 1137 - DNA, 1512 bp, Homo sapiens
  misc_feature (207)..(207): n equals a,t,g, or c
  misc_feature (209)..(209): n equals a,t,g, or c
  misc_feature (521)..(521): n equals a,t,g, or c
gcagagcccctgggtgtgagaagctcgtctcccgtgggttgcattggctctgccctatctctgcctccagcacccagggcggccgcagatggcagtgtctctggggacagcagctgcgaatgagtccacgggccaacgctgagctgctcaggctgaggcggtgtgctcagcacagagcccccggaactggcatctgcagggcgtgancnaaggccgccgcgatgccgcacttcctggactggttcgtgccggtctacttggtcatctcggtcctcattctggtgggcttcggcgcctgcatctactacttcgagccgggcctgcaggaggcgcacaagtggcgcatgcagcgccccctggtggaccgcsacctccgcaagacgctaatggtgcgcgacaacctggccttcggcggcccggaggtctgagccgacttgcaaaggggataggcsggcggcaccgggcgccctcccccagcccgccccgcccgcccagcccggagacccccaaggcagagggangccggcctgttggccctccacgctatccctctgcagcctgggccctcccgacagaggccccaggtgcgctgscagtgraggtggggcacttaggtgcctggctggcccagggcttgctctccgtgtcaagccgactcacccagagcccaccctcccaagctcaggggcatcctccgctgggccccagtgcctttgcrctgcgcagcactctgccctccactggactcaggcatgtctatggctgcctgtcctgaggctccggagccctcatttcttcgtgaagtccccagctcccctgcctccactcaatggcaccggccctgcaactttaggcaggtcgaagccaacccaaggaaagaacctaagaacctcgtttggagggatgtcagcttgggccagmccagccgcaccccgcggggctcaggcttggaactggtgagggtgtgtggtgggggtatgcagagggataagaccgtggtagaggagagggttggtgaggagagagagagagagagagagagagagagtctggggggagcgggcaagcatggggagatgagatgtgtatatgtgagagagagtgtgggggccccaggcagggcaggaggtggtggaaacggggtgaactccgtgggctgtgtgaggactgtccatagtgggtccmaaccccctccctctgctggagtttcctagcccttccccctcccyaagactgwggcagcaggcaggagcccctgccctccctccctgtcctgtgccacacttctggggccaaacccagcccccttgagccaggccctgccagactccaagcccaccctagaaccctcctcctgtgtggagactctgttgccccactttggacacagattggcaacctgcctcaccmckcccccctwcgctggggcttccatcttaatttattctcaataataaagacttcatgatgamaaaaaaaaaaaaaaaaaaaaaaaaaaaaaaaaaaaaaaaa

SEQ ID NO: 1138 - DNA, 1586 bp, Homo sapiens
aattcggcaccaggagaagtggagtttggaagttcaggggcacaggggcacaggcccacgactgcagcgggatggaccagtactgcatcctgggccgcatcggggagggcgcccamggcatcgtcttcaaggccaagcacgtggagactggcgagatagttgccctcaagaaggtggccctaaggcggttggaagacggcttccctaaccaggccctgcgggagattaaggctctgcaggaratggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggagctcactgagctgccggactacaacaagatctcctttaaggagcaggtgcccatgcccctggaggakgtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggartcgctgttgaacccararctgattcggcccttcatcctggargggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgaaggttggtctcgargcagargtcatgttcccagccaagagtatgagaacatccagtcgagcagaggagattcatggcctgtsctcggtgagccttaccttctgtgtgcttcacatcactgagcactcatttagaagtgagggagacagaagtctagscccagggatggctccagttggggatccagcaggagaccctctgcacatgaggctggtttmccaacatctactccctcaggatgagcgtgagccagaagcagctgtgtatttaaggaaacaagcgttcctggaattaatttataaatttaataaatcccaatataatcccagctagtgctttttccttattataatttgataaggtgattataaaagatacatggaaggaagtggaaccagatgcagaagaggaaatgatggaaggacttatggtatcagataccaatatttaaaagtttgtataataataaagagtatgattgtggttcaaggataaaaaaaaaaaaaaaaaaaaaactcga

SEQ ID NO: 1139 - DNA, 1419 bp, Homo sapiens
  misc_feature (517)..(517): n equals a,t,g, or c
  misc_feature (539)..(539): n equals a,t,g, or c
  misc_feature (604)..(604): n equals a,t,g, or c
  misc_feature (676)..(676): n equals a,t,g, or c
  misc_feature (912)..(912): n equals a,t,g, or c
taagaacagaacagcaagtatgaaccacatggaacttaaaacatatgggtgtgaagtccacttatgtagacaaaacttataatttccaaactgttgtctagtatacagtgatcagttgctctctgttcaagtcattccacacatttccctattttaggctattataatatagaaagaaaatgggaagcattagttggagctagaaaatgaactgtatattattgctatatttgctaataccaactatttcaataagtgttgtaccatatgtagcattaaatataaaatacataaaagaatgtacagaaaatagcttttattgagtaatattacatttcatttatactgtagcaatatatttgtaggtatactctgtaagggctttaaataaaagaggtccattaatacttccttataaaaattctagtctgtttcattactgcccagatgttttagagataaatatttatgcagaaggtattttkgaaagtcyccytttgtctgatagagtttaacnagatatttaaatttagtgcycnagaaatcccacaagtcacggtctaaacacacttagaatactacagcataaatctgttagcattanttgccaaataagacagttgggatcccaaaccccaagtccttgagcaatgtttttcctcaaaaagctgctatnccaatgatataggaaaawacattgtgttttcctaaacacacttttctttttaaatgtgcttcattgtttgatttggtcctgcctaaatttcacaagctaggccaatgaaggctgaatcaaagacatttcatccaccaatatcatgtgtagatattatgtatagaaaataaaataaattatggctctaacttctgtgttgctgtttatcttgttatttttcggcgttatactaatgngtttattgagagcattttaccttccagacttctcatggctaacttttggtctgwattttgstccttagatgkgaatatttcttattagtytgctycctgcwacgcaatgactgcatttctatcatttctcagtttgttagwatatgtggatagtattctactgtataaatgattgcaaagtttatcaaaaacaaattattatatgtagcttttctacagtgctttgctaaaccatgtagtactagttaagtsttccttgaaaataaagatacactcttataggggacagttcctgttcactcccaggaaacttttttaaaagatgacactgaatgtttattgcactttagtgcagtgaagtggcaataaaacctaacatgaatcaaggttgtttatggcagatgcatgtgttgctttacagagtttagcaaaagctcttaattttatgtcatactgtattctactgaataataaagctaacattattcaataataaaatggaaaaaa

SEQ ID NO: 1140 - DNA, 689 bp, Homo sapiens
atggaagctaagtttggcctgctttgctttttagtctccacaccatgggcagaactgctgtctttactacttcatctcacccaagtcccgttcccaggcagccagggcctgggtttgaataattgcagggcagcctgccatgatctttctcacttactcctctcccattcagcaatcaaccagactaaggagttttgatccctagtgattacagccctgaagaaaattaaatctgaattaattttacatggccttcgtgatctttctgctgttcttactttttcgaatgtagttggggggtgggagggacaggttatggtatttaaagagaataaacattttgcacatacatgtattgtacaacagtaagatcctctgttaaaaccagctgtcctgttctccatctccatttcttcccatgctgtaaccccaggctccaccagctgttccccagtgatgttacctagcttccctctaccgttgtctactgaccatttccactacatgcctttcctaccttcccttcacaaccaatcaagtgaatacttgattattatctcttccttactgtgctttatcttttttgtttggattggttctaattaatgaaaataaaagtttctaaatttacatttttatagggtattgtaaataaaaacaaatgtatacttaaaaaaaaaaaaaaaaaa

SEQ ID NO: 1141 - DNA, 948 bp, Homo sapiens
taaaaatcatgctctgtaccatcctcaccgtagtcatcatcatcgccgcgcagaccacgagaactactgggatccctaaaaacgcccctggtccggccccactctgcgcccctcgatctcccaggctctttctgcagwcataccgcggacccaatgggcgccctgcacacccgtttctggggccgtcagacttggatacatcgtaaactccgcctccacggaacgtctcgcctkgcgagcaagmtcggaatccagttcctcaggaacccctccaaaacccacacccccagggacgccgctttccgggatcccggscaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgcttcttttcttctccgcggggtgattcagtccagtgattgggtttgtggctccaggcctcgcccacagacggacagacccctccctttcttccggcaaaaggaccgagccctggggtagtaaggsccccacactcctgttttttgcaagtacatttttgtccytcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgaaaaaaaaaaaa

SEQ ID NO: 1142 - DNA, 1393 bp, Homo sapiens
  misc_feature (127)..(127): n equals a,t,g, or c
  misc_feature (376)..(376): n equals a,t,g, or c
  misc_feature (447)..(447): n equals a,t,g, or c
  misc_feature (782)..(782): n equals a,t,g, or c
  misc_feature (1379)..(1379): n equals a,t,g, or c
  misc_feature (1382)..(1383): n equals a,t,g, or c
ggaacaagctgggatatgtgagcgttaagctactcacatccttcaaaaaggtgaaacatcttacacgggactggagaaccacagcacatgctttgaagtattcagtggtccttgagttgaatgaggnccaccggaaggtgaggaggaccacccccgtcccactgttccccaacgagaacctccccagcaagatgctcctggtctatgatctctacttgtytcctaagctgtgggctctggccaccccccagaagaatgggaagggtgcaagaraaggtgatggaacacctgctcaagctttttgggacttttggagtcatctcatcagtgcggatcctcaaacctgggagagagctgccccctgacatccggaggntccagcagccgctacagctcctctgaccccgagagcaaccccacatcccctatggcgggccgacggcacgngkccaccaacaagctcagcccgtctggccaccagaatctctttctgagtccaaatgcctccccgtgcacaagtccttggagcagccccttggcccaacgcaaaggcgtttccagaaagtccccactggcggaggaaggtagactgaactgcagcaccagccctgagatcttccgcaagtgtatggattattcctctgacagcagcgtcactccctctggcagcccctgggtccggaggcgtcgccaagccgagatggggacccaggagaaaagccccggtacgagtcccctgctctcccggaagatgcagactgcagatgggstacccgtaggtngcttgaggttgcccaggggtcctgacaacaccagaggatttcatggccatgagaggagcagggcctgtgtataaataccttctatttttaatacaagctccactgaaaaccaccttcgttttcaaggttctgacaaacacctggcatgacagaatggaattcgttcccctttgagagattttttattcatgtagacctcttaatttatctatctgtaatatacataaatcggtacgccatggtttgaagaccaccttctagttcaggactcctgttcttcccagcatggccactattttgatgatggctgatgtgtgtgagtgtgatggccctgaagggctgtaggacggaggttccctgggggaagtctgttctttggtatggaatttttctctcttctttggtatggaatttttcccttcagtgactgagctgtcctcgataggccatgcaagggcttcctgagagttcaggaaagttctcttgtgcaacagcaagtagctaagcctatagcatggtgtcttgtaggaccaaatcgatgttacctgtcaagtaaataaataataaaacacccaactgggagtgctgaaaaaaaanaannaaaaaactcg

SEQ ID NO: 1143 - DNA, 1860 bp, Homo sapiens
aattcggcacgagcagcagggagaagaggatgatgagcatgccaggcccctggccgagtccctgctcctggccattgctgacctgctcttctgcccggacttcacggttcagagccaccggaggagcactgtggactcggcagaggacgtccactccctggacagctgtgaatacatctgggaggctggtgtgggcttcgctcactccccccagcctaactacatccacgatatgaaccggatggagctgctgaaactgctgctgacatgcttctccgaggccatgtacctgcccccagctccggaaagtggcagcaccaacccatgggttcagttcttttgttccacggagaacagacatgccctgcccctcttcacctccctcctcaacaccgtgtgtgcctatgaccctgtgggctacgggatcccctacaaccacctgctcttctctgactaccgggaacccctggtggaggaggctgcccaggtgctcattgtcactttggaccacgacagtgccagcagtgccagccccactgtggacggcaccaccactggcaccgccatggatgatgccgatcctccaggccctgagaacctgtttgtgaactacctgtcccgcatccatcgtgaggaggacttccagttcatcctcaagggtatagcccggctgctgtccaaccccctgctccagacctacctgcctaactccaccaagaaagatccagttccaccaggagctgctagttctcttctggaagctctgcgacttcaacaagaaattcctcttcttcgtgctgaagagcagcgacgtcctagacatccttgtccccatcctcttcttcctcaacgatgcccgggccgatcagtgtaagaccagggtgggggtgggatgctgggggctttcctggcggcgaggtggagggctggctatctgccctgactcccaggagctcagcctggcactctgacctcctaggagggaggcctccaaaatggtcactgcctgggcccctccttccccctcccacccgagtgacccctcccacgccacctgccgcagctcgggtgggcctgatgcacattggtgtcttcatcttgctgcttctgagcggggagcggaacttcggggtgcggctgaacaaaccctactcaatccgcgtgcccatggacatcccagtcttcacagggacccacgccgacctgctcattgtggtgttccacaagatcatcaccagcgggcaccagcggttgcagcccctcttcgactgcctgctcaccatcgtggtcaacggtaggggcccggagcttgcactccccgcgctcaccaccaggtggtgtcagccacaggccaacctgccacttgctccaggtttcaagcccctccagcccacagaaagaacgcaagcttgtgtacccttcatagtagccacattaaaaaaaaagggtgacaacaattgaataatatgttttatctatcatcatctcaacatgtagccaatatgaaaattactaatgagatatttaatattcccttctcacactcagtcttgtcgcccaggctggagtgcagtggcaccatctcagctcactgcaacctccgccccttgggttcaagcaattctcatgcctcagcctcctgagtaggtgggattacaggcgtgtgccaccacacctggctaatttttgtatctttagtagagacggggttttgccatgttgtccaggctggtctcgaactcctgacctcagatgatatgcccacctcagcctcccaaagtgctgggattacaggcatgagccactgcatctggcctttttaaaaaaaaaaaaaaaaaaaactcgagggggggcccggta

SEQ ID NO: 1144 - DNA, 655 bp, Homo sapiens
gatgtagagcagactgagctcatccatcatgatttcttcgtgatattactgccaagcagattataaggtgaagtcaatgtgacaaaaggaaattcggctaaaagcttcctgaagccttttgatgctaagcagtccttcttttgatatttaatacccatggacataaacttctgccttagaggtcgccatggagttttgttttgttttgttttgttttgtttttgccatctgttaacagtcctgagtacccatagagccttttactatttatcagcatyctagagtcgtcagtatggattgtcaaaacttgcattkgtctcttttttgttcagtgttgtgtgcatccacatttyctttcttttttaaacaaccctgcttatgtaacatccacattttctgacttacctttcaaacctgccagaaagcagaagtgatatttaawacacttggtatgttttatatatwgattctaatgataatgtttrgtctaagatggacctgacaaggccaggcatrgtggttcaacagcactttgagaggctgaggcaggatgattgcctgagcctgggagttcaaggttacagtgaactgtgatcacatcctgccttctagcctgggtgacagagcaagaccctgtctcaaaaaaaaaaaaaaa

SEQ ID NO: 1145 - DNA, 798 bp, Homo sapiens
  misc_feature (331)..(331): n equals a,t,g, or c
  misc_feature (752)..(752): n equals a,t,g, or c
  misc_feature (795)..(795): n equals a,t,g, or c
aattcggcacgaggttagtctggcaaggaaagcagcaagagaggagtgtcaggcaggtatctggacctgacaccacgtgggcacctgcttatatgtggaattcccctccagatcatctctgcttcctaaatgtctccacagctttcttggccatacaaggcaattcccctcattccagaaaagcctagtcttcaggaatatgcaatggaatgaaaagatataactcactgcaaagaactcagctggtgcttcttgccctgcgcaraktaactgtttcagcctcaagcagctgcagcttatcctcttgataccctggtgcatccaagagccnacaggaattgaggcctgagataacgatagcgttgaactcttcagcgacatttcctggaacttcttgagatgaagagaaaacaagaaaactaactctgagctatagcacttggccagatgttatttatcagccctggggatttacttaatgtctagtctgtaatcctggtttagtggtctgtgtgaaagaagtcctcttcatgcaccaaggatttcaatcaggctaatgactagaaaatgacaaaaatcctcaagctaggattcctccaagamccagtgcaaatatctcctccaagcaaatgtgamaaccccactccccaccatccctggcccatcttgcaaaacccctaacagctttggaaagttgcccaccctggcctgaatggccaccctttataacacttgtccactttgcacacttngttttaattcccaccctatcttagaattaataaagctcccttnagg

SEQ ID NO: 1146 - DNA, 1900 bp, Homo sapiens
  misc_feature (1877)..(1877): n equals a,t,g, or c
gttggtcatatgtacagtatataaacataaaacacacaaggaaggtattatgtatgcagtagtatactagagtttaggaaaatgaaaattttagaaaatatgttttgtcaccctgttggtcagaaagatgtctttctggttttaacgcatgcaggcatgtaaatatttgtctggagtcacagtattaatgaatgagatcttaagcatctggtgacatcagaactctgtgtcagccacttttatttgtatattgaaccctaggctagtgccccaagctgcactattgggaatggattgtggctgaacagcaaatcaaaacaccagaaatatttttatatgttaacgtcatattatgttaatgttgctgaaaacaaaacctaacaaaccttgatgtaccagtccaataccatgtagcgctgagtgataaagttaaaatgtgctgtgcttcccacccttgtcagagggaagggtggctatgtgttattttcactgtctttttgaaagttacagtatgtgttttcactttcgtgcagataactggaagtaaagcggcaaacagtgcttattacatgctaaagttaccttctctttgttttttgcatatctggaattacacctttaaagactgatatgaatcagtacggtcactatacattttatgatttttctgtcatcttaaaattgtatgatcgtaacattatttattaccacaaaacagcaaaatcttcaatgtctaagaaaactagcttaaaatgtttaaatatagttctgattgggtattaattacttgattaagaaaaaattaacattatagatactctggcattacgcttctataccttttaggtcttccttgcaatactggaacataattcttttgtgtagctcactattagccagctaagttcatctttttaataccataaaaaggttatatgtacagttcctattttagcttgcttacaaagggagcattatttttatttaaagtattgctagtaaatgatttgtagaaacttggttttctaagcatagttcttccataaccaccttttgttgtttgagcacaagggattcttttcctagttctatgtgtttgtttccctatatgcagtctttaaaggattacaacacttaaaattgaatggacttgtgtcaagctttttgcatcatacattttttgaaagatttttaaaaaagcctacaacttacatatgtagtagaatcagccattgctctgctcctggcatagagtcacctgttatgtggattaaatagttttaaaatacatatttgaagacctttgagaatgctttagtgtttgatttgaaataaaaggaaattttagcaaggattaaagaaaaaagctatcagctgtatgttaagagagactcttactaacatgttgtaaatattacaattcatgaaatgttattgtaagtctgtaacttaattttttccctgttttagttatacaggttggtttggaaatttgtgttttggcataaacaagtaaaatgtgcccattttatggtttccatgcttttgtaatcctaaaaatattaatgtctagttgttctatattataaccacatttgcgctctatgcaagcccttggaacagaacatactcatcttcatgtaggacctatgaaaattgtctatttttatctatatatttaaagttttctaaaaatgataaaaggttattacgaattttgttgtacaaaatctgtacaaaaatctgtttttacatcataatgcaagaattggaaatttttctatggtagcctagttatttgagcctggtttcaatgtgagaaccacgtttactgttattgtatttaattttcttttccttttcaacaatcctctaantctgtcttgaatctccttgtgtc

SEQ ID NO: 1147 - DNA, 1845 bp, Homo sapiens
aattcggcacgaggaagaaatgaataatgtgagcattaggggcggcagtgggattactcagtgttgagagaaacaacacggaaagcccagagcagaggagggagaaggccccattctctcagctttaatctactgcacctcggagggcagagctctaaccagacaccctggataagagtccgctggctcctggaagctccctggtagacccccagatctctctttgggtgctgatggccattctgctggcctgcttcacagccgtcttggccttcatctgcctccagttctggtgtgtccgttgccatgagccgcgatggtcttacagggctggccacatggaggaggccaatgggttggtgagatggccagaggaggccccggatcttggtcagagggaggaagacctgcaggggctccccctggtggaaatgccacgcaagaactccagagatggagctgaactggatcccgaagccaaccaggatgcccctgatgcgggtgccttacagagggggggggtggtgacccacccgctatactgcctcattgtggggaatgagagtggggaggagagcgcccgcatcatgtagcctaaagctttccacacagtaggtcgtttgtacaaatgtgtctatagactacccatttctctcccatcaaacgtcactgctattgtaggtcacctgggttggatgaatgccccatgacaaagcttctcaagctggaaaatgtatcccccagggtatgccaaggcacaaacaaggcatctcagcagcagcatccactcggaggacacagttaagaattgaaagcattgttttaacattaaaacaaacatggatatgttataaagtagaaagcaaaaatttgcatgacttaaataaaacacagcacttgaaggaaacacttgagttacaagtaggctctcagaggtacacttttgggcaaaggtagatgtccagtttcctctgcccttgaggggattatttggaaataatttgggattatttggaaataatttgtgagaacccttgctctggagtgttttccaacttttaggcaatcacataccaccgctctctattttttaaaaccatggattatcttcactattattaataatactttcctttaaattgactcattttttaagcgtaaacttattttcaaagacagccttatattactccataagtgaaaaaccagcaccctcctgctgcaaacagaagggaagagacataagaataaacatcatgaaaacaagataatattaaataatctgacttagcttctattgcctgccagtgattctgagcttaatgcctgcttgcttgtctttgataaaaagggagatccagtgttggagaggtaataaagacatattagcaccaatatttgtctttctccttgatatagcataagatttgaaagagaatcgaaaagggaagtgctgtttttactttgcgagtcagtgttagttaaatgccatgtctgtgaaccacctcaaatgctgtcagtcagcttcccttgatttgagaaaattgtcttgaccagactaggcaggctgttctggagaagacgcctgtactctccaagcatcatccaagaccttcccagtaccctcttatatctatagagcacaaaatcccagaatcacaggacgacactgcagtgaatcaactaagaaacagcaggagctgagaagccaagacgagaagccccacatccctattcccttgcctacctcatgcattccctgctcggcacccagacttttgcccccattcctgctacttgtgaacaaataaagattcatatactcacaaaaaaaaaaaaaaaaaa

SEQ ID NO: 1148 - DNA, 2199 bp, Homo sapiens
ggcacgaggtttgagaaactgtagtacctagctttctccaaggctgtttgatgctgggatcctcttgtggggggcgtctgtcaacgtcaccatttgggaagtgcgcagagctcagagcagcgcttccatgcttccttctgcttgggggcccctccaggtagcttctttcttcttgctatctttttctttctgttttctctcctcttccccgcaccttgggaggcaggagacccacttggtggtgctggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttggggccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgccctgctctgcctgggactgagcgagtggacttagggctgggcaggcagtagccaccagagggcagcagcgaactaggccaggcctgactggggtctgaagatcagggtcagtgtggctatgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcagcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgacctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttcaaaaaaaaaaaaaaaaaa

SEQ ID NO: 1149 - DNA, 2863 bp, Homo sapiens
ggcacgagcagagatgtcaggtagggtggaagtaggtgacaactggggccagcttctgagctataaaactgtacaaacatgaagaatagttttttcacagtgagctgggctcttacttgctccttctcttgggccacagtgtaaatgagaacacgtagtctctcttccttccacataatgccctcctggggaatgttatcccgccacaccttcaggtttaatccttgaacaagcacctcctaaacctcatctttgtctctaaatgtgctactgagccctggcagcctcttgtcacacccatgggcttcttatcctctgtgtcccgtgctgacctcggcatctttctgccatttttcctcttcccatttttttctcccatatcagtgacagcccattgggccttatcctgaatgcctctctcgcctctcccctgcttcctctgtgctagtcaggcaccagtgctttacattctgccgcctggttatatctgtgtgtcttctctctaccctcacagcgttcatcccaggtatagactgaatatccgaagtgctccaaaattccaaatgttttgagcaccaacgtgacatttaagggaaatgtttattggagccttgcaaatggatttggggtgctcaaccagtaaatatgcaaatattccaaagttcaaaaaaatcccaaattcagaacacttctggtcccaggcatctgagataagagatactcagcctgtatcatctcccccttcctagcctcctggaagtccacagcctctcctcctgtagtttttcccttgaaacttcttttcgaagcactttcacttcgtctttttgtttgttcttcaccgtaagccagtgaagtgagcagggtttaagtaagtgtcctcagtatattggtgaaggaacagacacagttaggggtcaagactctcatgaggttactcaaggaaccagagaaagaacgggactcagactcagatttctcccctcttcagcagactgagggtaagttggggaggcatgaagaggtcaaggcttgggatcagcctgccagctttgccagagcaggagggggctgaggcagaggtgatcaggatagcaagtgccaccagcagctctcacatagtgagcacctgccatgtgtcaggtgccatgctagacacttgatgagttctctctcctttcatcctcatcatagtctgtgaggaaggaattcccatacccactcacagatgggaaaatgaggcataagtgaaggtggcgagggtggttccttattcaagttcacacagccaacacgaggcgggatcaggtttgcacccagacctgtctagctcctagttcctttcctcctgggcttgttgcctcgcagaggcagctgagcagaatgcttgaggatttggttctgcagccaggctgcctgggctttgtgactttgggcaatctgcttaaccttctaggcttcattttcttcatctgtaaagtgggggtaataatagtatctatctcacagggctgttggtaggatcaaggtagttaatatatttcggcatttagaatagttcatggtacataaagatctggaatgtccaggagagccattcatgagtaactgccctccctcaccacaggatgccagcgaagagacaagcacttccgtcatgcagaaaacccccatcatcctctcaaaacctccagcagagcgggtgagcagagaaggagggaggagggggagccgttagggaagggattgcccccattgatgggattttttttacctccgtagtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagatccagaaccggggcatgggcactgccgcaccagcagccatggaccgtgagttggggctgggcagtaccaggttgggaactggcgtctcctcacagatcctcactgcatcctctgtctcctgctttctccaatctccagctgtcgtgggtcaggccaaactactgcccccagagcgcatgaagcacagcatcaagttggtggatgaccagatgaattggtgtgacagtgccatcgaggtaccgaggggtcctgccctgcctgagcttccgcacatcctgcatcctctgatcttccacctctctgtaggcaacaccagactggagggttttgaggcaacttacagcagtgagagggggtggtatcagaacattctcacctaaccagagcggaatttcaactagctcggctgtgcttgctagttggtaaaatacagaactcctttggtaccgattggtaaagaagtactctcactaccaccccaggacccctgggatctcccgtgccatccacagcaggggagtcttttggaccctgctccagtacccttcttatttggttgaaacccttgctggtggctcatgcctgtaatcccagcactttgggaggccaaggtgggagaatcgcctgggcccgggagttcaagaccagcctgggcaacatgggaatactccgtttctaccaaaaatttaaaaattagccaggcatggtggcaggaggcatccaggccactcgggaggctgaggtaggaggatcacttgactccgggaggtcaaggctgcggagagctgtgatcatgacattgcactccaacctcaacaacagagtgagaccctgtctcagtaaaaaaaaaaaaaaaaaaaa

SEQ ID NO: 1150 - DNA, 1442 bp, Homo sapiens
  misc_feature (933)..(933): n equals a,t,g, or c
catgaagatgtgaaaatatcatcttaaccagtttcattctatgaacataatattctggcarctttttctataactgmgaatggtatatctttttatacactgcctaaatcagtactactgccagtcacctgaggtcaggtctgcacaacactaaattgggcaataacatagaacatctaggcagtcttgacagtcaaccagtgtaatcactaggggaagraaaagtaggcctacccttttacttattaacttaagtaataaaaattgtataaaaatatgaatgttsgctgcagaggagcctttacatgcagataatttgaagcagtctttgaaaataacaaaaattattccatttaatgaagggtttgttttgtttagcttttctcttttattcagaaaacatacctgtgccttttgaaagggcttaatcccaaacaggtaatatgtgtggatcaatcatctctcctcccatgaaattaatcattcatggtaatatattaaggctggaacgtagctcttagtgacttaaaacatgacagtaagcatttacactgttggaaggtaatttcattgctatgttattaaaatgatgggaatcctatttatacatttatttatttatttatttacagaagattggttccttccagttcaatttaacagcttcagtgaagttagtataatgataagaaaaattgactgtagctattattccaagtgaaaatcatgcagctgagtcctgctgcatcctgggagcaaagcattaattcaaatgaggagtagtcagtcctagcactgtagacgccgactttaccaaccaagatattgtatgtgtgtgacattcagctaacattgatctagggcacttagtttgctaccacattgttcccttcatgattgaaactgtaaataacataacactttaaggcagcnaagcaaatattttaataagccagaaaggcaagatgtcagagaaaatctgtatattcagctatttggagaactcgtgttttccacaaattaaactggagatgtcatttgaaattttcttcccttaaacatgctgtcacaacatggattccttctcatggatgtctttctaggcttataaatatatggtgtgattgctataattttgtgaaattttattcagcaattaatagtgatttcagcaatatgtactaagattccaaggcagaaataaatgtataaaggatttgagcctgtatgtgtaagaagaaactctctcttcagtcatatttcctaaattcagtgtaagtacctcgctgatttagcactggagttattccttgaatgtgtaaataatgatgttctattctgacctaatgaattcctgtaatgtgaatatttaaaataaaagaattcaatttaaatgtataaaaaaaaaaaaaaaaaaactcggagggggggcccggtaccta

SEQ ID NO: 1151 - DNA, 1882 bp, Homo sapiens
  misc_feature (12)..(12): n equals a,t,g, or c
  misc_feature (565)..(565): n equals a,t,g, or c
ttcggcacgganactggaaggaaagaaagaaaggtcagctttggcccagatgtggttaccccttggtctcctgtctttatgtctttctcctcttcctattctgtcatctccctcacttaagtctcaggcctgtcagcagctcctgtggacattgccatcccctctggtagccttcagagcaaacaggacaacctatgttatggatgtttccaccaaccagggtagtggcatggagcaccgtaaccatctgtgcttctgtgatctctatgacagagccacttctccacctctgaaatgttccctgctctgaaatctggcatgagatggcacaggtgaccacgcagaagccaccagaatyttgcctgccctattcctcctcccaagtctgttctcttattgtcaacctcagcacaacaggctggcgccaatggcattacagagaaagcaatctgtgtggctagtgggcagattaccatgcaagccccaggagaaatggaggagctttgtagccacctccctgtcasccagtattaacatgtccccttccccctgccccgccgtaganttcaggacattcgcccctgtgtgccaccaaaccagggactttccccttsssttgggttggcatccctgggctctctcctggtacccagcaagacgtctgttccagggcagggcacgagctttcaagctccgttactatggcgatggccatgatgttacaatcccacttgcctgaataatcaagtgggaasgggaagcasagggaaatggggccatgtgaatgcagctgctctgttctccctaccctgaggaaaaaccaaagggaagcaacaggaacttctgcaactggtttttatcggaaagatcatcctgcctgcagatgctgttgaaggggcacaagaaattggagctggagaagattgatgaaagtgcaggtgtgtaaggaaatagaacagtctgctgggagtcagacctggaattctgattccaaactctttattactttgggaagtcactcagcctccccgtagccatctccagggtgacggaacccagtgtattacctgctggaaccaaggaaactaacaatgtaggttactagtgaataccccaatggtttctccaattatgcccatgccaccaaaacaataaaacaaaattctctaacactgcaaagagtgagccatgcctgttaacactgtaaagaatgtaacatgtgggggacacacaggggcagatgggatggtttagtttaggattttattagtgcatgccctaccctctgggcgaacgtcccctctgaggttttcttctcggtggggggatttaacttctgtcctagggaaaacagtgtctgatgaggagtgtttccaacacaggctacatgaattcccctataccagtgcgaaagcagccaggagtccccgttggaaaagaacaatgccactctcttttatgtatcttggttctgcaactcatttgttgtaagtagggttaatcgagtatcaggttcacagtatcctgcccttattattttatgattcactgactcaagttccacgaagtccttagaaatggacctcttcatgtaaaatatcttgagaataataaatgtgagggaataagaaaggcaagctttggacacagatatgataggtgcatcagcttcggaagagaagaatgatgtgcagagtgttaggaagacatccgggctgctgagactcgggattagaagaaagagaggtaaataaagtgggtcctggaatcttttaggacttctgctgtaggacaaacagctgcctttggtgttttaatgtctcccaaagtacccttcagccaataaataccatctgttggtgcaaaaaaaaaaaaaaaaaaa

SEQ ID NO: 1152 - DNA, 4165 bp, Homo sapiens
  misc_feature (850)..(850): n equals a,t,g, or c
  misc_feature (957)..(957): n equals a,t,g, or c
  misc_feature (1405)..(1405): n equals a,t,g, or c
gcctgggactatgggcggctggccttgggacagatgcagacaggcttcggcggcaggagagggaccgagtggaacaggaatatgtggcttcagctatgcacggggacagccatgaccggtatgagcgtctcacctctgtctccagctccgttgactttgaccaaagggacaatggtttctgttcctgctgacagccatcttcaggataaaggatgatgagatccgggacaaatgtgggggcatgccgtgcactacctgtcctttcagcggcacatcatcgggctgctggtggttgtggkyktcctmtccgtaggcatcgtgctgcytgtcaacttctcaggggacytgctggagaacaatgcctacagctttgggagaaccaccattgccaacttgaaatcagggaacaacctgctatggctgcacacytccttcgccttcctgtatctgctgctcaccgtctacagcatgcgtagacacacctccaagatgcgctacaaggaggatgatctggtgaagcggaccctcttcatcaatggaatctccaaatatgcagagtcagaaaagatcaagaagcattttgaggaagcctaccccaactgcacagttctcgaagcccgcccgtgttacaacgtggctcgcctaatgttcctcgatgcagagaggaagaaggccgagcggggaaagctgtacttcacaaacctccagagcaaggagaacgtgcctaccatgatcaaccccaagccctgtggccacctctgctgctgtgtggtgcgargctgtgagcargtggargccattgagtactacacaaagctggagcagaagctgaaggaagactacaagcggnagaaggagaaggtgaatkagaagcctcttkgcatggcctttgtcaccttccacaatgagactatcaccgccatmatcctgaaggacttcaacgtgtgtaaatgccanggctgcacctgccgtggggagccacgcccctcatcctgcagcgagtccctgcacatctccaactggaccgtgtcctatgcccctgaccctcagaacatctactgggagcacctctccatccgaggcttcatctggtggctgcgmtgcctggtcatcaatgtcgtcctcttcatcctcctcttcttcctcaccactccagccatcatcatcaccaccatggacaagttcaacgtcaccaagcctgtggagtacctcaacgtgaggcctcatgcccctgtcactttccacgctgggtcacaacacacagataccaggccctgatccctcttccacttgcccagcccagcccgttctgcttgttccaaccccgtgccaccaaccagctcccaaaaacccctgtgtgcacttcccttgggctccctgccamcttccccctgagagaggccancctcaggtgtgcaacacctggagaaacacccagggaagagagagagcctgcatttagtcctgatctcagagaagtccccttccctcacccctcagtctaactgaaaaaatggaaaggtttgactagatcagtggctttggacttggattctgatctctttatcggtgtgaaacccagtgtggaaaagcagggctgctccgatgacagtagggtggcatgcatgtctgcctggcctcccctcacctctcctcccacgcatagagcatacctctttagaacctcagagtttgaagaaggacagtttgcaaatcacttggagtgataataccataatagataagacccagactgcatggattcaaatccctacctcatggcttgctagctagggaagctattgaatcttttttttgcctcagtttactcatctgtcaaatggggtaacagcattattgtgaggattaagacatggcaagtacatcagcactgcttagaacatagtasttgttcagcaaatgctgactatcagtattatccaccctggggttatacatatggccctggcccccaccctcaccccagccctccggatgttctgggcttccaacatgggagccctgagagttgtgaggccaagggcccagctggggaggaggcacataagcaaagccacctgggccccctakactgccctgcctgacgcccccctgtgccctgctgcagaaccccatcatyacccagttcttccccaccctgctgctgtggtgcttctcggccytccttcccamcatygtctamtactcagccttytttgaagcccaytggamacggtaaggtgcctccactcacaccacgcctcgctgtggcctgccctcaatgacccatcctctctgggcarcactttgcccttcaggctcctggccctgggcagtcccacagctggtagggaaggggtagtgcccagcaccctcaccttgkgaggcccacccttcccaggggacactccttggacattgtccttgttgggggagcaagtctggggcctgggctcacttgacctgtaccgttccctgctcccctccctcsagmtctggggagaacaggacaaccatgcacaagtgctacactttcctcatcttcatggtgctgctcctaccctcgctgggactgagcagcctggacctcttcttccgctggctctttgataagaaattcttggctgaggcagctattcggtttgagtgtgtgttcctgcccgacaacggcgccttcttcgtgaactacgtcattgcctcagcctttatcggcaacgccatggacctgctgcgcatcccgggcctgctcatgtacatgatccggctctgcctggcgcgctcggccgccgagaggcgcaacgtgaagcggcatcaggcctacgagttccggtttggcgcagcctacgcctggatgatgtgcgtcttcacggtggtcatgacctacagtatcacctgccccatcatcgtgcccttcgggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacggggttcctagctcccacgtctatgttcacatttgtggtcctggtcatcaccatcgtcatctgtctctgccacgtctgctttggacacttcaaatacctcagtgcccacaactacaagattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggccacatcctgccccaccccacccccactcccacggacactaaaacgctaataatttattagatctaaagccccttcctccccagcccctgctttcattaaggtatttaaacttgggggtttcactgctctccccccatgatggagggagggagccccccaacctcagtgaggagagccccgagccggccccggggcaaagaggggtgcagagggagttcccccagatcagtaccccccacccctccccagctagtagcatgaccaggagagggttaatgagagccaagaggagtacctggtgcacctggtgccggtggctggagacctggggggcaggtggatctggggctgttcccccccctccgttttttccaccccacagttcctcctgggatctggccctccagggaagtggagcctccagcccctaggggatgcatgaggggggagggggtgctgagtgggaggaagagtcaggctcacagctggggtggcctgggggtgggggtgggcaaggctgacactggaaaatgggtttttgcactgtttttttttkggtttttttgttcttttttgtttttttcctttaaaataaaaacaaagaaaagctctgaaaaaaaaaaaaaaaaactcgagggggggcccggtacccaattttccaaatagtgat

SEQ ID NO: 1153 - DNA, 1999 bp, Homo sapiens
  misc_feature (965)..(965): n equals a,t,g, or c
  misc_feature (973)..(973): n equals a,t,g, or c
  misc_feature (1110)..(1110): n equals a,t,g, or c
ggcacgagcccaaccacacacctggggaattgctggcctgacttctgacccctgactcctcatacccttcctccagagcatgacatttgaccaccaactgaaacctgacctctgaccccagaccactggcccttcccccgccctgtggtgacttcataaaggttactagcttctcccctggccttgagacccacacgatggccctgctggctctggccagtgccgtcccgtctgccctgctggccctggctgtcttcagggtgcccgcctgggcctgtctcctctgcttcacaacctactctgagcgcctccgcatctgccagatgtttgttgggatgcggagcccaagcttgaagagtgtgaggaggccttcacggccgccttccagggcctctctgacaccgaaatcagtgaggagaccatccacacttcatcagtgtcctggggaaggtgcagagggagggcaggagaggcccagagggtcaggctgagggacagacagagagaaacagtcagaggagaaaggctcaaagaccatgagaacaacagagacttagggacagagagacacagacaggggasgacagcagggcaaagactcagagaggggaggatggagagtcagagaggggaagatggagactcagagagggggaggatggagactcagagagagaggaagatggagactcggaaagatggagactcaggagtatggagagtcagagaggggaggatggacactcgggaggatggagagtcaggaggatggagactcatagaaaggggaggatggagagtcaggagaggttggagactggagagggaatagagacccagagaggggaggatggagactcagagggtggaagatggagactcaaagaggatggaaacccaggagagaggaggacagagatgaggcagagactaggggaagcaggatagcgactggtcgggggcanagactcanggaggatagagacttgggagggactcaggaagcatagcgactgtggggcaaagagtcagagaggggaggatacagacttgggagggcagagactcagaaacagaatgttcgcattagggacatggtgttgcgggganctgcctcccccagcccctgctccctccctcaccgccagactatgatgagagaagccacctgcatgacaccttcacccagatgacccatgccctgcaggagctggctgctgcccagggatcctttgaggttgccttccctgatgctgcggagaaaatgaagaaggtctttacacagcttaaagaagcccaggcttgcatccctccctgcgaaggtctccaggagttcgcccggcgtttcctctgcagcgggtgctactctagggtctgcgacctcccgctggactgcccagttcaggatgtgacagtgactcggggcgaccaggctatgttttcttgcatcgtaaacttccagctgccaaaggaggagatcacctattcctggaagttcgcaggaggaggtctccggactcaggacttgtcctatttccgagatatgccgcgggccgaaggatacctggcgcggatccggccggctcagctcacgcaccgcgggacgttctcctgcgtgatcaagcaagaccagcgccccctggcccggctctacttctttcttaacgtgacgggccgcccccgcgggcggagacagagttgcaggcctcgttccgggaagtgctgcgctgggcgccgcgggatgccgagctgatcgagccctggaggcccagcctgggcgagctgctggccaggcccgaggctctgacgcccagcaatctgttcctgcttgcagtcctcggggccctcgcatcagcgagtgcgacagtgttggcgtggatgttctttcgatggtactgcagtggcaactaacaaaggtatctttcctccttccctatcctatttccatcctgaaaataaagaatatatttcaactctaaaaaaaaaaaaaaaaaaaaaa

SEQ ID NO: 1154 - DNA, 2235 bp, Homo sapiens
gtaattcggcacgagggttccaccaacatggagctctcgcagatgtcgsagctcatggggctgtcggtgttgcttgggctgctggccctgatggcgacggcggcggtascgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacaratgtggaatacaagaagaagcaggacccctacttgctgaagacaggccgctttgaagaggcggcgggtgccgmgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttyttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaaaaaaaaaaaaaaaaaaaaaaactcga

SEQ ID NO: 1155 - DNA, 1595 bp, Homo sapiens
ggcacgagccggttattttagaactagagttgagatgaatatgacacttcataattacactcactacatttttcacaaattattttttaatgctgaaaagagtaattttacttgttgagatgtttattcattttctaatctatgctaaaagcttttatcataagtcttgggaacagttgtcatttacacattacttactgcagatatcttgactaaatcaggagggaggtgtttaatcatttgatatgtatagttgacactcaggaatagtaatgcctaaaatttacagtggatgaggtctgtttcaagtttaattctttttaaaaatgttttacttatttttaaatcactttgaaaaaattgacctccagaatgctgttttatgaaattggcaaataaatgaaggtattcaatttttgaggaagaatgacattgccacaaaatacctttttgtgacacctattaaaccactatgaaaataacttttcaggatctatttcctatgtggaattctttcaaatgctttcttcacggaaatgttttctcactcttcgttttgttccccttacttacatgtttctcttttccttatactgtgaactctggaacaaaactagattgggttggttggttggttggttggttcttcttggagtttatgtatatcaacaaaggatttgaggtcacttctgagaataatatatcaaaaagggtactggttagagaaaatataagaataaaatccagcccagagagagtactaagaatgtaaatgtgagtaaaaagccagttttgaattctatttacgtgacagtgatgcatgctgtcatttaattctcacaaaaactctcgttatatattttatcctcattttgtagatgaggatagcaggcttagaaggatttggtaatttactaatgtcatgatagggatttaaatctggaattgaagtaattgtgtctcactactctaagctaattgaacatcagacattaagagagatgatccttattgaagtaaaccagttcctaaaggatccttgtagtatacatacttgggaatcctgttcagagtaatttttaggaagtaggtacacagtagtaagtcttctgttgcctcagttggccatagatggaattctgtgtttgccactcattagaaatttaggaattttaggcagggcacggtggctcacacctgtaatcccagcactttgggaggccgaggcgggcagatcacctgaagtcaggagttcaagaccagcctgaccaacatggggaaaccccgtctctactaaaaatacaaaattagccgggcgtggtggtgcatacctgtaatcccagctactcgagaggccgaggcgggtgaatcacttgaggccagaagttcaagaccagcctggccaacatggcaaaactccgtctctactaaaaatacaaaaattagccaggtgtggtaacgcagacctgtaatcccagctactcgaatcaggagaatcacttgaacccaggaggcagaggttgtcagtgagtccgagatcgcactctagcctgggtgacagagtgagactctgtctaaaaaaaaaaaaaaaaaaa

SEQ ID NO: 1156 - DNA, 1777 bp, Homo sapiens
ggcacgaggtccccgacgcgccccgcccaacccctacgatgaagagggcgtccgctggagggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacgctgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcagtacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggacgcgtgccgcccggtgacagcccgccgggcaacggctctggcccacggcacatcaatgactcaccctttgggactctgcctggctctgctgagcccccggctcactgcagtgcggcccgagggctccgagccaccaggttccccacttcgggccctcgccggaggccaggctgttcacgcaagaaccgcacccgcagccactgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttcttaaaaaaaaaaaaaaaaaactcga

SEQ ID NO: 1157 - DNA, 2016 bp, Homo sapiens
ggcacgagtctgcatggccgccgtgttcgtggactcagcttcctggtcaacgactgcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccttctcacgtgtacataatcagagccacaataaattctatttcacacccaaaaaaaaaaaaaaaaaa

SEQ ID NO: 1158 - DNA, 1376 bp, Homo sapiens
  misc_feature (938)..(938): n equals a,t,g, or c
  misc_feature (1350)..(1350): n equals a,t,g, or c
  misc_feature (1358)..(1358): n equals a,t,g, or c
  misc_feature (1360)..(1360): n equals a,t,g, or c
ggcagagggaggaattgaggatgatcctgaagtttttggcctttcacagaatggaaaagaatggggagcagcaggggcgttttgttttgctttgttttgattttkttggtggtaggcattgcaggcagagaaatcaagttctgaattagacatgttattgcactgtgttcagatatacagagacatatatcgatgcctagctgcctagttatctaccaagatgtctattggaaatctatgtgggtaaagagctggasttcaagggagaggctagggtttgagataagaacatgagaccactttccatggtcaaatatccacccccctgagcttctgtgccctgaagggtgtgtcagattccttgtgtgtgcctggcacatagtaggcaatcaagaaagtgccactggttttatggttattgttatacggcacccgccttctctgcccgcagcctccctctcctcttctcccttcctctttcttctytcsccttytyttcytcttctcaakcatcctggggtccgttggtccagatgaaggtacttgccaaggagggagcccacaggtcgatggtcgcgggatggggtcagtggggtcattgtctytcttggctgggaccttaccagtcatgtcagcttgagccacctgtcacttcgtggtggtgctgggcccagaaagcagggcagacctccagcctattaggtcatttctgatttgggattcgtcctactatatgtggctgaccttacaccccagctgtgtcatcctgcttgtcccaaggcctggggtgccatccatctctctgaaaccccatcagcccagatcccgagggctgagatggtacctctgtaggatagcagagtccctacaatcttactctcagtcccagcagcagggacatctttgcctagcctgggtggggatkgaactggagaaangttttgattggctttgggcctgcagacggcaytcacagggaargggcagagctagcctaggaagaactctgctcccagctgggggcggttgctcacgcctgtaatcccagcactttgggaggccaaggtgggtggatcacctgaggtcaggagttcaagaccagcctgaccaacatggcgaaaccctgtctctactaaaaatacaaaaagtagccgggcgtggtggcagacacctgtaatcccaactactcgggaggctgaggcaggagaatctcttgaacctgggaggtggaggctgcagtgagccgagatcacgccattgcactccagcctgggggacagagtgagactctgtctcaaaaaaaaaaaaaaaaaaaaaaaaaaaaactcgagggggggcccgtacccaatncgtccctnangagtgtgtgcgtatta

SEQ ID NO: 1159 - DNA, 1215 bp, Homo sapiens
  misc_feature (15)..(15): n equals a,t,g, or c
  misc_feature (61)..(61): n equals a,t,g, or c
  misc_feature (65)..(65): n equals a,t,g, or c
  misc_feature (104)..(104): n equals a,t,g, or c
  misc_feature (180)..(180): n equals a,t,g, or c
aggaaaagttttccnaattggaaagcgggcagtgagcgcaacgcaattaatgtgagttagntcantcattaggcaccccaggctttacactttatgcttccggntcgtatgttgtgtggaattgtgagcggataacaatttcacacaggaaacagctatgaccatgattacgccaagctntaatacgactcactatagggaaagctggtacgcctgcaggtaccggtccggaattcccgggtcgacccacgcgtccgcccacgcgtccgtgaaaatccgaagtgccgcggaaagtggaggtgagggccgcccgccctagaggtgcccgtccgagaggcagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctcctccccaacttctgtcccagccttgaaggctgaggcacttctttttcagatgccaataaagagcactttatgagtcctccaaaaaaaaaaaaaaaaaaaaaaaaaaaaaaaaaaaaaaaaaaaaaaaaaaaaaaggggcggccgc

SEQ ID NO: 1160 - DNA, 2042 bp, Homo sapiens
ctgcatccaggcgcagaataacctgggtatcttgtggtctgaaagagagaaattgaaactgcacaggcttacctagagtcatcagaagcactatataatcagtatatgaaagaggttgggagtcctcctcttgatcctactgagcgttttcttctgaagaagagaaacttactgaacaagagagatcaaaaagatttgaaaaggtttatactcataacctatattacctagctcaagtctaccagcatctggaaatgtttgagaaggctgctcactattgccatagtacactaaaacgccagcttgagcacaatgcctaccatcctatagagtgggctatcaatgctgctaccttgtcacagttttacatcaataagctatgctttatggaggccaggcactgtttatcagctgctaatgtcatttttggtcaaactggaaagatctcagccacagaagacactcctgaagctgaaggagaagtgccagagctttatcatcaaagaaagggggaaatagcaaggtgctggatcaaatactgtttgactctcatgcagaatgcccaactctccatgcaggacaacataggagagcttgatcttgataaacagtctgaacttagagctttaaggaaaaaagaactagatgaggaggaaagcattcggaaaaaagctgtgcagtttggaaccggtgaactgtgtgatgccatctctgcagtagaagagaaagtgagctacttgagacctttagattttgaagaagccagagaacttttcttattgggtcagcactatgtctttgaggcaaaagagttctttcagattgatggttatgtcactgaccatattgaagttgtccaagaccacagtgctctgtttaaggtgcttgcattctttgaaactgacatggagagacggtgcaagatgcataaacgcrgaatagccatgctagagcccctaactgtagacctgaatccacagtattatctgttggtcaacagacagatccagtttgaaattgcacatgcttactatgatatgatggatttgaaggttgccattgctgacaggctaagggatcctgattcacacattgtaaaaaaaataaataatcttaataagtcagcactgaagtactaccagctcttcttagactccctgagagacccaaataaagtattccctgagcatataggggaagatgttcttcgccctgccatgttagctaagtttcgagttgcccgtctctatggcaaaatcattactgcagatcccaagaaagagctggaaaatttggcaacatcattgggaacattacaaatttattgttgattactgtgaaaagcatcctgaggccgcccaggaaatagaagttgagctagaacttagtaaagagatggttagtcttctcccaacaaaaatggagagattcagaaccaagatggccctgacttaatccttgtttttaaagaaaggaaatgtgcaatattgaagtgatctttttccctagtcagacaggcccaattccattgtgatgtttacctttatagccaggtgagtgcagtttgaacttgagatacagtcaactgagtgtttgctaggatcctaaggaacataaagttaattaaaaacttacacctaattatgtaaattgccttgttaaagacatgtgatttgtattttagatgcttgtttcctattaaaatacagacatttctaccctcagtttctaaatgtagactatttgttggctagtacttgatagattccttgtaagaaaaaatgctgggtaatgtacctggtaacaagcctgttaatatattaagattgaaaaagtaacttctatagttactccttctaaaatatttgacttcctacattccccccacccaaaatctttcccttttgaaaatactaaaaactaagttatgttattataaagtgtaaaatggtttgtcttaattataggagaaaaaggccttgttagaaataaaataaactgacttatttcactaatgaaaaaaaaaaaaaaaaaaaaaaatt

SEQ ID NO: 1161 - DNA, 632 bp, Homo sapiens
  misc_feature (557)..(557): n equals a,t,g, or c
  misc_feature (571)..(571): n equals a,t,g, or c
  misc_feature (608)..(608): n equals a,t,g, or c
ggcacgagccgcagctcccctcttccttcctctgcagacgctggcgctgtctgccggaggtgttgcccaaaaggccctagtggggcgtggtcagctccacctcctgatcctgtgtgtcctccgacatgctgctgattctagtgacccctgtccccaccaggctcagagccagaccgcgcctggaccttcttgttctgactccacgtgcctgcccggcctccagggtgcgggggcgcctttcttgcaggcggaccctgcccaggatggggccagcctcgtgctcagctttggccacaaatgcagcccctggcccaccccaccctgccggccctgccttctccagtatttcccacatggccacgactcctcagtcactagagcctcctgctgggaacagtgtcccccagagcctcatgtctatcctagaccctgcaagcagctgggtccccaagagtgcatctccccctagagttgcctgcccatgcccacctgctttgtaaccttcccaggagattcatgcttgctctgcacagcagggytcgaggsccaggscatgnamasggaaytgccntcaggtttgggtcaractgcatcctgggggcatctgntggaaatgtgagcacacaaaccaa

SEQ ID NO: 1162 - DNA, 1519 bp, Homo sapiens
cggcacgaggtaaattctgccttcacccagtatatctttccaatgtaggatgatttatttttcattacatttgttctaagattttgtagtgattactctagtgtttgtcatgtaaatgttagtttatcaaaatcaggctcagttctccagtaatatgtggttaaatttcagtgatgtacacacatatttgtcctctatagctctattatgtttttgcctttctggggtactttgttgcatatgtaacaactcagtgttccacattcaacaatatattcttataattattacttttccactggtagtcatttagttcagtttttatggtgttatttataaatataatacatgtatgttaaatttttctatgttgtaggcctaacaatccattactacttattactttacacaattgacttgtaaatccataacaaggagaaaggtgaagaaacacatattcagtttgtcttttccacttatatagtcttgcatggtgctctctgctttttcctgtggattttgacagactcaataattttttttttttttgagatggagtcttcctctgttgtcccaggctggagtgcggtggctctatcttggccactgcagcctccacctgccgggttcaaatgattgtcctgcctcagccccccaagtagctgggactacaggcgtgtgccaccacacccggctaatttttgtatttttttttttttttgtagagacagggttttgccatgtttgccagggtgctctcaaactcctgacctctagtgatccaccagcctcggcctcccaaagtgctgagattacagacgcgagccaccgcacctggcactttggtcttgtagggctggtgtgccaggaaaaattctctcaatgttcatatttttaagcctaggaaaatatttgttttgtctttcattttgaacatgaacattgttggattctggttaaggtgtgttttggagcagagcatgatgagggactgggtgaggggcttcccagtgaaaggaggaacagaacctagcaaaagcaaatatgtctgtttcactccaatcacttattacaataacctctattacttaatatcaaaaaaaaagcaatgatcaatatgttgaaagggatggaagaagcaagtatgatgtttgaccataatagcattcattgcttgggaaactaaagacaaaacaactggaaaactattaacactgttggccaggtgtggtggctcatgcctgtcatcccagcactttgggaggctggggtggatggatcgcttgagcccaggagttcgagaccagcctgggcaacatggcgaaacctcatctctacaaaaaatacaaaaaattacccgggtctggtggtgtgttcctgtggtcccagctactcgggaggctgagatggaaggattgcttgagcctgggaagtcgatgctgcagtgagccaggattgcaccactgcactctagcctgagtgacagagtgagaccctgtctaaaaaaaaaaaaaaaaaa

SEQ ID NO: 1163 - DNA, 2419 bp, Homo sapiens
ggcacgagagagagtgagccaccatgcccagctttttaattttttttttttgaaacctattacagtaactccctgagatgaagatgagacgtttagcttcctcacactccctcctcctcctccttccccatgcacctcccatgctttgttcaatgttactctccttttacttgcttaaggtactctttcttatgccattgactttagacggaattccttggctttactgagtaagatggggaaattagaaatctgcagtccccaatgttaacactcactcattttgttagctatgactatttcattgtcaagcggttggttggttggttagttggttggttggtttgttttgttttggtttcaccattcatacacagtctgtccactaattataattttttgtgctttatgtgtgggtagattctaaaaagtcagaaaccaataaacctgtattatgattatatagtatattattcacattagttcctagaagtgtggttgactcattaaaaatgtaatcctatattacaaaattcatacaactaaagtgtcaaaggaaattaatgttctctgtttcccccctcaatagctcaggatcatgccacatttaagcttcatattttgatcatgtttttattttcagtttcatcctgaaacttttatttccagttttatgaaagtagtacatgttcacacttttaaaactgaaatagttccacatggcttaaaatgcaaaacacgcttccctttcactaccctttggtgcttcctaaaagccaccattctcaactcttttagctcttcccttagctattgatttttgtatttgttaaaaacatgctcttactgctgtttgttgtttttcagtttgagatattatattatgattattattattaatattagagacagggtcttgctctgttgcccaggctggagtgcagtggtgcaatctcagctcactgcaacctctgcctccccggctcaagcaattctcccacctcagcctcctgagtagctgggaccacaggtgtgcatcaccacgaccgttttttgttttgttttgttttgtttttaaggacacagggtttcaccacgttgcccagactggtctccatctcctggactcaagcgatccacccacctcagcctcccaaagtgctgggattacaagcgttgagtcaccgcgcctggccagagataatatcttattgacctcctctatatgggatgctgtgcccggccacacctcacatacacacattgcactcacacatgtgcttctcctccccagttccttcagcatgtttatgccagtttttgttgaatcagtagtaagtgttcatattatgttaactctgtaattgttctttacacctgagctgtgtagtttctatgtacatgtcacttattcatctccaaattctccaaccaaattgaaaatctcagaacataatgaaagatgtaggccctccttcggattgcattgttttttggagccatccctgcccctgctcccaggtagtctggctgctctgcaggcctgctgcaagctgtcaggcttacattgcccttcgtctgcactctggggatcctcatttctctcccaggttgtgttccttattacctggaccctcttgcttggtttacactcctgtttagatagagcacctcctcctgtaccttcacagaaaaagcacagagaatggaaaactcatatcttgcatgtctgaaaaaatccttattctgccttacatttgaataataattttataggatatagaattttagtttggaaaacattttccttccgaattttaaaggcattgctctgttgtcttctagtttcaaatgttgctttacataaatattctgatgcaattctaattactgattatttgcacatgacctacttttttctctctggaatattttagattcttgggtatctgataatctggaatttcatggtaagatgccttgttgtgaacctttttttattttttatttttattttttgagataagttcttgctctgtcacctaggctggagtgcagtgatgtaatcacagcttgctgcagtcttgacctcttgggctcaagtgatccttctgcctcagcctcccaagtagctgagaccgcaagcacgcaccaccacacacagctgattttttaaacttttggtccattccaagatggccgaataagaacagctctggtctgcagctcccagcgtgattgacgcagaagacgggtgatttccgcatttccaactgagcgagaaggcatccatctccaaaccaaggagagggccctcaccggacatcagatctactggtaccttaatcttggactttccagcctccagagctgtgagaaataaatgtttgttttttaaaccaaaaaaaaaaaaaaaaaa

SEQ ID NO: 1164 - DNA, 1189 bp, Homo sapiens
cccccgggctgcaggcggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcagatatgtgcagcgggggctacagcgagtggggctagatccccagctgccactgaatctggctgcccttcaggcccacctggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggacacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggaaaaaaaaaaaaaaaaaa

SEQ ID NO: 1165 - DNA, 1348 bp, Homo sapiens
  misc_feature (407)..(408): n equals a,t,g, or c
  misc_feature (1331)..(1331): n equals a,t,g, or c
gcgccttcacgatgccggcggtcagtggtccaggtcccttattctgccttctcctcctgctcctggacccccacagccctgagacggggtgtcctcctctacgcaggtttgagtacaagctcagcttcaaaggcccaaggctggcattgcctggggctggaatacccttctggagccatcatggaggtgaggggcaggggtggggaccgctatgcccagggtccctcaaagtgctggaggggctgtracttggtggggagtgggtctgtcacagccatcctctgtccagggtggggcaaggcctgggacagtgccaggcaccccaggaccccttccaggcttgtctcctgctccaccgcctcaacaccccccacccctgcccaagctgtttctcctctgcctctctnnttccctgccccaggacttctctcttctcctctgcctctccttggacccctgcccttcctctacctctgacctgtgaacacacagacacatgctcacacactaagtcccargcacacmsaaaggcaatgtggaccagcacaaacctccactctcccggctccatcccarcgggcctgtggctggccatgaaaactgggggctacctggagggaagcatcctcatcccaggtgagtgggcaccagcccttccctgtatgtgtgttgtgggtggaagcaggcatgagagcatcttagcccataggtttgtattcagggacttccaaacccagacctacaaagagtgtgtcttctaccagatcttgttcaaaaaagggtttgtgatgatggaactacacgatagagggagtgagcaagaacaatgaggattagagtggagcgtgaaatagtctaggagcatggcttccaaaacatatgctgtgaggtctgtccacctgagagttgggccatggatttaattctgagcctcttagcaggcaaagcaaagacagaaagcagatcggctgtggatttctgtctataaaatgtgagttcttggccgggtgcggtggctcacgcctgtaatcccggcgctttgggaggccagggcggatgggtcgcgaggtcaggaggttggaaaccatcctggccggaatggtgaagccctgactctactagaagtgcaaagattggctgggtgtggtggcgtgcgcctgtggtcccagcttctcgggaggctgaggcgggagagttgcttgggcctgggaggccgaggttgcggtgagctgagatcctgccattgcacttcagcctgggcacagagccagactctggctcaaaaaaaaaaaaaaaaaaaactcgaggggggcccgtacccaattcgccgnatatgatcgtaaacaat

SEQ ID NO: 1166 - DNA, 2007 bp, Homo sapiens
gaattcggcacgagaacaaaacaaaacaaaacaaaaaactagatatgtaatttctaaacacccagatcacaatgacaagatgccactccaaccatgggacaccttcatgatactaggtttgtacttcctggtctctgggatgacttcagattctgctggccaaggcaaattgaactcagttcaagatggccaccactggtagacgtgtagatagaaaagaggactggtcttgggaacatctttggaaaaaccaacaaacaatagttctagggagatgaggaaaaaaattcaccttacagtgctaagaaagtgcattagaatggaattgccctttccttaaggagacagtttgggctctccccttgccaccggctctggtgttttggcttatgcgttccttcaggttgagctgagcagtgtgttatgggaagctgctcaatttcctttcattcaattccacctccttcctgaactctaatagaggttaaaagggaaaaaaaaaaattctgtagatagcaaattgtgtgtgtgggggggggtgggggtgtgggtgcatggaggacaacctgcaactctgagctccctacttcctggctcatttcatgcagtcttttctgaacagcctatgctgctgccctgctggccccttgtgcacggcagctggccgtgtccgtagctgtcagtatgacttagatctagctcctacctactggttgatgtgttttttccttttgccaagtgattgagtctgtttagtagtttccatcattctagtctttaagtaaaaatgacactattgaggaaagtcagtctactcccttcttcctccccccaaacacgtgttctcttttgtcaggaaactcagccagtgggctgtggcagagaaagtcctccactcagaggcagagactgagttaagtcataggtggccttaggcatctgcattgtttgcaggggttaagttttccttccagtgagggctggagggatgaattagctggtacctgaagccccgcttagctctgacactctgccaacatcctctgattctaggtgtggtgttgactgtcctttcaaggaaaaacttgcaatagagggaaaagccattaaagcagctccctgcttcatcattaagtcctgtcatccctaccagccaatcccagtcaaagaagttatgctttattcacttctgtggaattacaagtgagagacacttttaggacctgatggacaaagcaggagattcactgtcagctttcctggtcctctccttacttctgtgggccttgcaccgtcttagtttacacatctgccaaaggggtagaattacacttctttttacaggtaaatgtcaaggcacaatcagttttcaggaagtgcttcaagaccccaggtgaaatgaaaatgctaagtaccctctgaatggccatgcctgttaccaggtgctgcttcttcagatgatggggagcacttttcagggtgaaattcaggcgagttttgcccaggcctgctgtcttgagtacaaatgtgaatgatcgactgactgcttgttgccaaactggaaatgttctgtagggatttactggcatggtatcattcctagaagaaaaaaagagagaaacttgactgcacattaaaaaaaaaaaaatccacattgtgacttttatttaatttctattttttttggtaataaaaagttgacttttttatttgaatttgtcttttttatttattggtctgaaaggcatttcaaaggtattataataatatattggtgtaatttaattggtgcaacatgctttatggctcctgtcaaaattggttttcactcatttgattggtttgagcccagaacagcctacaggggaaaaacaagctggataaccacccaaagtgtttgtattttcgttggaaactgatttttgtttcattttggtttttgtttctgtttttatttttaaattaaataaattgcaatgaactgaaaaaaaaaaaaaaaaaactcga

SEQ ID NO: 1167 - DNA, 990 bp, Homo sapiens
  misc_feature (751)..(751): n equals a,t,g, or c
  misc_feature (879)..(879): n equals a,t,g, or c
  misc_feature (888)..(888): n equals a,t,g, or c
  misc_feature (897)..(897): n equals a,t,g, or c
  misc_feature (899)..(899): n equals a,t,g, or c
  misc_feature (901)..(901): n equals a,t,g, or c
ggggaactgcagtgacagcaggagtaagagtgggaggcaggacagagctgggacacaggtatggagagggggttcagcgagcctagagagggcagactatcagggtgccggcggtgagaatccagggagaggagcggaaacagaagaggggcagaagaccggggcacttgtgggttgcagagcccctcagccatgttgggagccaagccacactggctaccaggtcccctacacagtcccgggctgcccttggttctggtgcttctggccctgggggccgggtgggcccaggaggggtcagagcccgtcctgctggagggggagtgcctggtggtctgtgagcctggccgagctgctgcaggggggcccgggggagcagccctgggagaggcaccccctgggcgagtggcatttgytgcggtccgaagccaccaccatgagccagcaggggaaaccggcaatggcaccagtggggccatctacttcgaccaggtcctggtgaacgagggcggtggctttgaccgggcctctggctccttcgtagcccctgtccggggtgtctacagcttccggttccatgtggtgaaggtgtacaaccgccaaactgtccaggtgagcctgatgctgaacacgtggcctgtcatctcagcctttgccaatgatcctgacgtgacccgggaggcagccaccagctctgtgctactgcccttggaccctggggaccgagtgtctctgcgcctgcgtcgggggnaatctactgggtggttggaaatactcaagtttctctggcttcctcatcttccctctctgaaggacccaagtctttcaagcacaagaatccagcccctgacaactttcttctgccctctcttgccccanaaacagcanaagcagganananactccctctggctcctatcccacctctttgcatgggaacctgtgccaaacacccaagtttaagaaaaaaataaaactgtggcatctcca

SEQ ID NO: 1168 - DNA, 1126 bp, Homo sapiens
ggcacgagggagtaagtcctgagcccagacaggggagtcacctgctccaggccacacacggctgcagccccagccctcaggacccatcctgcacagaccccaaggtttgcgtgccatgtgcataggcagcttggacaaacgtaaggacacaggagtcccagaccaggttccagacatgatgttctccttgaacctctgcctcggtgggatgtgtcctcaccatcctcctgtggccctaggtctggagtgtgacctggctcagcacctggccggccagcatctggccaaggcgctggtggtgaaggcgctgaaggcctttgtgcgggacccagcccccaccaagccgctggtcctctccctgcacggctggaccggcaccggcaaatcctatgtcagctccctgctggcgcactacctcttccagggcggcctccgcagcccccgcgtgcaccacttttctcccgtcctccacttcccccaccccagccacatcgagcgctacaaggtaggctggatgcgtccttgaccactgttctcaccatggggtgccaccctagggagtaagtcctgagccctgggagcccggctggcgccggccagagaagctgaggacccagagggtgggaccgaggggcggggcccgcagacttgggagggtggagggtacccgttgaggtccaggaggccctgccaacctggagagaggcctcagccagcagaacccttggtggaagttcttgggcctccccggaatggcctggccgtcaaaggagaagtgcagtgcgccttggggatgggcggggtctgcggctgaccccgttgacagctcgcatttagagctgagtgcaatctagaggaccgcctggtgggggcgctgccgagctgaatcaggcccgaaggtggctcttttccacccttgccccttgcctccttggtcgggcaccatacctcctcccctccaccccacaccctgtgtccatatcaagccaggtggagccttctcagtttccagaaatggagggactcaagctgccacttgggcctggttttagatgtttttaattttgtaaaagaaaacaagtataataaactcagctgtgggaccagaaaaaaaaaaaaaaaaaaa

SEQ ID NO: 1169 - DNA, 2287 bp, Homo sapiens
ggcacgagcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggcccctcccggcacccatctctgatatcaagtgactccaacaacctaaaactcaacaacgtgcgcctgccacgggagaacatgtccctcccatccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccattcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcaaaaaaaaaaaaaaaaaaaa

SEQ ID NO: 1170 - DNA, 1189 bp, Homo sapiens
ggcacgagatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagataactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcatgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctgcatgttcatttggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataattgtaaataaagaactcaccatctctgttcatttaatactatgcaatggttatgctttcaatcgctggctcttctgactcgtgcagtgtggttctgaaatgtttgtggtttaaaaaaaaaagcaaaaaacactcaacagaacatagtaaatataaaaaaaaaaaaaaaaaa

SEQ ID NO: 1171 - DNA, 866 bp, Homo sapiens
  misc_feature (20)..(20): n equals a,t,g, or c
  misc_feature (375)..(375): n equals a,t,g, or c
  misc_feature (847)..(847): n equals a,t,g, or c
cgaattgggtgccgggcccnccctcgagttttttttttttttttttaaatgaacagagatggtgagttctttatttacaattattgtctagataaaaaaattcataaaaacagatgaatggtcataaattatttaccccctaatggagtgaactgccaaacgtaccccatgctgctagatataggacgcagagtgcaagctttatgtactacagtgagttttgacaaaccaaccatttcgtgtgtgtgtgtgtgtatgtgtgcaagtgtgagagtgagggggtgcatgtgtgcaagcatccttcattcctgacaagagaagaccaacgctaatgttgggcattcttccatcgctccctgttccctaagccagggntccactgaggaacccctcctggctccraatgaacatgggagcatgggtgtgcaaacacagctatcctgatgtcatggaacgaggtcacggacacatgactgatcaaagaagtggggagatggaaaactgtgagaaaggaaactccaaaaaacaccatgttccaaggctgccccatgttttacacgtgcagatctttccttccttgtaggagagcagtgggctggctttggtggcgtttgtactggaatccaataagcacatctgagggctggtcacccctttggttatgcagttcctctcctggatacattcagagatacttcttcaygacattcaggtgatgcgctcttgaaggtcctccttccaggaggattttgccaggtgggatgggctgactttgaaccccaaaccctcaagtttttccaccgccatccagatgtaggccctcccagttgactwtggtattggggcncgatggtctaagattgttt

SEQ ID NO: 1172 - DNA, 1314 bp, Homo sapiens
ccacgcgtccgggcctcagggtggacgcatggttctgcactgaggccctcgtcatggtggcgcctgtgtggtacttggtagcggcggctctgctagtcggctttatcctcttcctgactcgcagccggggccgggcggcatcagccggccaagagccactgcacaatgaggagctggcaggagcaggccgggtggcccagcctgggcccctggagcctgaggagccgagagctggaggcaggcctcggcgccggagggacctgggcagccgcctacaggcccagcgtcgagcccagcgggtggcctgggcagaagcagatgagaacgaggaggaagctgtcatcctagcccaggaggaggaaggtgtcgagaagccagcggaaactcacctgtcggggaaaattggagctaagaaactgcggaagctggaggagaaacaagcgcgaaaggcccagcgtgaggcagaggaggctgaacgtgaggagcggaaacgactcgagtcccagcgcgaagctgagtggaagaaggaggaggagcggcttcgcctggaggaggagcagaaggaggaggaggagaggaaggcccgcgaggagcaggcccagcgggagcatgaggagtacctgaaactgaaggaggcctttgtggtggaggaggaaggcgtaggagagaccatgactgaggaacagtcccagagcttcctgacagagttcatcaactacatcaagcagtccaaggttgtgctcttggaagacctggcttcccaggtgggcctacgcactcaggacaccataaatcgcatccaggacctgctggctgaggggactataacaggtgtgattgacgaccggggcaagttcatctacataaccccagaggaactggccgccgtggccaacttcatccgacagcggggccgggtgtccatcgccgagcttgcccaagccagcaactccctcatcgcctggggccgggagtcccctgcccaagccccagcctgaccccagtccttccctcttggactcagagttggtgtggcctacctggctatacatcttcatccctccccaccatcctggggaagtgatggtgtggccaggcagttatagattaaaggcctgtgagtactgctgagcttggtgtggcttggtgtggcagaaggcctggcctaggatcctagataagcaggtgaaatttaggcttcagaatatatccgagaggtggggagggtcccttggaagctggtgaagtcctgttcttattatgaatccattcattcaagaaaatagcctgttgcaaaaaaaaaaaaaaaaaaaa

SEQ ID NO: 1173 - DNA, 1680 bp, Homo sapiens
ggcacgagggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagctggatgcccaagagttcctgaagctcctcatggagcggctacaccttgaaatcaaccgccgagaccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttattaagaaaaaaaaaaaaaaaaa

SEQ ID NO: 1174 - DNA, 1502 bp, Homo sapiens
  misc_feature (446)..(446): n equals a,t,g, or c
  misc_feature (470)..(470): n equals a,t,g, or c
  misc_feature (1024)..(1024): n equals a,t,g, or c
ctcaaaataaataaataaataaaaatttgtattccattgatttgggtagacaccaggaatgtgcatttctaacaagctttccaggcgatcctatagtaagtcatctgtggactactttaagaaactcttctatagagaatggagttggattaataataggtgattttttacactggactgattcacaagaacctaaacagtagtccatgaagctgctcatctgtggtaactatttggccccgtctcactctgaaagcagcaggagatgttgtttactttgtttctatcccctttgtctggagattaattttggaatgaaagtttttctctctatgccattcctggttcttttccaaagcctcatacaagaggattaggtcacaatgcatgcattaccttttaaaagaatgcgatattgataccgatgcttactttttttttttttnactacttgttttattccttc[450 bp omitted]cttccttggtatagtggaggatttgaggattggaatatagagtagagtgcttgcttaagcctgggagcccatctttatagctatttgatgtaagaaaagagacatggnccatttctaaactatataaggtgagtgtgtctattcccagcagatataaaggaaaaaggaaacttttttgattcccaccttcccagcctcacctagccatcttccagcctcaaatatagagatgttagtgcaaggtcctgggctctaggtgatcatttcataagtcctttacagataaagaaaaagtagtgtttgtatgtttgtttttaagtaaccccaaaacaaatttatattgtattcagcaaaattggaattcaggtgtttaattttagaacatgaagtgcctgctgttttaagcattgacttgtataaaaagaattgcatgtctccagtaagcttatgggttttctcatttttaggtatatggcttttaatcatgtaaagtgaaacattagttttcttgcattttattacaggttctttgttgcaataaagatgctgctgaaattaattgaaaaaaaaaaaaaaaaaaactcga

SEQ ID NO: 1175 - DNA, 1641 bp, Homo sapiens
  misc_feature (1603)..(1603): n equals a,t,g, or c
  misc_feature (1632)..(1632): n equals a,t,g, or c
gcggacgcgtgggcggacgcgtgggcttgcttgctgtgactggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccagctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatattattatgttagttttagcgtggaaattggaggctgaaascatgggattttttaccaaggaagaatggttaaagggaatgacttcattacagtgtgactgcacagaaaakttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagaacaataaagattcagatttgtgacaaaaaaaaaaaaaaaaaaattaatttcaacgagaaggcgatccataaggagggctgtgtggagaagattgggggctggctgaggaaaaatgtgctggtggtagctgcagcagcccttggaattkcttwyrtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaaaaaaaaaaaaaanaactcggggggggccccgtaacccaattngccctaaag

SEQ ID NO: 1176 - DNA, 1318 bp, Homo sapiens
cccacgcgtccgaacagctcttaattggtgctttcagtttttaatggacttcctgatgttaagagagtgagagagcagtggtttacttaatcaccggggcccttttcatagtttcgtcttgtgtgctgtgctttttacccagctctaggagggagatgtttgtgggtaccagggttttgttagtccctctccccttttttagtataagtggcatgctggcaatagacaaataccttcataaaaagctgcttctaaatgaaataattactacctccacttgggcattatgataattatcaatagaatattgaatcagcttggtttttcaggaaaaaaaaatccaaacaaaccttccttaaacaaggaaggttttatttcaggtctccaattagagtaaacaagcatttggggcttttcctcttgttttctgtgttaggattgtgaatactagtctgctatagaaggttgctagttactttctgtaatgtaggcagtttctggggattggagacacagatgggagtaaagggtctggattcttctctttcccacctgcctgtttggctttccctcagcctcccaccctgtgcccatgtgccccttctctgatctctgtgctcagatggcagggaccataggagttcatgtgtccagaggtaacactacccgagtctgtgatactcagaagcttccagttccttattaaaacgggaaattgaacagtaaattgttactgcctaccagatttcacagcaggagactgtcattacacctttcatttgactcagagagagtgtagccatcagatgcccagattttgccattctttagtcacttggaaaatgcacccattgtcagcattttgagttattaggattcctcaaatgaaaaaaaggcaaacaatatattttgatggattgaaatccacactgttgtgctgaaaataggggaaggaaaaaaggaagccaagattttggcagaaaactgaacactcttaagaataactcctcagccgggcgcggtggctcgcgcctgtaatcccagcactttgggaggccgaagtgggcggatcacgaggtcaggagatcgagaccatcctggctaatgtggtgaaaccccgtctctactaaaaatacaaaaaattagccgggcgtggtggcgggcgcctgtagtcccagctactcgggaggctgaggcaggagaatggcgtgaacccgggaggcggagcttgcagtgagctgagatagcgccactgcactccagcctgggtgacagagcgagactccgtctcaaaaaaaaaaaaaaaaaaaaaaaaaaa

SEQ ID NO: 1177 - DNA, 885 bp, Homo sapiens
  misc_feature (7)..(7): n equals a,t,g, or c
gggtcgnacccacgcgtccgaatttactttgctactttaatgattaattggcaatgatcaatgcacaaccttttactctcatgtgttattttcaattttccccttgtgtttattgtagcaagaactccctaccttccttccttattatctatttgtaatttggaagccccagtataccttagaattgatccaggatggcctcatttatgtatggcttgagagttttttttaacagaaaaaacattgattctctaaaaaataagagtttatatcatagtttctcaatattttcctatctacaaggacaaaattttttttcagaagcaaaacaactagcatactaactttctgtttatgcagtagtaaatattggttgattactgcacaatttccaggaawtatgcagagataactacagagatgagtagaataaaactcattttagagcttcaaactctagtcagagatgtagttacaaacaaataatccagtgtagttagttaggtactctggcagaagtgtaatgaaagtagtatgaaaaaacagagaaagaaatcgaaggaacacatggacaaagtgatattaaaaagaatgaggccgggtgcagtggctcacgcctgtgatcccagcactttgggaggacctgaggtcaggagttcaagtccagcttggccaacatggtgaaagctcatctttactaaaaatacaaaaattagccagatgtggtggcaagtgcctgtaaccccagctactcctgaggctgaggggcagcagaattgcttgaacccaggaggtggaggttgcagtgagccgagattgcgccactgcactccagcctggctgacaagagcaaaacactgtcaaaaaaaaaaaaaaagggcggcc

SEQ ID NO: 1178 - DNA, 2076 bp, Homo sapiens
ccacgcgtccgctccagtcggcgtctcagcagtctccggtgtccacgcgttgactgccgtgtgtgactccagtcggcgtctcagcagtctccggtgtccacgcgttgactgccgtgtgtgactccagtcggcgtctcagcagtctccggtgtccacgcgttgactgccgtgtgtgactccagtcggcgtcttaacagtctccggtgtccatgcgttgactgccatgtatgactccaggtattgagttcatcttcaacttctcccaacaatgaactggagttttctgtgcatgtgtctggcatgttttcctttagatctagtcctaggtgttcgatatgctattgaggactgtgtatttttatttcatttgtcacctgtgcgtggtgctttaatcctgtgccctaaactcccgccttggccatggcggtgtttctgtggactcgtggggtttccgtgtgcacacgcgtgtcctctgtctgacagtggctttgcttccccttgtcagtctgtgcctcggcttctcactgcactggcgaggtgagccggcgcttgctaatcttattccagtctcggtgaacatgggctcagtctttcccggctcagtgttgggtttgcactggtgcacttacaggggaagagcttcctcatttgctgagggcttttcctgaatccgtgttgaatgggtcagtgcctttcctgcacctagtgagatgctcatgaggtcacttccttaccgcattactgtagtgaattacgctgactttcatatgccaagatgacctggcatttcaggtaagtccctgtggccatggtgcattggccttttctctgcatggccagatgagatttgctcataccgggctaaggacctcctgtgtaggaatgctcttgagggacactgggcttggatgttcattgtcttgtcatgtgatgtgtgtgtcatggttgatattgcattaagtgggcctcctgaaacaagttctgccatagtttgtataggattggcattatttgtttcatagagatgtgatgggtgaggccatctatgcctgccattttctttttgcttaggtttttcattaagaacttgatttttaaaaatagacatgaggcctggcatggtggctcacgcttgtaatcccagcactttgggaggccaacgtggatggatcacctgaggtcaggagtttgagaccaacctagtcaacatggtgaaaccccgtctccattaaaaatataaaaattagcagggtgtggtggtgcatgcctgtaatcccagctactctggaggctgaggcaggagaatcacttgaactcaggaggtggaggttgcagtgagctgagatcacaccactgcactccagcctgggcaacagagcgaggctctgtctcaaaaaaaaagacatgaggcttttggattttctgtttcttcctttgtcatttttttaaagataggtttgtcgcagaatttcatctaagttatcaaaacaatttacataaatcattcacagtatcctctgtgcagtgatgtccattctcattcctgctctgggccatttgtgttttcttttccccctgatcagactagctaagagtttatcatttttacagatattttccccaaagaaacctacttttgggtccattgattttttttttctattgttttctttttcattgacttttgctcttttcttatgaatttcctttcttctacctattttgtgttcaatttgctgtccttgttttaggttcttttgatagaggcttagatcattgatgaagaatatgaaagaatgggataatacagttaaaaacttggtctacttatgcccattagagaaaacattcttaagcacgcatggaatcttttaaaaatggacgaggtactaggacccaaagcaaatgtcagtaattcgcagatgataatgtaatgtataaatatatgatatgtaggtaaataatacaaatcacattctttggccagagtgcaactgaggaggaaatcagtaacaaaaagacaattaaatccatttgattcttttgaaaaaaaaaaaaaaaaaaaaaaaaaaaaaa

SEQ ID NO: 1179 - DNA, 687 bp, Homo sapiens
  misc_feature (57)..(57): n equals a,t,g, or c
aattcggcacgagaaaaaataaaaaaaataagccaggtgtggtggtgggcacctgtnatctcagctacgtgggaggctgaggcaggagaatctyttgaacctaggaggcagaggttgcagtgagccaagattgtsccagcctgggcgacaggtgaggctcttgtctcaaaaaaaaaagtccacatcttcatgaaccctcagactctggagttgggtgtcggcttttttagccagcttttgtgggaattgcctttgacctattaaagaaggaaagtgggtaatggagtcccagccactcaagagactggatatcccccgagaatggcttgggttaccagctatggacccttggaagatgaatctaatccttctcactggtttttctttgcaaattcatttgcttttatttttctaataacaataaactctattttccatgttctcagggcccctgggtagacagacacagcttgatttcagagcagacataggcgaagaaaacatggcattgagtgtgctgagtccagacaaatgttatttatatacacatccaaatttgaagagaaaatgtatttctttaggtttcaaacactgtaatagatataaagcaaaaataaaaacctgttgcaaagttcaaaaaaaaaaaaaaaaaaaaaaaaaaaaaaaaaaaaaaaaaaaagggcggcc

SEQ ID NO: 1180 - DNA, 697 bp, Homo sapiens
  misc_feature (97)..(97): n equals a,t,g, or c
  misc_feature (394)..(394): n equals a,t,g, or c
ggccgccctttttttttttttttgataaaagaaaagattggtcttgtctctgtaaaactgaggaacaattactttagataactggtgttagttttcnctttctttcttgacggaagcaaaacagatatgggttctaccctcaagaagctttagatgaatcagagatatagacataaaataaagaactataaaacaattcattacgcttatgatagctgtaataataaaaaagtacagggaacaataatatcatataacagagggataacatcacacagggaacaacagtatcacatagcagggatatatacaaggatcctaggtaacctggtctggatatatacaaggatcccgggtgacccggtctggctggtaagaggtttccctgagaaancgatcagtgagagctgagagagaagcaggcagagcaagktgatggggcaggggtggggagagagcagaagcgtgacccaagagggtcccaggccaaaacctttgcactcagtgactctgaaagaatgcagaggggctgtggctcaaagctgcagctggaaaggtaagaggggccaggcactgcagcaccatgtggatcacactataaactttgaatatcatcctaagagaaatgggaaaccaattatggatttttaaaaggaaatatttttatttccattttaaccggacgcgtgggtcgacc

SEQ ID NO: 1181 - DNA, 1536 bp, Homo sapiens
ccacgcgtccggggcagaaaggaaccgggttgtcttgggccgggcagggcgggtggtgactctcaaaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgtttggacttatatgaagagatcctgactgaagaaggaactgcaaaggaggcaacatataatgatttgcaagtagaatatggaaaatgtcaactacaaatgaaagagctgatgaaaaagtttaaagaaatacagacacagaatttcagcttaataaacgaaaaccagtctcttaagaagaatatttcagcacttatcaaaactgccagagtggaaataaaccgcaaggatgaagaaataagtaatcttcaccaaaagattgtcctgagtttccacattttcgaaataatcataaaactgcaaggacatttgatacagttaaaacaaaagatcttaaatctagatctccacatttggatgattgttcaaagactgatcaccagagctaaaagtgatgtttctaaagatgtacatcatagcacttcactgccaaatctggaaaaggaaggaaaaccacattctgataaaaggagtacttcacatttacctacatctgttgagaaacactgcactaatggtgtttggtcacgttctcattatcaggttggcgagggtagctcaaatgaggatagtagaagaggaagaaaagatattagacatagccagtttaacagaggaactgaaagagtacgaaaagacttaagtactggctgtggtgatggtgaaccaaggatattggaggctagtcaaaggctacaagggacatcctgagaaatatggtaaaggtgaaccaaagactgaaagcaaaagttcgaagtttaaaagtaactcagattctgactataaaggtgaacgcattaactcttcttgggagaaagagacccctggagaaaggtcacacagtcgagtagactctcaaagtgacaaaaaactagaaagacaaagtgaaagatcacaaaatataaataggaaagaagttaaatcacaagacaaagaagaaagaaaagttgatcaaaaacctaaatcagtagtaaaggaccaagatcactggagaagatctgaacgagcatcacttcctcattccaagaatgaaataacattttctcataattcaagtaaataccatctagaagagagaagaggatgggaagattgtaaaagagacaagagtgtaaacagtcatagttttcaagatggaagatgtccatcttctctttcaaacagtagaactcacaaaaacattgactctaaggaagttgatgccatgcatcagtgggaaaatacacctttaaaagcagaaagacatagaactgaagataagaggaaaagagaacaagaaagcaaaaaaaaaaaaaaa

SEQ ID NO: 1182 - DNA, 1590 bp, Homo sapiens
  misc_feature (1374)..(1374): n equals a,t,g, or c
  misc_feature (1397)..(1397): n equals a,t,g, or c
  misc_feature (1516)..(1516): n equals a,t,g, or c
gggtcgacccacgcgtccggagattctgggaggatcccgagtaccccccagttgcagtcatgtcaagactgatgctcaggaggatcccaactgtcatgagcaacacccatcgaacacagccatccacctgggaacagatcaagaagctgtcacagatggtgggagaaaacctgaggaaagcgggacaaccagtcacaatgagtaatttaatggtagctatgatagcagtgatcaccattgccgtgagtattccttcaacaagggctgacacagagatcagttatacttattgggcatatttgtcaattttggctggcaataatgcctggatataatcactttatgacacagttacacatgctttctggtctcaatatttaccataataagtctgctcctataattgaggcataccaccctcaaaaatctatttgtaaacaaaattgaacctggccagaaaaaatgaatgtacttttttaggaaggttgcattgcagaacaggcagaggtgctgcacaacgattcctatggaatcattattgattggtcccctaaggggatgtttagcttgaattgcacctcttagtctgcatgtcacagccacactgtgttcaactggtctgaacagaatggtcagatggtacaaatggtaagacgtatggcaagagttcctattatctggaaccatggcagtataggggcacctcaacctcaaatgatatggcccattgtaggagctaaacataaggatttgtggcaactgttaatagctcttaataagatcaaaatttgggaaagaataaaaaagcatctagaaggacactctgcaaacttgtctttggatattgcaaaatatatatatatatttaaagcatcccaggcacacctgaccttaatgccagaactggagtgctcgaaggagctgcagacagattagcagctagtaacccattaaaatggataaaaacacttagaagctctgtgatttcaatgatgattgtgcttttaatctgtgttgtttgtctttatatagtctgcagatgctgatcttgactcctgtgagaagtagctcaccgtgacaaagctgccttggctttttatcgctttgcaaaacaagagaatggggacaagttgggaacaggccccaaaatctggccataaactggcccctaaactggtcataaacaaaatctctgcagcactgtcacatgcttgtgatagcctgacgcccacgttggaaggctgtcggtttaccggaatgagggcaaggaacaactggcccactcagggcggataaccacttaaggcattcttaaaccacaaacaatagcatgagctatctgtgccttaaggacatgttcatgctgcagataantagccagagcccatccctttacntcggcccatccctttatttcccataaggaatacttatagttaatctatagaaacaatgcttatcactggcttgctgtcaataaatatgtgggtaaatctctgttcaaggctctcagctntgaaggctgtgagacccctgatttcccactccacaatctaaaaaaaaaataaaaacaaaaaaaaaaaaaaaaaa

SEQ ID NO: 1183 - DNA, 286 bp, Homo sapiens
  misc_feature (1)..(1): n equals a,t,g, or c
  misc_feature (3)..(3): n equals a,t,g, or c
ntnctagcactcaggagtccaaaccattgcttttgggttagaatgcatgaagaacatgcacgtctatctgaactacaataactttctgcttartctacttaggctaatgttgaacatttgttcattcacacaaccactggtggcagaagaagagagacctcttacaccactatagcataggagctgcaatgtcacatgagttttaaaagatgctytttaaagaaaaaaaaaaacamgragsargaaaaaaaaaaaaaaaaaaaaaaaaaaaaaaaaaaaaaaaggg

SEQ ID NO: 1184 - DNA, 858 bp, Homo sapiens
  misc_feature (843)..(843): n equals a,t,g, or c
  misc_feature (847)..(847): n equals a,t,g, or c
ggccgccctttttttttttttttgataaatacaaagatacatgtaaagttttacttacctgattttaaaaacaggctaccaaaatttatccaaatatattaaaaaatgagactgttttaaaaacctttcgtttccatattgtgactccactaagcgggtaaaaagttcaggacagagatggaaaggaaagaaggaaacaggaagaagtgaaactaggaaggtggtgccagtggcacatggatgaagaaagagagatcatcagccatggagaattttgtaatgtaagtagagagagagattgggtaggaagacaggcttcacagtttgtaaagtgtaagggaactacccatcgtaccctgtcattgactagggctgtgagttatgtagttctgtctcctcttgcaaaagacttaccacttctggcaagtgattaaccacttctggcaactcttcatttcttcttatccttgaatattcatctacatcactctaaacagcacagccccagaagcatggaaaggggagttattagtatggaaaggggagttactcttctggtgtagtggtccgattgagtccatggcttcccagccttaccagagctgataaaaatgtcaattcctttggggccaatcttgctcctccagtgtgttttagccctaatgaggtcatggttatttctagacttctgagacttactgtggctttgaattgacacaaacactaattttctgtcaaaggctagagtgatggatgttatatgcctgcggacgcgtgggtcgacccgggaattccggaccggtacctgcaggcgtaccagctttccactatccgtgcgtcagncgcnactgtaaccct

SEQ ID NO: 1185 - DNA, 361 bp, Homo sapiens
cccacgcgtgckggcgcctggcagccaccgcctgggaggttactgtaaggcccgcagctcccgccagctcccgcggactsctgccgcctccttaccatgaagccagtaagtcgtcgcacgctggactggatttattcagtgttgctgcttgccatcgttttaatctcctggggctgcatcatctatgcttcgatggtgtctgcaagacgacagctaaggaagaaatacccagacaaaatctttgggacgaatgaaaatttgtaactcttctggatttaattatctgaaaatacagttctttccctcatgcttatgtagatataaaaataaaattcataatgcaaaaaaaaaaaaaaaaaag

SEQ ID NO: 1186 - DNA, 1390 bp, Homo sapiens
  misc_feature (1267)..(1267): n equals a,t,g, or c
gccgttttggttcccggttggtgcttcctgttcgcagctgcggcacttcaaggttactgactttttatgatgtttggtggctatgagactatagawgcrtrsgrrgatgatytttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgrtgacaaatatgaaattcaggagagagaaaagagactaaaacaaaaaataaaagtantcaagaaaaatggggttatcccagagccatccaagctaccttatataaaagcagcaaatgagaacccccaccatgatataaggaagggccgtgcctcatggaaaagcaacaggtggcctcaag

SEQ ID NO: 1187 - DNA, 1100 bp, Homo sapiens
ggtgactgctccctagctggtcatgaaaattctcctcaagattattaaatcagggattatgtcttgtccaaatataagtgaaatattgtttgtaacaatgataagttacttggctttacattttagtaactaccctttcatgtttctttaactcttgaaatattttattaggggttgagcattcatgatggtacctggaagtcagcaatttatggttttggagatcagagtaatttgagaaaactaagaaatgtatcaaatctgaaacctgtcccgctcattggtccaaaattgaagagaaggtggccaatttcttattgtcgggaactcaaaggttattccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaaaaaaaaaaaaaaaaaaaaaaaagggcggccgc

SEQ ID NO: 1188 - DNA, 1431 bp, Homo sapiens
gcctgcagtcgacactagtggatccaaagaattcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcattcgatcaagagaaaaaagcagagatcgtgaaagggaacgagagcgggaaagagagagagagagagaacgagagcgagaacgagaacgggagcgagagagagaagc

SEQ ID NO: 1189 - DNA, 1307 bp, Homo sapiens
ggtcgacccacgcgtccggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagaaaataaagttatcagatgagcctgtagaagcaaaagaagattacactaagtttaatactaaagatttgaagactgaaaagaaaaatagcaaaatgactgcagctcagaaggctttggctaaagttgacaagagtggaatgaaaagtattgataccttttttggggtaaaaaataaaaaaaaaattggaaaggtttgaaactttgaaaataaaatctagcaaaaataaaaaaaaaaaaaaaaaaaaaaaaaaaaaaaaaaagggcggcc

SEQ ID NO: 1190 - DNA, 389 bp, Homo sapiens
ggtcgacccacgcgtccggtttgccatataatgagcattttgtatacataaatttatagtttaattaaattaggacatttgtaaaaaattggatacaattttattttcaaatacctttttttagctacactcaaacacttattgaattgaaattatgcacatgtttgatttagtgatatggtattacaaaacaccaataccctgttaattgtttctgcctttcttctttccatgctgtttttcaaattttctattgctatatttctagtcactaatctgtcttttgaaaggtctaatctgttgttagggccatccagtgatttgtttttaaattttaagtaatttatctctataagttctagatcgcgagcggccgctctagagggatc

SEQ ID NO: 1191 - DNA, 915 bp, Homo sapiens
acccacgcgtccgtgttcacagacagtagtttcaaagtgtgtaccacatgaagttgcagtcttccaaccttccagccagtgtgtatggaaataacctgaattgtattaatagcagttcttcaatgtgggcctgctgggggatgcttggttgtattccgttgtttgttccctgggtgcccgtcttgggcaagcatttctctggatgtcyctatttatgtggcaggtmaccctgctggattgccttcatctgtgtgcggactccctgtggaccaactacagcgcctacagctactttgaagtggtcaccattkgygacttgataatgawcctcgccttttacctggtccacctcttccgcttctaccgcgtgctcacctgtatcagctggcccctgtcggtaagagagtggtctggccctgtcctccgcatgcacaagtcaggatgttagctagagtactgagacctgacagagtttttcccgtctgcccatctcacctctttaaccattctttgctgcctctgccctgaatttcctattgtttggtggacatctctgcttgatgtcctgctggtttttaaaactcactttccagctacaagaaggctgtggctggccgggcgcggtggctcacgctggtaatcccagcactttgggaggctgaggcgggcggatcacgaggtcaggagttcgagaccacggtgaaaccccgtctctactaaaaaatacaaaaaatcagccgggcgtggtggcgggtgcctgtagtcccagctactcagagaggctgaggcaggagaatggcgtgaacccgggaggcggagcttgcagtgagccgagatcgagccactgcactccagcctgggtgacagagcgagactcctctcaaaaaaaaaaaaaaaaaaaaaaagggcggccgc

SEQ ID NO: 1192 - DNA, 1450 bp, Homo sapiens
  misc_feature (1)..(1): n equals a,t,g, or c
  misc_feature (692)..(692): n equals a,t,g, or c
  misc_feature (1410)..(1410): n equals a,t,g, or c
ncccgccggctccggagcggctctgccttcccgagcgcgggacgcggcgccctgggggaggagggcgaagcgacgcggcgatggctccgcgggcactcccggggtccgccgtcctagccgctgctgtcttcgtgggaggcgccgtgagttcgccgctggtggctccggacaatgggagcagccgcacattgcactccagaacagagacgaccccgtcgcccagcaacgatactgggaatggacacccagaatatattgcatacgcgcttgtccctgtgttctttatcatgggtctctttggcgtcctcatttgccacctgcttaagaagaaaggctatcgttgtacaacagaagcagagcaagatatcgaagaggaaaaggttgaaaagatagaattgaatgacagtgtgaatgaaaacagtgacactgttgggcaaatcgtccactacatcatgaaaaatgaagcgaatgctgatgtcttaaaggcgatggtagcagataacagcctgtatgatcctgaaagccccgtgacccccagcacaccagggagcccgccagtgagtcctgggcctttgtcaccaggggggacgccagggaagcacgtctgtggccatcatctggcatacggtgggcggtgttgtcgagagggatgtgtgtcatcggtgtaggcacaagcggtgggcacttttatnaaagcccacttaacaagtccagagagagcagaccacggcgccaaggtgaggtcacggtcctttctgttggcagatttagagttacaaaagtggagcacaagtcaaaccagaaggaacggagaagcctgatgtctgttagtggggctgaaaccgtcaatggggaggtgccggcaacacctgtgaagagagaacgcagtggcacagagtagcaggtgagccgtggttttggtgacattgggggcagagtggtgcagggtgaggagaaggtacttggagcctcccaggtgctgtggcagcataggaatggtatttgacagggaagtgggagagctttccttgacccaggaagactgagggggactgaacatgattacttgtctgcctagagcttcttgtaaagaagtcacaaacttagtgcctccaggggcttggcctgtgtgataatgaggatagaggattacttgtgaggcaatgtggcatggtggggattgtggcaaactagaattcacatcacccaccatatagggcttgcattaccacgaggcagaaagcacctagtgttgctgcatcttcttacgcaaaaaagacaaaatccagacttctaaaatgtaaaatcactgattttcgatattggcagcttactttttttttttaaacaaccatgcaggccaaatgacttgtaatcttgtcaccatttttagggtaaactgtggacttngaaaaagtctgggagcaaacaaaccatgctttttccttta

SEQ ID NO: 1193 - DNA, 1280 bp, Homo sapiens
ccacgcgtccgactacttttataatcagaaaataggatatatagaaatggtctggaaaaaatgaggagagaagttacaatagggaggtcatcttcaatctgtttggaccagcaagtaaaagcaggaaatgctgtccaccaccaatggcttaaatatgtgtgttggatggtggtggtggttggtggttctggggttggggatggggggaaccttgggatgtgatggttttcttagtcagagatggtgctttacagctgggaagtatcttgaacttggtggaggtctatccagacatcaggcagatttcatattttcacagacaaaggctacgtttacgtctaaggggaaaacacaaaatactaagatagaaacctccatgccccctcaccttttcagacaacaagaacccccagggcagagggtcttcctcactctcagagttactttgacttctcatctggtttcgtgtgggtaatgcattttcactcttgagtttcttttctttttaaggtattttcattatgacgtttgttcttttgcaaagagctaattctgcagaattctacccagggagggccgagggaagttagtgaaggtaacgataccagttagaaagttgagtttgggtcatctcaggggcctcctttggcctcctttggcttatgttctagagatggcccttacttcccaggaatagatagtgatgtcttactgagttgcaggtagagtctgtattgaagcgcaagattttcttccctgacttgtctgggaatccttacccaggactgtggctttcctcttccatatccctccaccaggaggcaggctctaagcctctgtgctgtcatccttttgccacttccatgaacatgccttcaaatacttgaaaaagtcactatagcgtaaagtatacttttctcttttggtgatgcttttctgcattttctctataaccagagagtaagaataaaactacagcttgggacctggcgcggtggctcacacctgtaatcccagcactttggaaggctgaggagggtggatcacctgaggtcgggagtttgagaccagcctgaccaacatggagaaaccccgtctctactaaaagtacaaaattagctggcatggtggcacatgcctgtagtctgagctactcgggaggctgaggcaggagaatcgcttgaaccttgggggtggaggttgcagtgagttgagatcttgtccattgcactccagcctgggcaacaagagtgaaacgccatctcaaaaaaaaaaaaaaa

SEQ ID NO: 1194 - DNA, 1004 bp, Homo sapiens
ccgggtcgacccacgcgtccggggcgcccatgcatcacagctgtgtccacaggatgcacgatggccattgagaaatggattttggagtcagaagacctgggtgctgcatgcttaactcatctgggtcctttggacaaatcacatcacctctcatggcctccatatgttccttctgtgcatgaaggatgatgttacttcttgcctctgccttcctcatagggacagtgttaggatcaaacagatcatgtatgagtcagtgctgtgggcaccataaatcacagaaagcccagaagacatcgtcatttattacagccccagtcaagtaaaagcccatttacccaggcacattggttccaacagtaagcctttttggctgatgaaagctgtgtaaagtttggtctctggagagaagctgttttatttttttaaaccaagtctgtaaaaccttggatgagaagctcttttagctcttttatgttttgatcaataatcaatgaaggcccaatataagatctcctcccccgaccgtgtatgcaacacatttccaaggcccatccacagcaactttgttacttctgcctgccgcatgcatggtttgaaatttggcagctcatattggtgtaaaaatcacatatcactgtaggctaaacttacctctgcacactcctccatgtccactgagcatctgctgaagtctgctttttcttcattttttatggaatgtaaagctcatccatgtgtacattattcatgcatttacttttctgccacctccaaagcattcaattaaagcaggaattaaggctcaactatcttactttagcacagttttggcagagatgttacagtgagatgatttttttctgtctgtcaaagttgtttcttcatgttttccaagatggtctagaacatcatttagagtaaattttcattttggaggaaatttttatgaaaagtctctgtaggtatctcctgtgaatagaggttttaaaaaaaaaaaaaaa

SEQ ID NO: 1195 - DNA, 1373 bp, Homo sapiens
tcgacccacgcgtccgttcagaaaaaggatttgacaaaattcagtgcccattcatggttaaaaaaaaaaaaaactttcagaaaaatgataatggaggagatctttctcaacttgataaagaacatctacaaaagcccctacagccaatgtaacacataatagtaaaagactaattgcttttctccaatatcagggatattagggacagagatgtctgtcctcaccactcttattcaacatattgctggaagttctgtctagtgcagtgaggaaagaaaaggaattaaaaagcatgcagacaaaaagaaggaaacaaaactgtctctatttgcaaatgacatgattctctaaataaaaaatcccaaggaatctacaaaaaaaactagagctaggtggggtgtggtggctcatgcctgtaatcccagcactttgggaggctgaattaagaggattacctaaaccaagaagttcaagaccagcctgcgcaacatagtaagacccccatctctacaaaaaattgaaaaattagctggatgtattagctactcagggagctgagctgggagggattgtttgagccagagaggtcagggctctggtgatccatgatcacatcaccatactccagcctgggcaaccgagtgagacctgtccttaaaaaacaaacaaaaacaaactagatctagtgagagttcagcaagccctcaagctacaagacctatataccaaaaatcaacttgcatttctatatactattaatgaacatatgggaaacctaaatttaaaagatagtaccacttaacaattgtttcacaaaaatgaattacctgggcataaattaaataaacatatacaggatctgtatgctaaaaattgcaaaatactgataaaagaaatcaaagcaaacccaaagaagtggagacacataccgtgttcatgtactggaaggctcagcagagacgtgggttccctccagactgatgtacaggtttgatgtacttgctagcaaaaatcccagcaaggtatttttttgtagatgcgcaagattattctaaaatttgtatggaagggcagtgaaactaaaagtcacgaaaataatcttgaaaaagaaaaagaaaatgggcagaatcactgtatttgataacataccttgttatataactgcagtaatcaagacagtatagtgttggtgaagggacagacacaaggtcaatgaaacagaatagagaacccagacatagacccacacaagtaccaccagtggatttggacaaggtgcaaaagcaactcattggaggaaggcagcctatttagccaatgtgactggagcactggatacccataagccaaaaaaagaaaaaaaaaaaaaaagg

SEQ ID NO: 1196 - DNA, 1637 bp, Homo sapiens
attttctagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcmaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactgaagataccatcccacggaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatccaaaaaaaaaaaaaaaaaaaaaaaaaaaaaaaaaaaaaaaaaaaaaaaaaaaaaaaaaaaaaaa

SEQ ID NO: 1197 - DNA, 4285 bp, Homo sapiens
ctgtgccgatcgaatctataaaacaaacacaggaagaaattaaaagaaatattatggctcttcgaaatcatttagtttcaagcacaccggccacgrattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagrcataattrattcaatacactactgttaaaatcatttgcaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgttttycttaagtcagctggttcataacataggccaaattctagagatgtttatagagcatttgaagtgctgataatttatgttttttcattatgaaaacttattttagctttagactccagtgtgttcagtgaataagtagaatataaaaaaatataaccagtattttacttcaaaagccaaaaagaggcaataagaaaagacactttgtggtggcctttatgtgtgcattaaaattggtttctgtaaaacgtgtaataagttgagtatctacgaagagtatcaagttctgaagtttaatttttttattatcctcctctcttcttagtaacttctttctgtggcaaaaccacaattctttaagattcctattgttcaggctaaggcaaatttttttgtttgtttcttcagtttaatattttgattttgtgtttttacgtaaatatttatattccttgaaagcaatttttgccaaggtagttcagtttaggaatatgttgttctaaaatatgtcttagaatcctgaaagcatagattttgaaatgtttttttaatgaaaatgaaggtcagagagaataattgccctgaccacatttgcctttcagtaggaggaggctgtgaaatagtaaaattataatcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggtccaaataatattttatttgtatgggtatcttctaagactaaataggtagttgtgttctttatttttaaaatttctttttagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggaccgtaaacggttcccagttgtctgagagcctcatgagggtttctaggatttatgaccttatgaccagtttttttcatttaccaagattttattttcctacatgaaaatttaattgagtaataattattcacatgtgcattttctttttagctgttaaatgtactatgccatcatccaccatttagtaaaatgtagctggcccaggacatgtaaaaaaaaaaaaaaaacaacaacaataaatagggcatgtgaaatgttaagttacagcaatagatattttatttgtatttcatgttagtacttttttgttttatatcacttataaaggtacagtgtactctttgtcacagctcagttggtaaccgcattccattgaaaagttggccttgtaaaatacaactctcatttaatattcatgcttttgtgcctttaagaaaatattttttgtcattttttgtgttacagaactataatgtgattcaaggtgtttataggcttgtcataaaagggtcatttctgtgtgttactttctttttatatagctatagtatatttaaacaataatactatcttttataggggtttgtctatttacctattctttactcagacattgatgtagacttgtcagattattctgagtattgttaacagtgccttttcgatggaatcacactttttggctgtcaccttgtgccatatacacacaaaattttgtggaaggcagttttaactttctgaagaatatctgtcaaaatttaagaaaacaaatgtataaaattccattttttccagtgtttagcatttctagtaagcagtgaggttgtttgacatacagtgatgatggcattattgataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatgaatgtgaatattctttctaaaaatttagaaaatgttatctttttgcatttattatgtaaaactgttttacagtatcaaaatttttcacttaaagaaaaaaaatgccatgaaacatttgaactgatgagccacagaacttcagttgaaatttttttcactttttagcatgctaaatatacatctgagtttaaatgttctgtttaatggccattcataaattcaagcactaccactggtcagttttgtgtgatagaataaaaatatgttacctgcagtgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataatctgtaaaattatgctaacttctacaagtaggcttctaaataaaatttttaaaaagagcaaaaaaaaaaaaaaaagg

SEQ ID NO: 1198 - DNA, 1597 bp, Homo sapiens
tacgccgtgcaggtaccggtccggaattcccgggtcgacccacgcgtccgcctgcctgcagtaaaccactgcctgaaccgtgttcctaggtggtgctgatgctgggctgtctcaaaagcccttagtctgtttcaaagcttcctgccaatggcaagaatgtggatgatgtgattagaaatcaaatgaatgtaactgttacattgccaaaataccatttagctctcatttggctgctttttcactttgggtgggcattattatcagtttgctcaaaaacagtgcttatgaatctatccaatgtccacaatgctgttataggataaaagsccatttcttattagtccaaataacagagtgggagacttttattcttttaattgattgtgaggttctaaaagagataattgtaaaagcaacaacaacagcaacagcaatcatggctgtatgcttatttgaacaagactagaaatgagagcagaaatttgaaaagttaaagtatttgaatgaccaccagatggcagtgtggggccacctggaagctgaagccaaagtcgtggttctgtctctctaggcagcctctgaaagtgtcagccccaaagaggcaattgctgtaaatgtataaggctaaagtatcttattaaatgattataaaatatatttaaatgcattttaaaaatgaagttcataagaattattttaggaaactgaaaggtttacatttactctaatacaaaattttagcccacaagtcttcaaaatataattaactcagagaagtctcataaatcaagacagagaattaatgaccacatagagaaaatttaagaaacaataattgatttttttaatagggaagagatcattaagcaaccacagccattacccaaataattatttttctcctaatggctacaaccattgtgcatgaaaatgatatgcataagtttcacttactctagaagaagtcaaactattttcacaaaatttctgcgtgttaaggtgaaaaatctgctgctgctttttaatacatcgtgacacaggtatggcaagcgaattcacaaggtaataccagagtattttggggtgtaaaaagagaaatccattttaaagtttgagaattcttagtttaaaatatactacaagaacgagcctctttatccctgctctgcccctgtcatagtgggagaatgtgccacaaaggccatattaatgagaggactggaaagaacacaaggagatacaaaacttcaagtcagtgaaaaagttacatgttacatgggattttggtaaattcaatgttctttccctttttccctctagaatcacaatttcaaagatgctttaatttcctccctccctccctgcctccctcccttccttccttcttccctcccttactttcttctgctctttcttgttttgatttacctccaagtggcagtaagtgctagctagcatttaaattctctacttgggtgttttatattaagttatttcatttaattatatctattcagtgaattagttatgattactggtaataataatgttaataaaatcaattttatgacaaaaaaaaaaaaaaaagggcggccgc

SEQ ID NO: 1199 - DNA, 606 bp, Homo sapiens
  misc_feature (606)..(606): n equals a,t,g, or c
aaaaattggagacactgtttaacttctgtgcatggactccatcagcakctacaaagccaytgggaggctgaggatcacttgagcccagaagtttgaggctgtagtaagcttcaaaggccactgcactctagcttgggtgaggcaagaccctttcaagcagtaagctgcatgcttgcttgttgtggtcattaaaaaccctagtttaggataacaggtctgcctgcatttcttcaatcatgaattctgagtcctttgcttctttaaaacttgctccacacagtgtagtcaagccgactctccatacctttaaaaggtatgacaggaactgtcttcatgtccttacccaagcaagtcatccatggataaaaacgttaccaggagcagaaccattaagctggtccaggcaagttggactccaccatttcaacttccagctttctgtctaatgcctgtgtgccaatggcttgagttaggcttgctctttaggacttcagtagctattctcatccttccttggggacacaactgtccataaggtgctatccagagccacactgcatctgcacccagcaccatacctcacaggagtcgactcctactcttagn

SEQ ID NO: 1200 - DNA, 2270 bp, Homo sapiens
cgctgcagccgctttccgcggcctgggcctctcgccgtcagcatgccacacgccttcaagcccggggacttggtgttcgctaagatgaagggctaccctcactggcctgccaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccgtcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccagcggagaagcctctcccgaagccgcgagggcggaaaccgaagcctgaacggcctccgtccagctccagcagtgacagtgacagcgacgaggtggaccgcatcagtgagtggaagcggcgggacgaggcgcggaggcgcgagctggaggcccggcggcggcgagagcaggaggaggagctgcggcgcctgcgggagcaggagaaggaggagaaggagcggaggcgcgagcgggccgaccgcggggaggctgagcggggcagcggcggcagcagcggggacgagctcagggaggacgatgagcccgtcaagaagcggggacgcaagggccggggccggggtcccccgtcctcctctgactccgagcccgaggccgagctggagagagaggccaagaaatcagcgaagaagccgcagtcctcaagcacagagcccgccaggaaacctggccagaaggagaagagagtgcggcccgaggagaagcaacaagccaagcccgtgaaggtggagcggacccggaagcggtccgagggcttctcgatggacaggaaggtagagaagaagaaagagccctccgtggaggagaagctgcagaagctgcacagtgagatcaagtttgccctaaaggtcgacagcccggacgtgaagaggtgcctgaatgccctagaggagctgggaaccctgcaggtgacctctcagatcctccagaagaacacagacgtggtggccaccttgaagaagattcgccgttacaaagcgaacaaggacgtaatggagaaggcagcagaagtctatacccggctcaagtcgcgggtcctcggcccaaagatcgaggcggtgcagaaagtgaacaaggctgggatggagaaggagaaggccgaggagaagctggccggggaggagctggccggggaggaggccccccaggagaaggcggaggacaagcccagcaccgatctctcagccccagtgaatggcgaggccacatcacagaagggggagagcgcagaggacaaggagcacgaggagggtcgggactcggaggaggggccaaggtgtggctcctctgaagacctgcacgacagcgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttttgtgatttccaaggcaacatgaaatgactataacatggttatgataatgaagcaacgacaacacaaa

SEQ ID NO: 1201 - DNA, 1480 bp, Homo sapiens
  misc_feature (1478)..(1478): n equals a,t,g, or c
cgcgtccgacttttccatgggtcaaattttttgtgtgagagatagaggtacatgtcttctgatgatgtgctgtggaatgcaatgtgggaaacctacatctggctagtgcttacatttgctcaaaaagcatgttgtatgaagctgactgccaccatgctaaagcagattcatattaagaagtgtcggtcgatccagtggctcttaagagtgaatagctttatggaatcaagtatgtccctgagtagcaagattaggcctcaccaaagaagaaattaacctgcactttcaaaaagtaccatgtataggaatgaaacattgaggtcccactttattctgtctttagtacatggttttacttattttggggatggatagaaatatatttttgctagttctaggcttgaatcatgggctccttggctttcctagcatcccaaagcagtcaacagtgatttcttaagcaatttgatctgtacctttacttgtgaaaggtatgctatataattcagcaagtaccaacttgtgtagctgcagaataaccaagtggctatccagtcaagtaaatacagtttgcttacatacttcaacagtttcataaaacgattcccctgagtgacacaagaacataaaatgttaatatcactaatatagcctgttaaatcttttgtggagacaggtgcaaatcagaagattgacaaggaagaacttgagcttgctaaataagacttcctaaatttaaaagctctagttttgcttagtgtgaattctggcactttaaaaagattaagcaagtgaaattctgctgccctccaccatttatttttacagtgctttgtaatttttttcatcagttccttaaatgttatttggaggaaactaagttcttgacctcagtaattttatttttgtttttccctaaatgtttccctactagtctttttggaaaacatgtttgttttaatttcatcttccctcactttatttaggtagaatttttcccccttcatttctgaaattttttgctcaccgccatgtttaaatggggttgaatcatagcgagccatttgctcttgccaaagtgagatagatgtactgaggagataattgaaaagtcagactctgtactgtggggctttaatcggagcactgctggaaatgattgcagagaatgtagtgcttcatatatccatgaccaagattgacatgttgctcacaacatgtcacaatttagtgaggagctacatgtatttccaagaattccagcatagattataatttaaataatcgaatttggtatttaggtacattgtttatatagccaagtcgtgttctaagtatttatttaaaacaaaagaatcacgttttcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaa

SEQ ID NO: 1202 - DNA, 3226 bp, Homo sapiens
ccacgcgtccgcgctgagtctgaagggacctatgacacctatcagcatgttccagtggaaagctttgcagaagtattgctgagaactggaaaattggcagaggctaaaaataaaggagaagtatttccaacaactgaagttctcttgcaactagcaagtgaagccttgccaaatgacatgaccttggctcttgcttaccttcttgccttaccacaagtgttagatgctaaccggtgctttgaaaagcagtccccctctgcattatctctccagctggcagcgtattactatagcctccagatctatgcccgattggccccatgtttcagggacaagtgccatcctctttacagggaactgattacatatgtatccagaatgtattccaagtggcaggcagctcttggctttcctgtattcgacaaagttgcttctccaggtatcagctggagaacagtggtgtgatcatagctcactgcagcttgaactcctgagctcaagtgatccttgtgcttcagcctccctagtaggatttcagtcttagaaaggtgatcacctggtgatgctcctttgctttatatctgaagaaactgagacccagtggaatcaagaaagggaatcaactgctccttccatggagttcccaaaactcttggcttatgattgtgctgatcccaaagaactaatcaagatggtcaccaggcatgtgactcgacatgagcacgaagcctggcctgaagaccttatttcactgaccaagcagttacactgctacaatgaacgtctcctggatttcactcaggcgcagatccttcagggccttcggaagggtgtggacgtgcagcggtttactgcagatgaccagtataaaagggaaactatccttggtctggcagaggcttgatggacatttctgcagaactctagaggaaagcgtctacagcattgctatttctctggcacaacgttacagtgtctcccgctgggaagtttttatgacccatttggagttcctcttcacggacagtggtttgtccacactagaaattgaaaatagagcccaagaccttcatctctttgagactttgaagactgatccagaagcctttcaccagcacatggtcaagtatatttaccctactattggtggctttgatcacgaaaggctgcagtattatttcactcttctggaaaactgtggctgtgcagatttggggaactgtgccattaaaccagaaacccacattcgactgctgaagaagtttaaggttgttgcatcaggtcttaattacaaaaagctgacagatgaaaacatgagtcctcttgaagcattggagccagttctttcaagtcaaaatatcttgtctatttccaaacttgttcccaaaatccctgaaaaggatggacagatgctttccccaagctctctgtacaccatctggttacagaagttgttctggactggagaccctcatctcattaaacaagtcccaggctcttcaccggagtggcttcatgcctatgatgtctgcatgaagtactttgatcgtctccacccaggtgacctcatcactgtggtagatgcagttacattttctccaaaagctgtgaccaagctgtctgtggaagcccgtaaagagatgactagaaaggctattaagacagtcaaacattttattgagaagccaaggaaaagaaactcagaagacgaagctcaagaagctaaggattctaaagttacctatgcagatactttgaatcatctggagaaatcacttgcccacctggaaaccctgagccacagcttcatcctttctctgaagaatagtgagcaggaaacactgcaaaaatacagtcacctctatgatctgtcccgatcagaaaaagagaaacttcatgatgaagctgtggctatttgtttagatggtcagcctctagcaatgattcagcagctgctagaggtggcagttggccctcttgacatctcacccaaggatatagtgcagagtgcaatcatgaaaataatttctgcattgagtggtggcagtgctgaccttggtgggccaagggacccactgaaggtcctggaaggtgttgttgcagcagtccacgccagtgtggacaagggtgaggagctggtttcacctgaggacctgctggagtggctgcggcctttctgtgctgatgacgcctggccggtgcggccccgcattcacgtgctgcagattttggggcaatcatttcacctgactgaggaggacagcaagctcctcgtgttctttagaactgaagccattctcaaagcctcctggccccagagacaggtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatggttccaacaaattgcaaataaaactgtatggaaacgaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1203 - DNA, 1142 bp, Homo sapiens
  misc_feature (341)..(341): n equals a,t,g, or c
  misc_feature (369)..(369): n equals a,t,g, or c
  misc_feature (386)..(386): n equals a,t,g, or c
  misc_feature (408)..(408): n equals a,t,g, or c
  misc_feature (412)..(412): n equals a,t,g, or c
  misc_feature (526)..(526): n equals a,t,g, or c
  misc_feature (598)..(598): n equals a,t,g, or c
  misc_feature (676)..(676): n equals a,t,g, or c
  misc_feature (739)..(739): n equals a,t,g, or c
tcgacccacgcgtccgtcttcctcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggaatgttgccgcctgtcccgggagcctggactgtgccctgaagaagcgggcaagtgtcctcctggtgcacatgcctgtgggcctgccttcagcccttccanaaggaacagcaaaggcttgttttgccangatgcgccgggcttcangcgggggccgggcccaacccanactngaaatgagattgattcctggcccaagggagcttgcccggaaaggaatttggacatcaattccgccctaacccaaggacggacagcggttcccggagcttgccaccttgggattntcggcacgggggcaggggctggagctgggcttcccttccactccaggaacccccacgcccacgccccacacntaccatgggttacccctgtgtcatccgacccggtgcacatgtcgcccctggagccccggggagggcaaggcgacggcntcgcccttgtgctgatcctggcgttctgtgtggccggtgcagccgccctctccgtagcctccntctgctggtgcaggctgcagcgtgagatccgcctgactcagaaggccgagtacgccactgcgaaggccctggctacacctgcagctaccccggatctcgcttggggaccagcgcctggcacagagcgcggagatgtaccactaccagcaccaacggcaacagatgttgtccctggagcggcataaagagccacccaaggagctggacacggctcttcggatgaggagaatgaggacggagacttcacggtgtacgagtgcccgggcatggccccgaccggggaaatggaggtgcgcaaccatctgttcgaccacgccgcactgtccgcgcccctgccggcccccagctcaccgcttgcactgccatgacctggaggcagacagacgcccacttgctccccgac

SEQ ID NO: 1204 - DNA, 1464 bp, Homo sapiens
  misc_feature (15)..(15): n equals a,t,g, or c
  misc_feature (63)..(63): n equals a,t,g, or c
  misc_feature (132)..(132): n equals a,t,g, or c
  misc_feature (887)..(887): n equals a,t,g, or c
  misc_feature (889)..(889): n equals a,t,g, or c
gactgtgcttgcagnaagagtaaacactctcggatgccgctgtcctgggggagcccgcgggangctgtgaatgttgatacgagctggccagtcctgggcccagctcacttgtccagctacctgccaggtggntttcactgtgtttaaaatacattgcattccaagctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcacatttgcagtctgcaacagtgacgcgcacccggtccagagcgtggtgagctttgtttgccttctgggtcggctttcgctgtgtctcctgtgtgtgttagaatccagagcccagaggaagtgcaagcgggtcctccgccaacggggagagcctcttcgcggcgctgttggcgacamagcgctgtgaattcgcgtananggggagttgtttgaaacaccttcctgagtagtccggccttgtcaatgagtgcttgttttcctttaaacagtctgacatatttactcgtcactttcaaaccagaagcatgaaaggaaggagatattgtggggtccgtttaactcgatagaaagcgcagggggatggcccccggcgcaggctcttgacccgctcagcgctgaccccaccgccctggccgaggcacttggccttgctgagctggacttcctcctcctcctcctcatgaccggggtgaattagaacgtttttaaagacacccccttccaaattctgtaacacattgtaattggagaagaaggaaactctgcaaggctaaactgtcattcacaacttggctacacatagactctagtcagttttgtctccagaaccttaggcttttgtattttttaattttaatttcactgttaatccttattgtcttttttattaagatgttggaaaagcaggaggtagttgtgcctcaattattgcaaaaatgtaacaataaagttcctcaaaataaaaaaaaaaaaaaaaaaaaaaaaaaaaaaaat

SEQ ID NO: 1205 - DNA, 4361 bp, Homo sapiens
ccacgcgtccgcgtccagcagctggtcaacgtgagccgcgggaacacgtccggcgtgctggtggtgctcaccaagttcctccggaggagcgagagcatgaagctgtatgcactgtgcacccgggcccagcccgacgggccctggctgaagtggacggacaaggactcactgctcttcatggtggaggagcctgggaggttcctgcctctctggctgcacattctcctaattacggtgctgctggtgctgtcgggcatattttctggcctcaacctcgggcttatggccctggaccccatggagctgcgcatcgtgcagaactgtggcaccgagaaggagaggcgctatgcccgcaagattgagcccatccggcgcaagggcaactaccttctctgctcgttgctcctagggaacgtgctggtcaacacctccctcacaatccttctagacaacctcatcgggtccggcctcatggcggtggcctcctccaccattggcattgtcatctttggggagatcctacctcaggccctgtgctcccgacatgggctggctgtgggtgccaacaccatccttctcaccaaattctttatgctactcaccttccccctcagttttcccattagcaagctcctggacttttttctgggccaggagattcgcactgtttacaaccgggagaagctgatggagatgttgaaggtgacggagccctataatgacctcgtgaaagaggagctcaatatgatccagggtgccctggaactacggaccaaaactgtagaggatatcatgacccagctccaggactgcttcatgatccgcagcgatgccatcctggacttcaacaccatgtcggagataatggaaagcggctatactcgcatcccggtgttcgaagacgagcagtccaatattgtagatattctctacgtcaaagacttggcctttgtggaccccgatgactgcacccccctcaagactatcactcgcttctataaccacccggtgcactttgtcttccatgacaccaagttggatgccatgctggaggagttcaagaaggggaagtcccacctggccatcgtgcagaaggtaaacaacgagggtgagggtgaccccttctacgaggtcctgggcctggtcaccctggaggacgtgatcgaggagatcatcaagtcggagatcctggacgagtccgacatgtacactgacaaccgaagccggaagcgggtgtctgagaagaacaagcgtgacttctctgccttcaaggatgcggacaatgagctcaaagtgaaaatctccccgcagctcctcctggccgctcatcgcttcctagccacagaggtctctcagtttagcccctccctgatatcagagaagatcctgctgcggctactcaagtacccagatgtcattcaggaactcaagtttgacgagcacaataagtactacgcccgccattacctgtacacccgaaataagccggccgactacttcatcctcatcctgcaggggaaggtggaggtggaggcagggaaggagaacatgaagtttgagacgggcgccttctcctactatgggactatggccctgacctcggtcccctccgaccgttccccagcacaccccaccccactcagccgctcagcctccctcagttacccagaccgcacagacgtctcaactgcagcaaccttggcaggcagcagcaaccagtttggcagctctgtcctgggccagtacatctctgacttcagcgtccgggcactcgtggacttgcagtacatcaagatcactcggcagcagtaccagaacgggctgctggcttctcgcatggagaacagccctcagtttcccatagacgggtgcaccacccacatggagaacttggccgagaagtctgagctgcctgtggtggacgagaccacaactcttctcaacgagcgtaactccttgctgcacaaagcctcccacgagaatgccatctgacaggagggcccggggccccctgcccaccctgcgggggcctccccagtgggcccacatgaagagagggaacctgttagtccagaaaggatacggatagatagcctgtctgactgaacagccagatggcccccagcctatgggggatctggcctctgccagggacctctgagtagctctgaggtggcactgtccagccctggatagggggggcagtgggccagctaccgtaagcaaaggctgttttttactgagagaatttctaaagtaggctcatcacttttttttaaatatcattttgggaagggaagacagggttaaggaactttatttaaaaaaaaaatatttttttcctaaaaactataaaagaggaagggtttcttgtcccgggaagcaacggacataatctgttcccagccatggccttccagcttgtgtccctgattcagggagctctcccttcctcctcctcctcctcctccggaggtgggatcccagagcctgccagtggaggcttatctgttgggaggaagacagctcttcacagaagcaaagaacaaaatggcatggagatcagctgcctgagcacctgcgctgtagcttatctgacaacgctgaggccacgagctcctgggtagctgtgatcagggacatgataatctgagctatgcagaggagcacatctgttgtcaactgctgtacccagaaatctagaactctgccgacagcctctcctggtgagtcgggactcagctgaggacacatccccaccctgcctcccatctggccctttggacaactggccctttgtgacagggctgactcaagtgttaggcagggtctcaggcctttgattgctcacccctgctccccaggccctgccctcacttttaccaaaggttctccctcggcgggagggcatctgtgttggaggtgatttgtctgggttcttccttttggttccagaaggaactgtcagtcatcagcatctgcgttgttagcagtcagtaccacccccgccccacaatgacagtcaaggctgacttgttgactgaagcctttttcccagaccccttatttcgaatccccaagcttcagtccctcttgggggtggagacaagaggacatgtgggaagccacggaagcaggttctttatgtcctctcctctgtggctggcaaggctcacctggccttatccacccacttatggaacctcaggagaggagggctcctcctaaaggcatgcagcttgcagcccctctttctcacacgtgtgatcctagcgtgagaggtcatcctgcccttgctgaagttagtagtactgtactaagagctctgccctcatgtgaattcctgccctggcgcctcttccctggggctgaatcaggccctgctgcaaaactccaggcttcccagggttggggaggctgtgggaccaaggtccatgttggtccttccactgggtgcagcaggagctgggtcccgagagcctggcaggtgaaactctgcaggccttccgcctgattattatttattcactcctttcctcaccccaagtgccctgctctccaggtgcctagagtatcctaactcttaggaccagggattgtcttgcaccaagtatgcctacccctggccagtctgaggtctcctagccatagaactgactcctggaagcctggagagaaggtggtgacacccatgggttctcaactgtaaggaaaaaagacaccagacttttgttccctagtgggggaaagcccttagtcttgtacaggagcagcttgctcccaagtccttttggaagctggcagagctatattcctgacagccctgactgccaggtagagcaaaagacattggtgggggtatgtgaagcaaaaggggcaggtgcacacacctccacagtgacctctgtgcacacggttaccaccaactggctggccctcctcctcttccctggcccattgatcatcccttctcacagagggtcatcattatttccaaatattgtttgtctgatgacttcctcttcccagtgcaatttttcccttcctatttcaacctctggttcctgggatgagccataccctggaactggcccacccactgtgtcttccacgtaagggagacctttgcaaagggcatccaaatgggtaggcaggtgacagccgccgtatttattttgcataatattttaatttgtatatttttgtgatttattttggcgttatgagtttgactctcggggagttttgttgttatgactcttgtgtcttttgtcacaaaacaatgatatttgctaaacgatatatggaatttatttttgattggtaataaaaaatcaaatatgtataaaaaaaaaaaaaaa

SEQ ID NO: 1206 - DNA, 1895 bp, Homo sapiens
  misc_feature (34)..(34): n equals a,t,g, or c
  misc_feature (43)..(43): n equals a,t,g, or c
gcctccgcaagtgccacccggcccacccgggccnctcccttcngcctgggacgtcagcggaccgggcgctcgcgggccggggctgtatggggctcccgcgcgggtcgttcttctggctgctgctcctgctcacggctgcctgctcggggctcctctttgccctgtacttctcggcggtgcagcggtacccggggccagcggccggagccagggacaccacatcatttgaagcattctttcaatccaaggcatcgaattcttggacaggaaagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgccttccaacctgagccttctgaacggttcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacaggccgcacgcctattttggaccagaagcctctgccagtaaattcaagctgctacatccggacttcatcagctacctgacagaaaggttcttgaaatcaaagttgattaacacacattttggagacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgctgaccccaatgcactgagccctttgcttcttcaagagttgcggccctgatcctctcaagtggccaaaagcttttttaacttttcaatcttcaccttcccttgccaacagagggcactggggtgaattcaagattttcatcgaggtctgttcaatataggacaccccagcttgtccttggctcatccaagaactcttctgtatctaaaacaatacatctcaatcttggccaagggaaaatggactgctttgctggattggcactgagcaactttaggaaatgtcggtggagtgttcagcaagatcagacagcagtccaggtcaaaggcaaacacacacgctccagcccaaatcctcctggtggcacatcctaccccagatgctaaagtgattcaaggactccaggacacctcttaagagcctttctaagaacatgataggcttacttctgctccataataaagtgggagaaaaaagccagaatataacttaagactagataactgcgtacatgatggaccattttttttttttggctgggtagagaaatcatataaaacgcaggctgtttagcatggagatgactctcagaacactgggagggtctggcacttgatgggggttagttgcttggcagcctgcctgccactgagggaagtcccattagagatgtatcaccaccttgtca

SEQ ID NO: 1207 - DNA, 1116 bp, Homo sapiens
tcgacccacgcgtccggccgcaggaacgggctccgcggacgacgggctccagggacgcacaggcagcgggcctcccaccgcgggtgccgggggcgggggggctgcccccatgcggggcccttcctggtcgcggcctcggccgctgctgctgctgttgctgctgctgtcgccttggcctgtctgggcccaggtgtcggccacggcctcgccctcggggtccctgggcgccccggactgccccgaggtgtgcacgtgcgtgccgggaggcctggccagctgctcggcactctcgctgcccgccgtgcccccgggcctgagcctgcgcctgcgcgcgctgctgctggaccacaaccgcgtccgtgcgctgccgccaggtgccttcgcgggagcgggcgcgctacagcgcctggacctgcgcgagaacgggctgcactcggtgcatgtgcgagccttctggggcctgggcgcgctgcagctgctggacctgagcgccaaccagctggaagcactggcaccagggactttcgcgccgctgcgcgcgctgcgcaacctctcattggccggcaaccggctggcgcgcctggagcccgcggcgctaggcgcgctcccgctgctgcgctcactcagcctgcaggacaacgagctggcggcactcgcgccggggctgctgggccgcctgcccgctctagacgcgctgcacctgcgcggcaacccttggggctgcgggtgcgcgctgcgcccgctctgcgcctggctgcgccggcacccgctgcccgcgtcagaggccgagacggtgctctgcgtgtggccgggacgcctgacgctcagccccctgactgccttttccgacgccgcctttagccattgcgcgcagccgctcgccctgcgggacctggccgtggtttacacgctcgggccggcctccttcctcgtcagcctggcttcctgcctggcgctgggctctgggctcaccgcctgccgtgcgcgccgccgccgcctccgcaccgccgccctccgcccgccgagaccgccagacccgaaccccgatcccgacccccacggctgtgcctcgcccgcggacccggggagccccgccgctgccgcccaagcctgagc

SEQ ID NO: 1208 - DNA, 1984 bp, Homo sapiens
  misc_feature (106)..(106): n equals a,t,g, or c
agttgttgctatgaatgattttaagcctttttttttaagcttggcaaacatcccagctaatcaaaatagtcatattcctgagaagtaggaaactaaaacttctttncatataattgttagaaggtttgtttcccaaactaccatagttacaaaggtgaatagccaaattttaggaacagaatcaaaagaataaaaatctgtgaagagatcctactactcttccttctatgttttggttttggtttctattgtccctatcatttcagcaagtggaacagcagcaagtttttcagtgcatatgctgcacaagaacaaaatataaatctgtatggcaccaaaaatcaaagtgaaaaccaaaccaaaaacccaaacaccctatgtaactatcggaggcatatacgtggtataaatgactgtagctgtgatacacacatggctacttgtcacatcactttccataattatttactgcaaaatgattgagaggcttttggtgcaggcagccgttaacctcctgcttcctttgttacctctggattactttgcagtaaattgcaggtcttttaagagatttaagcttcagttttctcaaaccaaaccaattatcctgtcttatctgaagatgcagggttgtgggcaaaagaggctggttataataatgccctcatattgagtggtctgtaaacggctgcacacttcaggcactgtagttgctgaagatgctttgttaaatgtgaccttgactggctttacaggggtgtagaatgtaatctacacaaggtgactttgcatctatcttgctcttgaggtggatgaaattgagaagctggagtgtgtaagccatgcacataagtattcttcactgtaaattttgttttcatttttaacccaattatggtactttatccaatgcacaactgatctctcagtagatattcatttgaaaatagtgtggccttgatcagtgagaaagggaaggagaaaagtgacttttttgcttatgtagaaatgactcatttgctgagagtttgtctttctgcagcactcttggtataatgttagtgatcggtctcctttttgattggggaaagttaatgtttttgaccctggagttaattcagttgagttatcttatatttttaggaagtatcagaattgctctgatgaataacaaagttgactgttttgatgtccaatctcaggttttagaatatagtggtgtaaagtcccactatttttaattcttaaaacaactttaatttcgtacaccctaaaagtcacatgcataaggcctgttcagagagcagagcctccatctttttgctccttttctactttgtacttcacttgraaaaatatcaagtgactttacatkgtatatttccattgtaaccctgacatttctcaaagataaagcactttttgatcatgaaatacatgaaatctttgtgtgatgtggatcatagtttctcaggctcccttagataattgcttatgaatattgttctaactctgtgtaagaagagtagaaatctttgctaatgttagaaggtttgtattattgatccagaatgcattttgctagtttccaatggatgggagagtaaataatgctgcattcacaatttaataagttactttcccttgagccttaaggtaactttttcttttctgtcaactacagcactgaagttatagtaagtgaatgagattatcagttttcagggttggttttagagtactgtaaatcaattagctgtcttcctaaagagttacaactcccattcagtatactggataatgggtgtgtgggtggggctggggagggcgggagatagtttgtagaaaagaaaaaagaaaaaaaaaaaaaacacatttaccttaagaaaatacagacaaaaaaaaaaaaaaagggcggccgctctagaggatccaagcttacgtacgcgtgcatgcgacgtcatagctcttctatagggtcacc

SEQ ID NO: 1209 - DNA, 548 bp, Homo sapiens
ccacgcgtccggcaggcagcagggaaggaagcagaggcttcctaaggctgttttcttagccgtggagaagcccgcgctttctacatgctcccaagtgctgtcatgagcacgttcctgacaagtcaggtgttcagattgcagtccctggccaacgtcaggattcttacaggttgaatgttaagctcaccgatcttggcctcaggtcctgcctggcttgcctgctcattttcacacgtgcagtggtgggtctgtctcatagcacaggtgcagtttagtgcagccacagtgtccccaggcagggcggggactggagcagcccccagtgtgccagcagtgtgggcagcggaggctaggggcccatctgtccctagcaccctccagggcagtcccgttttgcagcgggatttggcaaacccccctccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1210 - DNA, 2512 bp, Homo sapiens
ccacgcgtccgtctgagatcatgctggcaaaagtgagtcaggagaggagggcttaaaaaggagccaggggctgagcacagtggcttacggcctgtaatcccagcactttaggaggccaaggtaggcggatcacttgagcctaggagttcaagaccagcctggccaacgtagcaagaccccatctccaaaaagaaaaaaaaaatgtggggggagccaggaggtagagtctctgccctggcccaggtatctgcagggtatgcaccatctgggagtcagaagtgctttctacaaggcctgagggtcttgttattggtggtacagctctctgccccccacctctgccccaaccccaactcatgccaagttctggcctcctacttctcatgtctgtattcctactgggatacaatagaatcccccagggctgtgggttcacacctcaggggcagatatattggttctagctaagccagaacttaggaggagaaagtatctggagaagatttctagaactcagaactgtgcttagaggctggccagcgaccccttggtcagtgcctatcatgtgggccttccagtccgggcagcccgtgagggcatctgaccgctccctgacatctgcctccacccccaatgcccccccagggaatggtgtaagtccctgatgctgtctcgaacccacatctccccgaccctgttctccctgataaataaataaaactgtaaataataaaactgcaggctgggcacagtggcttacacttgtaatcctagcacttggaaaggctgagacaggaggatcacttgaggccaggagtttgagaccaacctgggcaatatagtgagaccctatttctacaaaaaataaaataaatagccaggcctggtggtatgcacctgtagtcctagctactgaggaggctgacggaggaggatcacttgagcccaggaattggaggctgcagtgagctatgatcacgccactgcactccagcctgggcgacagagccagaccctatctctgaaaacaataataaaacgacaaccaatgctgactgtgtctccatcactgggtggggctgaggaagcaggcctcagaaaggaagccagttttcccccaaaattattccctgaggctgcctctgggcctgtggatccagatgtgtgggggccttcaggagtggcaggggggtggggcctccagcgtgaaaacagaagtcaccgtcagccttgcacccccggctctgcctcccaggactggtgtttttgcctctgttttaatttcctgctgggtcctcccttggacattgtcaggtatgcaggctgggacatcccttctttcctcctacattccccctagagcccaaggctctgtccgtggtccagccactccatggcagggaagctgtacctccataatcagctgcctgagggcccctgacccaccaccaggcaccaccctggtggggctgaggttagaagggaaagaatgccagaactccagtcctggaggcaggagagtgtgtgagcccagccccgccctctcagactctcagacctttatttcatcctcattttcctggctagaggttccatgcatcatttttttttttttttttttcagatggagtctcgctctgttgcccaggctggagtgcagtggtgctatgtcggctcactgaaacctccgcctctcaggttcaggcgattctcctgcctccgcctcccgagtggctgggattacaggcatgcaccaccacacctggctagtttttgtatttttggtggagacggggtttcaccatgttggccaggctggtctcaaactcctgacctcaggtgatccacctgcctgggcttcccaaagtactgggattataggcttgagccaccacgcccggctggttccatgcatcttacctggatgacttgggtccctaaatgggcccctgggtgcccagcctcccctcctccaatacattctctgataatctgaccttgtcatgaccattggggcacctgttgcccacagggtagaggccaggtgcctgaggacagcactgaaggccgtgcacctccacctccagcctccagtcacctcacctagctcactgctctctctcctgcaaagtctctcctgcttccctccctaagggaagggctggccgctcactgcttgggcccccttgatttctaagacacctgtgaagggtcccacaaggccaggcacagtggctcttgtctgtaatcccagcgctctgggaggctgaggcaggaggatcacttgaggtcaggagttcaatgtggacaacacagtaagaccctgtctctacaaaaaaatttaaaacttagctggcattggtggcgcatggctgtagtcccagctacttgggaggttgaggtaggaggatcgcttgaacccaggagttcaagtctgcagtgagctatgattgcaccactgcactccagcctgggtgatggagcgaggccccaactcaaaaaaaaaaaaaaa

SEQ ID NO: 1211 - DNA, 780 bp, Homo sapiens
ggcacgagcaagaatgggatgaattttatcttactcatttcctggaggaattttgacaaagcagagacgaagcgctcattctctcacctgccgccgccctgtgaagaggtgccttctgccatggttgcaaatttcccgagacctccccagctacgcagaactccaatgttggtgtcaaatttaaaaaattgatttggcaagaacacataatggattgtgctgtgtgctctgtactgtctcatgcctggaggcacaccatgtttggctgtcccttctgctaacactgagattaaactgtggatttggtaccaggaatggtggctcatgcctgtaataccagcactttgggaggctgagaacagctgatggcaaccagtttgaagaccccaacagaggcactgagtcggcagtactatgagaacacagtttcttcctcttcctgtcccatgacttcacgctgcactcttcaaccaatcaacgatctccacactttggcccactcccaaacccttaaaaaccctagcccccaactcttcagggaggcagatttgaggtttcctcctatctctgcatttggcagccctacaatgaaacctctttgtctgctgcaacctggtgtctcagcctattgacttgctgtgtgcattgggcaagaaacctattacggttacaaaatgatgatgtttctaatttgtcatcttttaaacatttattaaatggaattcttccgtaaaaaaaataataaaatttcctcgtcagttaaaaaaaaaaaaaaaaaaa

SEQ ID NO: 1212 - DNA, 1744 bp, Homo sapiens
tacgccaagctcgaaattaaccctcactaaagggaacaaaagctggagctccaccgcggtggcggccgctctagaactagtggatcccccgggctgcaggaattcggcacgagcaataattggaatttttaaaatcaagatgatctgcttatccagtgattgccattagcaatgaagaaagaaatggttttgttgacaactacttatttctctctccatgtgaaagtgtttttttgtttgtttgtttgtttttcaattctgtcatcatcgagacgtggatcccttgctaacaacagttcctggtgactatagaaattaagactccttagaagaaaaatgttattattacaattcaaaaaagaaacaaatgtgctcacctgttggtgggaggacaactgaaatttgcatgtcaactgtaaacatctgaaagataaataagagaggaaagaaagtttatgatacagataacagattgctagtacagagctgctttttcagaacctctcctttattaccagtatttttcccccctttttaaaaaaaaatctaaacaattagatgtcaagcattgggtgaaaaacacataacaaaagattctggcttttgctcatcattctgatctccctgctctgcatactgaagccccacttccttttgttgkcctcccagtggaatttcagccactcagaccagtcaggggtgtgttggcagctatcctctttgaatggtagagagtacatttattctttgcacagaaggaacatgaaaatttggtttgaaacctagtaactctcaggctgcatggtctggagacaatagaagtatttcatcccttgaaaccagacgaatcttgagtaatcaggtgaacctgccttgctggctggtggtgcttcactgaagggttggaccagggtgtagaaaggactttggtggttcagatttccactggaaaactgtgacatcctgccatctcagagaagaaagttgcaggagatagccacacgtataggtgattcctgcttatctggctaataatattcttgctaatatttttgaaaagaaattagttttgggccttcacggaagctaacatttaatctcatagggcataaacacgagcgtagggtggaataacagcctaatgttttgaaccccatgaatttgctaatccataggaagttccattaagaaactccctagttcatcattcatagtatttcacctgtagctctaatccccaggcccatgactgcccttctctcttctgagttgtgtgtcagtcttcaacctacggtccttcccgactatggactcatgtacaactctgaatgaaactagcatctttcaaagaagagtctagttttcttcctggtcctgtacccctctgtgtttcgttgtactagagaaatttcttatttattaagaaccttttcggcctggcgcggtggctcatgcctgtgatcccagcacttgggaggccgaggcgggaggatcacgaggtcaggaaatcgagaccatcctggctaatatggtgaaacccgtctccactaaaaatacaaaaaattagcggggcatggtggcaggcacctgtagccccagctactcgggaggctgaggcaggagaatggtgtgaacccaggaggcagagcttgcagtgagccgagatcgtgccactgcactccagcctgggcaacagagcgagactctgtctcaaaaaaaaaaaaaaaaaaaaaaaaaaactcga

SEQ ID NO: 1213 - DNA, 1086 bp, Homo sapiens
  misc_feature (10)..(10): n equals a,t,g, or c
  misc_feature (77)..(77): n equals a,t,g, or c
  misc_feature (1056)..(1056): n equals a,t,g, or c
ttgaaacacncttttgagcattaggtcccagctccaccgcggtggcggccgctctagaactagtggatcccccgggntgcakkaattcggcacgagcaacctgtagtgagttggctgtcactcagcagctctggaaaattacctgtctgcactgaatttcctcatcagtaaaatggaaatgattatagtactgaccttgtaggattattctaaaaatcagagaagttcatgcagcttagaacagtgccaggcacatggcaaatgctatggcatacttaagcatcttcctctgtggtgcctcgtcatcaccatgtgattgtgccttgcttgtccctgtttcacttttcagagggagaaaagtggccaactttaagaatcaaaattctgatgttacttcgggaaatgcatagagccagagagacacaatttgacttagtatgatccacatcatcccctcaggctgaatagtggtggcatgcacatctataccaaaatgttttaccttttttgtagaaggaaaatatttgtatcttctattccatatcttagatctttataagagcacttaagttcaacctcctaagaaactgccaattttgttgatcatgatagtctgcacagattttcgtactatttagtgktgggagtgccttagggaccatcaacaacaggsccctccttttatccatgagactactgaggccttggaggttatttgtccatccatggcgggtgcacrgctagaggttatctggttagtagcccaactaagattagaacccaggaattttgatttaatctcaaatgacctcttttatttctgcatccgggaaggagaagaggaaagtaaacgggaaattcatgttatctatggaaaagttatcagtttgatgtttattaaatgatttgtttcaggagattgtttacaacttttatcttcctagacaataattttctgtaagagtaaagtcatggtcattaaggtagtcatattaatgtattcagtaasctgtgaagaaaaatatatatcaatgttttccaataaaatacagtgantacctgaaaaaaaaaaaaaaaaaaaaaaaa

SEQ ID NO: 1214 - DNA, 752 bp, Homo sapiens
ggcacgagcaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtttgtgcttttctggaataacttaatatttgccttttctagggttttgccatgttggtgaagggggaaggtgtgaggcttgttttgagacttcttggacgtaatggtttgcatcttgctcccctgcctgctcttctcttgcacttcctgatgcttcccttgtcagcccccgtggcttattctctccctgctggcgcatgtctgcaggggacagggagctcctcccttctactctgtcaagttcagctgctcactgctagggagtaagagaaaagccagctaattggccatacgcggtggttcatgcctgtaatcccaggactttgggaggccaaggcgggtggatcacctgaggttagaagttcgagatcaacctgatcaacatggtgaaaccccgtctctactaaaaatacaaaaatcaaccaggtgtggtgacaggcacctgtaatcccagctattagggaggctgaggcaggagaatcgcttgaacccaggaggcagaggttgcagtggcccagatagcgccattgcactccagcatgggtgacagagtgagactctgtctcaagaaaaaaaaaaaaaaaaaaa

SEQ ID NO: 1215 - DNA, 1028 bp, Homo sapiens
  misc_feature (1022)..(1022): n equals a,t,g, or c
  misc_feature (1026)..(1028): n equals a,t,g, or c
gggaaccaaagctggagctccaccgcggtggcggccgctctagaactagtggatcccccgggctgcaggaattcggcacgaggtggactggattagctgcggaggccctggaagctgcctgtccttctccctgtgcttaaccagaggtgcccatgggttggacaatgaggctggtcacagcagcactgttactgggtctcatgatggtggtcactggagacgaggatgagaacagcccgtgtgcccatgaggccctcttggacgaggacaccctcttttgccagggccttgaagttttctacccagagttggggaacattggctgcaaggttgttcctgattgtaacaactacagacagaagatcacctcctggatggagccgatagtcaagttcccgggggccgtggacggcgcaacctatatcctggtgatggtggatccagatgcccctagcagagcagaacccagacagagattctggagacattggctggtaacagatatcaagggcgccgacctgaagraagggaagattcagggccaggagttatcagcctaccaggctccctccccaccggcacacagtggcttccatcgctaccagttctttgtctatcttcaggaaggaaaagtcatctctctccttcccaaggaaaacaaaactcgaggctcttggaaaatggacagatttctgaaccgtttccacctgggcgaacctgaagcaagcacccagttcatgacccagaactaccaggactcaccaaccctccaggctcccagagaaagggccagcgagcccaagcacaaaaaccaggcggagatagctgcctgctagatagccggctttgccatccgggcatgtggccacactgcycaccaccgacgatgtgggtatggaaccccctctggatacagaaccccttcttttccaaataaaaaaaaaatcatccaggaaaaaaaaaaaaaaaaaaaaaaaaaaaaaaaaaaaaaaaaaaaaaaaaaaaaaaaaaaaaaaaaaaanaaannn

SEQ ID NO: 1216 - DNA, 1631 bp, Homo sapiens
cttagggggagccctggtgctacttgcttgaagttttcagtgtaagtaccctgatgccttttggaccttgggatcagatcaagagttttggagatcaggtaccaaggaaataaggacagtctagctgcctcaagtgaggggccctttgcatagctctccttccccctcactgaagctgggtagcctattggggttgagagggaaaatgtgaaatctcagaatttatctcccttagaagagagccagtaacttatgtacaaggatgaaagaaaggtcgcagcagtagctttggggaaagggaggaagatatggcacttctccaaccccggaaaacattgcttttgaaaactgctgataaaatatgagccggttattacttctgtttgggagactgtgctctctgtggtgcctctcttggctctactccacagataccagacctcttctaagaggatgagcagaccagctttgaggttgacctgtttctctttgtctgccttcccaaaacaccagcccccaggaagacattaagcagccttaagcttaaattcctactccctcttccaaatttggctcacttgccttagatccaaggcagggaaaggaaaagaaggggggtctctggctttattactcccctaagtctttactctgacttccccaaacccagaaagattttctccacagtgttcatttgaaagaggagtattttgtcccattttccccttcctcattatcaaacagccccagtcttccttgtctctgctaagaaagtagaggcatgatgatctgcctctcaactgccctaagtcctagctaagtatcaggggaaaaaaaaaaaaaaaaagcctaacaaatgggattagactagggctgcaagtagtgaggattttgttgatacctctgctgggatgtgtgctttcccatatcttgccttcaggaattacactgtgccttttccccagggatatgggctctgtctacccagtgctccagtttcccggtaactgctcttgaacattgtggacaagggcaggtcttcatatttttgatcatccctttctcccagtgaaatcccatagcccttacctagagtctagggcacaaagacttcggggaagatacactgagattgacctgaggagacatctacacacaccagtggcagctgccccagggcctgcttccccttcctaagtctgtcatcctctggaagggatgggtggtgctccaatctctggtgcctaaaaacccaagtttatttctctcttaacactggcaataaccagtccacaccactgttgccttttaaaacctcttaataatctcatgctgtgtttgttttgattccaatccaattatcaccagggctgtgtgggtaaatgcttttaaatgctctctcatcttgttcttccccctcaccccccactcttaggtatgtatgatgctaatcttgtccctaagtaagtttcttcctgctccttttgtatcttcctttcttgtctttcctcctaccttttgtctcttggtgttttgggacttttttttttttttttggccttttgtacaaagattagtttcaatgtagtctgtagcctcctttgtaaaccaattaaaaagttttttaataa

SEQ ID NO: 1217 - DNA, 1052 bp, Homo sapiens
  misc_feature (250)..(250): n equals a,t,g, or c
  misc_feature (1051)..(1052): n equals a,t,g, or c
tacagctcaggatgcctgtaacattgtcatctctgggcttctgggtcctgcttagcctgctttttccctggaggactgaccagggatgcggcccagcaacatgttactaaatcatactctcctccctacctttcccagacctctcactcctgcctggtgttccaacccgttctgtggccagagtatacattttggaacctcttcgaggccatcctgcagttccagatgaaccatagcgtgcttcagcagnaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccmctmyccttccttttcttggtgaaaggcacctcctttcctgataatgaatggtgttccctttgcttggctggggagccccccaggccaggtttgctggccatagatacctttgggctgcctgrgacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccactgctgctcctccccttggstytccacctgggatttgctattgaatctctaccctnn

SEQ ID NO: 1218 - DNA, 517 bp, Homo sapiens
gaattcggcacgagtgcacttccaccagctatgtatgagacttcccattgctccacatctccagtattttatgtggtcagtccttttgtttttggtcattttggtggatatgaaatggcatctcagtgtggcttttcattatatttccttgatgactaatggtattctttcaccctttcagtgcttattggccattcatgtatctttgttttttgtgtagcacttcaggtcttttgcccatagatttagtgggttgattgctctttattaatgatttgtagggatgttatatatattctggacacaagattattgttagagatacgtacttcagatattttctcccagtctgtagcttgcctaattattattattattattatttgagatgaagtctcactctgtcgcccaggcagaggttgcagtgggccgagatagcaccactacactcaagcctggctgacagagtgagactctgtctcaaaaaaaaaaaaaaaaaaaaaaaaaaaaaactcga

SEQ ID NO: 1219 - DNA, 814 bp, Homo sapiens
  misc_feature (3)..(3): n equals a,t,g, or c
  misc_feature (6)..(6): n equals a,t,g, or c
  misc_feature (32)..(32): n equals a,t,g, or c
  misc_feature (751)..(751): n equals a,t,g, or c
  misc_feature (770)..(770): n equals a,t,g, or c
  misc_feature (784)..(784): n equals a,t,g, or c
acncgntggcggccgctctagaactaggggancccccgggctgcaggaattcggcacgagcatagacttttaaactggtacggttcttagagatggtccttggccttctgttgttgttgtkgtttttttctttttcttcttctccttctccttcttcttctcttctccttctttcttcttttttttttcagagtcttgctctgtcaccaagactggagtgaagtgatgtgatctcggcttactgcaacctgggaggcagaggttgcagtgagtcgagatggtgccattgctctcgtttgggcaacaagagtgaaactcttgtctcaaaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgtatataaaagttgtatttaatcccttgtgccccaagaatgctataaaagatcccaagaatgttatctatgaaaagatagcaatagggaatggtgaacaaataatttaatttgccaattctaaaaaacatggacttaaaccccatgaaaacttggttccatagttttaactgttttatggttccaatacaaaaccagagtggtttacattccacaatnaccaaatttgcatccaatnttggggtaattttnggtatttgccatgggatactattcattttt

SEQ ID NO: 1220 - DNA, 823 bp, Homo sapiens
cccacgcgtccgcccacgcgtccggtaactttatgaatataaatttacagtttgatacaggaattattaggagtaattcttttctgtttctgtttataatgtagctacagtgttcttcattttcagaagttaacatcaagccatcaaacctgggtatagtgcagaaaacgtggcacacactgaccacacattaggctgtgtcaccattgtgtggtgtacctgctggaagaattctagcatgctacttggggacataatttcagtgggaaatatgccactgaccgattttttttttttcctctttgcagtggggctaggacagttgattcaacaaagtatttttttcttttttctcagtcctaatttgaacaggtcaaagatgtgttcaggcattccaggtaacaggtgtgtatgtaaagttaaaaataggctttttaggaactcactctttagatatttacatccagcttctcatgttaaatatttgtccttaaagggtttgagatgtacatctttcatttcgtatttctcataggctatgccatgtgcggaattcaagttaccaatgtaacactggccagcgggcccagcaatctccatgtgtacttattacagtcttatttaaccaggggtcctaaccactaacattgtgactttgctttgagacctttcctctcctgggtactgaggtgctatgaagccaactgacaaagatgcatcacgtgtcttaggctgatgccactacccgatttgtttatttgcaatttgagccatttaaagaccaataaacttccttttttaaaaaaaaaaaaaaaaaactcga

SEQ ID NO: 1221 - DNA, 1130 bp, Homo sapiens
aattcggcacgagcttgaccgcccacctggcaggagcaggacaggacggccggacgcgggccatggccgagctcccggggccctttctctgcggggccctgctaggcttcctgtgcctgagtgggctggccgtggaggtgaaggtacccacagagccgctgagcacgcccctggggaagacagccgagctgacctgcacctacagcacgtcggtgggagacagcttcgccctggagtggagctttgtgcagcctgggaaacccatctctgagtcccatccaatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctggttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaagatgaggtgtctggccagctcattctcaccaacctctccctgacctcctcgggcacctaccgctgtgtggccaccaaccagatgggcagtgcatcctgtgagctgaccctctctgtgaccgaacccccccaaggccgagtggccggagctctgattggggtgctcctgggcgtgctgttgctgtcagttgctgcgttctgcctggtcaggttccagaaagagagggggaagaagcccaaggagacatatgggggtagtgaccttcgggaggatgccatcgctcctgggatctctgagcacacttgtatgagggctgattctagcaaggggttcctggaaagaccctcgtctgccagcaccgtgacgaccaccaagtccaagctccctatggtcgtgtgacttctcccgatccctgagggcggtgagggggaatatcaataattaaagtctgtgggtaccaaaaaaaaaaaaaaaaaaaaaaaa

SEQ ID NO: 1222 - DNA, 1106 bp, Homo sapiens
  misc_feature (1)..(1): n equals a,t,g, or c
  misc_feature (4)..(4): n equals a,t,g, or c
  misc_feature (8)..(8): n equals a,t,g, or c
  misc_feature (11)..(11): n equals a,t,g, or c
  misc_feature (14)..(14): n equals a,t,g, or c
nttnaggnggnggnaatgaaaggcacatctcccctttctattgggaacacaagctggagctccaccgcggtggcggccgctctagaactagtggatcccccgggctgcaggaattcggcacgagattatatataggtgcctgctaaaaatgaggagatggtaatattttcacacacaaagggaactctcatacactcttggtgggaatgtaagttggtacagccattatggaaaacagtatggcagttcccctaaaaacagaactaccatatgacccagcaatccctctgctgagtatcccaaaggaaatgaaatcagcacttcatagagatatctgcattctcatgctcactgcagcattattcacaatagccaagacagagaaacaacataagtgcccatcaatagatgaacagataaataatttgcagtatatatgtacaatggaatatcattcagccttacaaaaggagatgctgctatatttgcaataacatgggtgaacctggaggacgttacgctaagtaaaataacaatattgaaggaaagaaataatactgaaagaaaaatattgcttgatctcacttatatatggaacttaaaaactacacatagaaacagggtagaatggtagttatccaggctgggaggaagagaaaacaaggagatgtaggtcaaagggtacaaacttgcagttctattggatgaatgtctagagagctaatgtacagcatgagaactatagttaatattgtatatggaaaatttgctgagagactagattttaggtattctacctcaattaaaaaggtaattgtggccaggcacggtggcttacgcctgtaatgccagcactttgggaggcctaagcgggaggatcacgaggtcaggagatcgagaccacagtgaaaccccgtctttactaaaaatacaaaaaaaaaaaaattagccgagtgtggtggggagcgcctataatcccagctgcttcggaggctggggcatgagaatcgccggaaccggggaggcaggggttgcagtgagccgtgatcgtgccactgcactccagcctggacgacaaagcgagcctccatctcaaaaaaaaaaaa

SEQ ID NO: 1223 - DNA, 2455 bp, Homo sapiens
  misc_feature (2277)..(2277): n equals a,t,g, or c
ggcctcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagsggccctggcggaattcaaccccttctcagagacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacagtgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggtttcamaccctggggggtgtgtcactgtgatgggacacgtaggagtccacccttaaaaccagcaccctgtccctcgaggctgccgagtgggtgtgtggactcgggggccttcccacaaaaactnstccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaaaaaaaaaaaaa

SEQ ID NO: 1224 - DNA, 554 bp, Homo sapiens
  misc_feature (552)..(552): n equals a,t,g, or c
ttcggcacgaggtctttacctccaaactaacttctttcctgaacagtagaatagtttttcatactatcatcatttggatggagctctttaaactgacctcagagatcagattcataaccttttgtccagagcaatggatgcctttgctggttccccgttctcattgatggtccctaaatgtgtacttatactgttctgtctagtctacagcttacagtgcattcagccttattcaagcttattgaattcagcctcgttgccttatcaccacgggcttaaactagctaatcttttattaattgtattctatcctcacatacattctatccctttttcctcaagtcatccttctaaactgcacatctgatcacatttgaatcttagctcctttacttgctttctggccttgggcagttgtttataatgctctgtgtcctccattcctcctgcctcctactgtggttcatggcttaatatatgtaaactatggcattaccttactgcttaaaactcttaaatttaaaaaaaaaaaaaaaaaactcgagggggggncc

SEQ ID NO: 1225 - DNA, 1023 bp, Homo sapiens
ggcacgaggaaccaccttctgtaggacagtcaccaggccagatccagaaggcttgaggccctgtggtccccatccttgggagaagtcagctccagcaccatgaagggcatcctcgttgctggtatcactgcagtgcttgttgcagctgtagaatctctgagctgcgtgcagtgtaattcatgggaaaaatcctgtgtcaacagcattgcctctgaatgtccctcacatgccaacaccagctgtatcagctcctcagccagctcctctctagagacaccagtcagattataccagaatatgttctgctcagcggagaactgcagtgaggagacacacattacagccttcactgtccacgtgtctgctgaagaacactttcattttgtaagccagtgctgccaaggaaaggaatgcagcaacaccagcgatgccctggaccctcccctgaagaacgtgtccagcaacgcagagtgccctgcttgttatgaatctaatggaacttcctgtcatgggaagccctggaaatgctatgaagaagaacagtgtgtctttctagttgcagaacttaagaatgacattgagtctaagagtctcgtgctgaaaggctgttccaacgtcagtaacgccacctgtcagttcctgtctggtgaaaacaagactcttggaggagtcatctttcgaaagtttgagtgtgcaaatgtaaacagcttaacccccacgtctgcaccaaccacttcccacaacgtgggctccaaagcttccctctacctcttggcccttgccagcctccttcttcggggactgctgccctgaggtcctggggctgcactttgcccagcaccccatttctgcttctctgaggtccagagcatcccctgcggtgctgacaccctctttccctgctctgccccgtttaactgcccagtaagtgggagtcacaggtctccaggcaatgccgacagctgccttgttcttcattattaaagcactggttcattcactgaaaaaaaaaaaaaaaaaaaa

SEQ ID NO: 1226 - DNA, 896 bp, Homo sapiens
  misc_feature (116)..(116): n equals a,t,g, or c
  misc_feature (863)..(863): n equals a,t,g, or c
  misc_feature (869)..(869): n equals a,t,g, or c
  misc_feature (872)..(872): n equals a,t,g, or c
  misc_feature (880)..(880): n equals a,t,g, or c
aagaagtcagctggacccacgtcaggggccacaaaagccacttttcagcccttatttctgaggacagtgggaagggcaggggtatggtggggggctctgtctcagggactcagtangaggagcaggagtgagaggaaaggcaaggtcacacaaatgtgttgtagctgaagcatctgtggggttcccagggggtgggagtgtgtccaggaagcagatggaaattcaggcctggatctcaggagtgagacctaggagttattgacgatcaggttgaggacaacgagaccaaggaattgaccgcctggatttgaggacttggaggccagctgttaggagccttgcagggctagagccaggaagcttggctaggaaggaggaaagagagtggtagctgggccagtactgaggtggaaggagagatggtttgttgttttcttaaaaatctgacatactcacacatttgtgtgctgatgaggacaagtgtcccttgaagagggaagagggcccgagggacatggatgcaaaggtcagaagggccaagatggccagggtcttgcagcttgagccccagacctcagcctgcctgctctctctgctgtgccctgccctccaggagcctggccctgcctctgggacagagtctgcccacttcctgcgggcgcactcccgctgcggccctggcctcccaccaccccatgtatctagtccccagccaaccccaccaggtcccgaagctaaggtgagaggatgtatgggggctagatggtggttgggcagggctcctggtgtggsgggggtgttcagggacacaacataatgctgtctgcccccacccacgcttgctgtgtcctgcaggagccaangcctgnggntggacttnattcgcacaatgctac

SEQ ID NO: 1227 - DNA, 2246 bp, Homo sapiens
ccacgcgtccgcccacgcgtccgccaggattctcatggcagcccctggcatggccatccctccattcattatgaacactttggaaaagaaagcctttttgaagaggttcccatggatgagtgcacccattcaagttgggttagttggcttctgtttggtgtttgctacacccctgtgttgtgccctgtttcctcagaaaagttccatgtctgtgacaagcttggaggccgagttgcaagctaagatccaagagagccatcctgaattgcgacgcgtgtacttcaataagggattgtaaagcagggaggaaacctctgcagctcattctgccactgcaaagctggtgtagccatgctggtgagaaaaatcctgttcaacctgggttctcccagttacggaaaccctttaaagatccacattagccttttagaataaagctgctactttaacagagcacctggcgtgggccaagtgcctgatactcccttacactgaatcatgttatgatttatagaaatacctttcctgtagcttttatagtcattgtttttcaaagacgatataccagccctcacccaggttttaaaaaagcactggtaggcatagaataggtgctcagtatatggtcagtaaatgttctattgattatcaatcagtgaaaaaagaaatctgtttaaaatactgaattttcatctcactcccattgcaaatcaaggagatctcagcagtgaactgggaaaatacaaaagctctgggctaatctataaaaacttaccctgaaatattaagggcagtttgcttctagtttggggattgcgctagcccaatgaaggtgatgaagcttttggatttggagggtaaaagctccttcacaccccttccaaaagtcagtcacagaccactgcaacatgccttccctgctggatcattatatacattcagattgtgagtggattgccttggttgacttttaatttattgttttttgttcttataaagatgataatcttaccttgcagttattgactttatattcaattatttacatcaaataatgaaataactgaaatgtacaaatgtcaaattttggaagtatattcaataccaatgctgtatgagtgggctgaatccagttcattgttttttttttggtaagaagtgagactacagttccagctacctacatgtcttttcttgtcatccttatagatctctttggctttcagaaagatacagtgataatgtgtgtatgaatcagtcacaatgaattttacttgaatattgtatgttgcattccacttcatttgaaaataatgaaaccatgtaccactgtttacatcatctgtagtgatttcatagataatatatttaatatgacagattatgtttcaactctgtagatgtttaacgtcatagacagttggccctctgtatccgtgagctctatatctgtgaattcaaccaagtttggatggaaaatttttttttttttttttttttgagacggagtctcgctctgtcacccaggctggagtgcagtggcgtagtctcggctcactgcaagctccgcctcctgggttcacgccgttctcctgcctcagcctctctgagaagctgggactacaggcgcccgccaccacgcccggctaatttttttgtatttttagtagagacggggtttcactgtggtctcgatctcctgacctcgtgatccgcccgccttggcctcccaaggtgctgggattacaagcgtgagccaccgcacccggcctgaaaatattttctaaaaagataaaaaatatacataacgatgaaaaataatacaaatttaaaaaccaatacagtataacaactatttacatagtgcttacattgtattaggtgttataagcaatctagagatgatttagcaagtatacaggaggatgtgcctaggttatatgcaaatactgtgccattttatatcaggaacttgagcatctgcagatattggtatcggagggcggtcctggaaccaagcatccacggatactgaggggtgacatttcatgaagtgtagatcattgtattcagagattgtaaatgaaaaaaatatagaaactatttagttttggtagattttttttctgacaatgtgaccagactgaatttcctcataaagaaaaaatggcgtgccttgaaaaaaaaaaaaaaaaaaaaaaaaaaaaaaaaaaaaaaaaaaaaaaaaaaaaaaaaaaaaaaaaagg

SEQ ID NO: 1228 - DNA, 1112 bp, Homo sapiens
gtggcaaatggggctactcctgcttttacttcttggttgctggacccatatattttttacaaatggaatgatttattggtatcttgaaggccaccccattcttaatgagatcctcttcattctgcacttttaaagggtattgcagcactttatcaggccagcagctttggggtaatactgtatgtggtaggaactgtggatctttgtggtcatatgctgtcattgtacctcctattctgcaaagtggaatccttgttctaagatactatgtgagttttcttgttagtgaatgagatactcctatgagtccttggatagtaatactggtcaaggcaccatagacagcataggcaaatgtatatagtagtccccccttatgcatgattttactttctgtggtttcaattacctatggtcaaccttggtccaaaaatgttaaatggaaaattccagaaataaataattcataagttttgttttggttttgagacagggtcttgctccagcccaggctggagtgcactggtgtagtcatagctcactgtagcctccaactcctgggcttaagcagtcaagcctcagcctcccaaatagaactacaggcatgtgccaccatacctggctagtcttggctatttttatttttatttttatagggatgcagtcttgctatgttgcccaggctggtcttgaattcctggcctcaaataatcctcccacctggcctcccaaagtgctgggattataggcaaaaactactgcacctggccctaattcataggttttaaatggtgcactgttttgagtagcacaatgaaaccttgagctgtcccattccatctggcctgggatgtgaatcattcttcgtttagtggctccacactgtatatgctacccgcccattagtcacttaatagccatcttgcttatcagaccaactgtgagagtattgctgtgtttatgttaagtaacccttatattacttaatgattatccaaagcacgacagtagtgatgctggcaattcagatgtgccaaagagaaactgtaaagtgcctcctttaagtgaaaaggtaaaagctctcaacaaaaaaaaaaaaaaaaaactcgtag

SEQ ID NO: 1229 - DNA, 734 bp, Homo sapiens
gaattcggcagagtgaagcattagaatgattccaacactgctcttctgcaccatgagaccaacccagggcaagatcccatcccatcacatcagcctacctccctcctggctgctggccakgatgtcgccagcattaccttccactgcctttctccctgggaagcagcacagctgagactgggcaccaggccacctctgttgggacccacaggaaagagtgtggcagcaactgcmtggctgacctttctatcttctctaggctcaggtactgctcctccatgcccatggytgggccgtggggagaagaagctctcatacgccttcccactccctctggtttataggacttcactccctagccaacaggagaggaggcctcctggggtttccccrrggcagtaggtcaaacgacctcatcacagtcttccttcctcttcaagcgtttcatgttgaacacagctctctccrctcccttgtgatttctgagggtcaccactgccarcctcaggcaacatagagagcctcctgttctttctatgcttggtctgactgagcctaaagttgagaaaatgggtgccaaggccagtgccagtgtcttggggcccctttggctctccctcactctctgaggctccagctggtcctgggacatgcagccaggactgtgagtctgggcasgtccaaggcctgcaccttcaagaagtggaataaatgtggcctttgcttctatttaa

SEQ ID NO: 1230 - DNA, 2142 bp, Homo sapiens
ggcacgagtgatcctgatgtctgttaaagtttgagagccactgtagtttctgatgcagtagttctgggttgcggcctgagaatgtgcatttctaattagttcctaggtgatggctgcagctgctgtagcactttgagaaccactgtcacggcagaagcttcatcctcctcctcatccatacaagcgtcattccattctctagctcttcctctaatgtccattcttgcctgatgatcaagatattgggtctgcgtcctagacagctgtggcatgttgatttgtttgtctgtatgtctttctgtctcttgctctcatttttcttcccctgtgaacaggactctccatttctaagcccaacatgatctccttactggagcaagggaaggaaccgtggatggtggagagaaagatgtcacagggtcactgtgcagactgggagtcttggtgtgaaattgaggaattatctccaaaatggttcattgatgaagatgaaatatcccaggagatggtaatggaaaggctagcaagtcatggccttgaatgctccagtttcagagaacctggaaatataagggtgaatttgagctacatcagggaaatgcggagaggcatttcatgcaagtgacagctgttaaggaaatctctactgggaaaagagacaatgaatttagtaattctgggagaagcatacccctgaaatcagtatttttaacacaacagaaagttcctaccatacagcaagtacataaatttgatatttatgataaactcttcccccaaaattcagtcataattgaatataaaagactccatgctgagaaggaatctttgataggtaatgaatgtgaagaattcaaccagagtacgtaccttagtaaagatataggaattcctcctggggagaaaccttatgaaagtcatgatttttcaaagctcttaagtttccactcattatttactcaacatcagaccactcattttggaaaattaccccatggatacgatgaatgtggtgatgcctttagctgttactcattctttactcaacctcagagaattcacagtggtagaaaaaccatatgcatgcaatgactgtggaaaagcctttagccacgacttctttctcagtgaacatcaaagaactcatattggggagaaaccttatgaatgtaaggaatgtaacaaagctttcagacagagtgctcaccttgctcaacatcagaggatccacactggagagaaaccgtttgcgtgcaatgaatgtgggaaggcctttagccgttatgccttccttgttgaacatcagagaattcacacaggtgagaaaccatatgaatgtaaagaatgtaataaagccttcagacagagtgctcaccttaatcaacatcagaggattcacactggagagaaaccctatgaatgtaatcagtgtggaaaagccttcagcagacgcatagcccttactctacatcaaagaattcacacaggagagaaacccttcaaatgtagtgaatgtgggaagacctttggctatcgctcacacctgaatcaacatcagagaattcataccggagaaaagccctatgaatgcatcaaatgtgggaagttttttaggactgactcacaacttaatcgacatcatagaattcacactggagagagaccatttgaatgcagtaaatgtgggaaagccttcagtgatgctttagttctaattcaccataagagaagtcatgcaggagagaaaccctatgaatgtaacaaatgtggaaaggccttcagttgtggctcatatcttaatcaacatcaaagaattcatactggagagaaaccctatgaatgtagtgaatgtgggaaggcttttcatcagatcttgtccctaagactacaccagagaattcacgctggagaaaaaccttataaatgtaacgaatgtgggaataattttagctgtgtctcagcccttagacgacatcagagaattcataatagagaaacgctctgattataacaagtataggaaagaaaacatgtggttaccactcaatccttattaaatattagtgagttctttttggttagtaaaaaaaaaaaaaaaaaaaaaaaaaaaaaaaaaaaaaaaaaaaaaaaaaaaaaaaaaaa

SEQ ID NO: 1231 - DNA, 692 bp, Homo sapiens
ggcacgagtgttcttcagcaaccctacctgcttctccaaactgcctaaagagatccagtactgatgacgctgttcttccatctttactccctggaaactaaccacgttgtcttctttccttcaccaccacccaggagctcagagatctaagctgctttccatcttttctcccagccccaggacactgactctgtacaggatggggccgtcctcttgcctccttctcatcctaatcccccttctccagctgatcaacctggggagtactcagtgttccttagactccgttatggataagaagatcaaggatgttctcaacagtctagagtacagtccctctcctataagcaagaagctctcgtgtgctagtgtcaaaagccaaggcagaccgtcctcctgccctgctgggatggctgtcactggctgtgcttgtggctatggctgtggttcgtgggatgttcagctggaaaccacctgccactgccagtgcagtgtggtggactggaccactgcccgctgctgccacctgacctgacagggaggaggctgagaactcagttttgtgaccatgacagtaatgaaaccagggtcccaaccaagaaatctaactcaaacgtcccacttcatttgttccattcctgattcttgggtaataaagacaaactttgtacctcaaaaaaaaaaaaaaaaaa

SEQ ID NO: 1232 - DNA, 807 bp, Homo sapiens
  misc_feature (726)..(726): n equals a,t,g, or c
  misc_feature (783)..(783): n equals a,t,g, or c
  misc_feature (790)..(790): n equals a,t,g, or c
aaatcatgtctcttcattttataataccccaatacataaataaccttgtacattttcctaattatattaaacattgatattaaaagttaccattgcttaactataaagatgccccataatcacagaactctaaaatatttgcttctctctttataggccttacttttatcaaatgtttctcgacaaaagttttccactggggaaattattaacttgatgtcagcaactcatggacttgacagcaaacctcaatctcctctggtctgccccttttcaaatcctaatggccgtatatctcctttggcaagagctgggtccagcagtgttagcaggggtggcagtccttgtgtttgttataccaataaatgctttagctgcaactaaaataaaaaagttaaaggtgtccctggcaaccttgtgtgtctatttcttactggatgaaggaaacattttaacagccactaaagtgttcacatcgatgtctttgtttaatattttaaggattcctctgtttgagttaccaaccgtgatctcagctgtggtccagacaaagatatccctgggccgtttggaagactttctcaacactgaggagcttcttcctcaaagtattgaaacgaactatacaggagatcatgctattgggtttacagatgcttctttctcctgggataaaacaggaatgccagttctaaaagaggctctgtggcttatgkttctcarcangcctggattcamaattgcattttgcaagaaaacattctctttggctccatcatgaanaaagagntttatgagcaagtattg

SEQ ID NO: 1233 - DNA, 1215 bp, Homo sapiens
  misc_feature (345)..(345): n equals a,t,g, or c
  misc_feature (1024)..(1024): n equals a,t,g, or c
  misc_feature (1098)..(1098): n equals a,t,g, or c
  misc_feature (1186)..(1186): n equals a,t,g, or c
agaggaagtcttttgccaagcctgttctctggactaacgccatccaggctgggaggggaagagtgctctgctacactcgtccccctcctgcctcatcttccttctcagccttggttcctgatgggaacagaatggagggcctgagaacatactttctaaatgcctttgacccaggaaccgattatctatatttgttcccattttccttcaccgtgacattccagcattgtctgactgtgaggtgggcctttgagagcctccaggttcctcaaaacaggcctgagcgatgggcatcacaccctctgcctacccacrtgcctgcttacctgccagataaccaagtgnagatgtctgcgagtggctagttttcacattcttactagtgtttggytcacctttgggcaaaggccccctctaggccttgccccacctccatcaaacgcagacactgtagtcagacctcagyaatataggaggcaataatcttttaacagtgttttgcaaacaaacaaaaagagaaaaatcccagccaggggaactcgccacctgcccacgctagttccatccacgctcaagacccgcccttagaccaggcaggcaaaggcccccatcacactcggccactagtggggtcctgaggccaagaaagaaaccagaccctgtatgacaagttgggktctttccagaacacgacagaaacagggggggccccttgttaatgccactccatactccagaagcattattccttatttgggacagccaagggcagattcacaggttattgtaggaataaagactagtttacaaaggaraaagagsccctggacttcccmaggaaaggtcaggttagggctcctgtacccattctgttccaccactgtttgatctctctggcctcccaccaggaatgccgtttcctttttatggatctgttgggaaccagagagaatcaacagatcaatgacataggatccgaagtgcaatgatagtcacttctagtttggcatttcacaaactctgnacagcaaggtattggtaggttactcaatttcaaaagggccccatggccaaatatgtttaggaaccgctgtttgnatttctttttttggagacgcattgtatataatatatgtcaaaggctttcggaattcctgcaggaaagaaatcagctttgttaaatccnaaaaaaaaaaaaaaaaaaaaatagactcg

SEQ ID NO: 1234 - DNA, 614 bp, Homo sapiens
  misc_feature (612)..(612): n equals a,t,g, or c
agggcgcggcccgggttcccgttccccgcggagccatgcggtacaacgagaaggagctgcaggctctgtcccggcagccggccgagatggcggccgagctgggcatgaggggccccaagaagggcakcgacgaggccgagcccgtcggagccctgctgctggagcgctgcagagtcgtccgggaagagcccggcaccttctccatcagcttcattgaggaccctgagaggaagtatcactttgagtgcagcagcgaggagcagtgtcaggagtggatggaggctctgcgtcgggccagctacgagttcatgcggagaagcctcatcttctacaggaacgaaatccggaaggtgacgggcaaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcantt

SEQ ID NO: 1235 - DNA, 2911 bp, Homo sapiens
  misc_feature (622)..(622): n equals a,t,g, or c
ggtggtttttgttctgcaataggcggcttagagggaggggctttttcgcctatacctactgtagcttctccacgtatggaccctaaaggctactgctgctactacggggctagacagttactgtctcagctctaggatgtgcgttcttccactagaagctcttctgagggaggtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagangcgtctaaactggatccagtgggcttccctcctgactttatttttgtctattgtggccttgactgccgggactaaaactttacagcacaacttggcaggacgtggatttcatcacgatgcctttttcagcccttccaattcctgccttcttttcagaaatgagtgtcccagaaaagacaattgtacagcaaaggaatggacttttcctgaagctaaatggaacaccacagccagagttttcagtcacatccgtcttggcatgggccatgttcttattatagtccagtgttttatttcttcaatggctaatatctataatgaaaagatactgaaggaagggaaccagctcactgaargcatcttcatacagaacagcaaactctatttctttggcattctgtttaatgggctgactctgggccttcagaggagtaaccgtgatcagattaagaactgtggatttttttatggccacagtgcattttcagtagcccttatttttgtaactgcattccagggcctttcagtggctttcattctgaagttcctggataacatgttccatgtcttgatggcccaggttaccactgtcattatcacaacagtgtctgtcctggtctttgacttcaggccctccctggaatttttcttggaagccccatcagtccttctctctatatttatttataatgccagcaagcctcaagttccggaatacgcacctaggcaagaaaggatccgagatctaagtggcaatctttgggagcgttccagtggggatggagaagaactagaaagacttaccaaacccaagagtgatgagtcagatgaagatactttctaactggtacccacatagtttgcagctctcttgaaccttattttcacattttcagtgtttgtaatatttatcttttcactttgataaaccagaaatgtttctaaatcctaatattctttgcatatatctagctactccctaaatggttccatccaaggcttagagtacccaaaggctaagaaattctaaagaactgatacaggagtaacaatatgaagaattcattaatatctcagtacttgataaatcagaaagttatatgtgcagattattttccttggccttcaagcttccaaaaaacttgtaataatcatgttagctatagcttgtatatacacatagagatcaatttgccaaatattcacaatcatgtagttctagtttacatgccaaagtcttccctttttaacattataaaagctaggttgtctcttgaattttgaggccctagagatagtcattttgcaagtaaagagcaacgggaccctttctaaaaacgttggttgaaggacctaaatacctggccataccatagatttgggatgatgtagtctgtgctaaatattttgctgaagaagcagtttctcagacacaacatctcagaattttaatttttagaaattcatgggaaattggatttttgtaataatcttttgatgttttaaacattggttccctagtcaccatagttaccacttgtattttaagtcatttaaacaagccacggtggggcttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatggtattttgcatgcagccagttaactctcgtagatagagaagtcaggtgatagatgatattaaaaattagcaaacaaaagtgacttgctcagggtcatgcagctgggtgatgatagaagagtgggctttaactggcaggcctgtatgtttacagactaccatactgtaaatatgagctttatggtgtcattctcagaaacttatacatttctgctctcctttctcctaagtttcatgcagatgaatataaggtaatatactattatataattcatttgtgatatccacaataatatgactggcaagaattggtggaaatttgtaattaaaataattattaaacctaaaaaaaaaaaaaaaaaaaactcgag

SEQ ID NO: 1236 - DNA, 921 bp, Homo sapiens
  misc_feature (111)..(111): n equals a,t,g, or c
ttttcttaagggaaaaatcacgctgtgttcttttaaaatccctcaggttttatgttttattgctaccagagtctgcctccctgaggttcttgtatagactagttatttccntctgtaaagaagctgttctattcgttctcgcctggtttggaacaaactgaacacttccaaaggaggcagtccttgcagccttgtctccttccactcccctcctccccacagtcctgggctggagcagcgagtctgtcgatcccagggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatctaatttttctctgtggaaaaaaaaaaaaaaaaat

SEQ ID NO: 1237 - DNA, 1202 bp, Homo sapiens
ccacgcgtccgggcaccagctgcccctccttccacaagtactcaagcctgtttgtaaatactgaaggaattgatggggttgaggaaaggaggtgcatgtgaccagggtcccaaggccacagcttttcagatcctaggaagcaagtggcatttgcttgagttgtggcctcggaaggagaatgtttatctgttttctaactttgctgacaccaggattctccctgtcattgagaagaaagcattatctaattaccttcaggtggtttacttattctgtaaagaatatgtgtaaatattttgtacagagccctgtatcaaataaacagccatatgtggttactaatcacctcttctgtcattccgtccttggccaccgctcagtgggaatggtctctgatctggatgctcccaccttccatgtcaggcccagaactgtgccatggtctgtggactcctggtcagccttgactggctaggagaccttgggcagtacctacagtcttgctgtttctgtttcatctgcaagaattatgacccacacactccagctgcagcccagggcactgtgatattttatacgtgtgtagatgtttttgtccacagttcctggttcatcactcccataaccctttgttataatgttgggacactgcaggcctcagaaaacggaatctctgtctgtgaccttctcctgccccatttcacttgctcaacaccagactttaatctgactgtagctcataagaccctcattccagagagggtgctgccccatacccggaaggaggaacgctgcacagagaggccaagaagcatctggacagacaggccttgctgggtttagaccttatgctttttgtccagtttcatctcaacacagctgccatgcttcagccatgcctatccaatgacgtctccataaaaggcccaggaacacgggagcttctgaagagctgaacatgtggagggaggggaacgagaacttgtccatgtgccaagagggtggcgcacccccactccatggggacagaagctccagcatttgcccaggacccgtccagacctcaccctgtgtgtatcttcatctggctgtttacttatttgtatccttttctaataacgtttgtaataaactggtaaacataaaaaaaaaaaaaaaaaaaaaaaaaaaaaaaaaaaaaaaaaaaaaaaaaaaaaaaaaaa

SEQ ID NO: 1238 - DNA, 1813 bp, Homo sapiens
  misc_feature (19)..(19): n equals a,t,g, or c
  misc_feature (1622)..(1622): n equals a,t,g, or c
gaaatccgttaagctggtncgcctgcaggtaccggtccggaattcccgggtcgacccacgcgtccgcaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgccyggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggygggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtnggccggcggccaaaccagtcactcggggaggaatgcggaggagcgctcattccattctatttaattgcagtgtacaaaattgtgtttgtatatagaataaactgtctgttgacagcgaaaaaaaaaaaaaaaaaaaaaaaaaaagggcggccgctctagaggatccaagcttacgtacgcgtgcatgcgac

SEQ ID NO: 1239 - DNA, 1576 bp, Homo sapiens
gcgtccgcccacgcgtccgagttctacaggctctggctgtctctcttcctacatgctgggtaagaggctcctcactgcccccgaacccgacccctgtgatggccacccagccggacccctggggaaaggttcctgggccagggcatggccggcccaacctgccgaagcctactgctcctgaagtgcctggctgaaggccgctgcctggtgtgtccctcccccagcgtggtgcactgcctcgtgtctgtggtctttcaaatgaccatcctgagggacctggagaagctggccggctggcaccgtatcgccatcatcttcatcctcagtggcatcacaggcaacctcgccagtgccatctttctcccataccgggcagaggtgggcccggccggctcacagttcggcctcctcgcctgcctcttcgtggagctcttccagagctggccgctgctggagaggccctggaaggccttcctcaacctctcggccatcgtgctcttcctgttcatctgtggcctcctgccctggatcgacaacatcgcccacatcttcggcttcctcagtggcctgctgctggccttcgccttcctgccctacatcaccttcggcaccagcgacaagtaccgcaagcgggcactcatcctggtgtcactgctggcctttgccggcctcttcgccgccctcgtgctgtggctgtacatctaccccattaactggccctggatcgagcacctcacctgcttccccttcaccagccgcttctgcgagaagtatgagctggaccaggtgctgcactgaccgctgggccacacggctgcccctcagccctgctggaacagggtctgcctgcgagggctgccctctgcagagcgctctctgtgtgccagagagccagagacccaagacagggcccgggctctggacctgggtgcccccctgccaggcgaggctgactccgcgtgagatggttggttaaggcggggtttttctggggcgtgaggcctgtgagatcctgacccaagctcaggcacacccaaggcacctgcctctctgagtcttgggtctcagttcctaatatcccgctccttgctgagaccatctcctggggcagggtccttttcttcccaggtcctcagcgctgcctctgctggtgccttctcccccactactactggagcgtgcccttgctggggacgtggctgtgccctcagttgcccccagggctgggtgcccaccatgccccttcctctttctcctcctacctctgccctgtgagcccatccataaggctctcagatgggacattgtgggaaaggctttggccatggtctgggggcagagaacaaggggggagacacaagtagacctcaggtagaacgacactgggcggagccaccccagggcctgctcccagggagtgctcgaggcgcatcaggcccgttttttaccagtttatatcacggtcttcatttttaaaagtaacgctaactttgtacggacgatgtctcatggattaaataatattctttatggcaaaaaaaaaaaaaaaaaaaaaaaaaaaaaaaaaaaaaaaaaa

SEQ ID NO: 1240 - DNA, 1996 bp, Homo sapiens
  misc_feature (1975)..(1975): n equals a,t,g, or c
  misc_feature (1980)..(1980): n equals a,t,g, or c
ggtcgacccacgcgtccgggtggctccagagatggcagtgagcgagaggagggggctcggccgcgggagccccgcggagtgggggcagcggctacttctggtgctgctgttgggtggctgctccgggcgcatccaccggctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagctcttggtggagggctccaccctggccttcttcgtgctcacgggctacaagttccagcccacagggaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggctaaaaaaaaaaaaaaaaaaaaaaaaaaaaaaaaaaaaaaaaaaaaaaggggggccgntctanaggatccctcgagggg

SEQ ID NO: 1241 - DNA, 1769 bp, Homo sapiens
tcgacccacgcgtccggaaaatgcattcagaatcttcagagtcaggtgaaaagctttggccatgattggccttggcattggttgtgctggacagcgggaccaggcgcccccttacctggctcccccctcccaggagcccggtgatgctgcgaaggctgtgaacaggggaggcggcactgtgggggctgccggcagccggggctggggagagacatgtggacacgtggcctctatggctcccgcctgccagatcctccgctgggccctcgccctggggctgggcctcatgttcgaggtcacgcacgccttccggtctcaaggtaggggaagtctggtggtggcggtggggagggagcgaaaaatgtaagagaccagttgggctccaacagaaagaggcatcagggggctgggatgggggtcaatgggggaaggccctggggtcaataggcgggagccttgcagccaactccctggatttcgggggtcagtgaggccagcatcacttgctccagcagcctaacagccaggacacaggggtccaataagaccagggcccaccccaggcctctgaccctcacccacagatgagttcctgtccagtctggagagctatgagatcgccttccccacccgcgtggaccacaacggggcactgctggccttctcgccacctcctccccggaggcagcgccgcggcacgggggccacagccgagtcccgcctcttctacaaagtggcctcgcccagcacccacttcctgctgaacctgacccgcagctcccgtctactggcagggcacgtctccgtggagtactggacacgggagggcctggcctggcagagggcggcccggccccactgcctctacgctggtcacctgcagggccaggccagcagctcccatgtggccatcagcacctgtggaggcctggtgagctgaggattctggaacgcggggggaaatgcccataagtttggaagttaagaaaaacacttctacatagagggcagagaaggaatgatagtgggatgttttttaagtgttttgagccaatcagtgctttggggatgcagctaaagcagtacttaaaggaaaatgtatagccttaggtaaggctgaaaattaatgagctaaacatcaatctcaaaaaattcgaggctgggcatggtgacttatgcctgtagtcctggcattttgggagggtgaggcgggcagatcacttgaggtcaggagttcgagaccagcctggccaacatggtgaaaccccatctctactaaaaatacatataaaaattagccaggcatggtggtatgtgtatgtaatcctagctactcaggaggctgaggtgggagaatcagttgaactcaggagggggaggtctcagtgatctgagatcacaacactgccctccagcatgggtgacagaacaagaccctgactctttaaatatatatatatattttttatatttataaatatatataatatataattatatatgtgtatgtgtatgtatacacatacatacatactatacacatacacacatatataattttaaaataaaaagaaattagaggctgagcatgctgactcatgcttttaatcttagccctttgggaggccgaggcaggaggatcccttgaggccaggaattcgagaccagcctgggcaacatagtggaaccccatctctatgaaaaataaattaaaaattttaaaaattaaaaaaaaaaaaaaaaaaaaaaaaaaaaaaaaaaaaaaaaaa

SEQ ID NO: 1242 - DNA, 1677 bp, Homo sapiens
gcgtccgcaagttgttgggaaaacagacgacacacttgccctgctcaacctggccgcatcatggctgtgatgccctccctccctccaggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaattgttctccactttttgcggagagaggagtttcacaggaactggaaatgtgctttatggcatttgcctatccactctctccaacctgaagacacgttgccaagctcacctacccgaggggcagcccactcccagcccctttgaggcctatacagagctggtggggtcgggggtgccaagccaggccctcccctcccctcggttgttgacacaaagatgaggaagagatggtaggataaaaaaaaaaaaaaaaaaaa

SEQ ID NO: 1243 - DNA, 1042 bp, Homo sapiens
ccacgcgtccgatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagaggaggaggaggaggaggaggaggaggaggaggaggccaggtcctggtggagcctttgcctagcccagtcctctctgcctctctcctggctgaagctgtttgtcaggattaccctcgggctaaagaggaaaaataaagatgttgagctaccaaaaaaaaaaaaaaa

SEQ ID NO: 1244 - DNA, 602 bp, Homo sapiens
gaattcggcacgagtgccctgggttccgattgatacccactcttgttgttcaaaagagagatgagtgctgcttctttttggccccggcctgtggcaagtatctcagtcttcatactgctgggaagctctgtaaccaccagcaagaccagaagtggggtgatcagcagtgcaggaaagcccatttgggtgcagtccccgcacctagcccttttggaagtgcttctccaaaagggaattgtgccggaaaagtagggattgaaaccaaacagccacatcctgccatcaggatgctctttatggccccactgaccaagaaatcacagcttctgtactcagtgatgactgcttgacttcagttgaggaaaacaatgaagttctgtagccaggcgtggtggcagatgtctgtaatcccagctactcgggaggctgaggcaagagaattgcttaaaccccgggaggtggaggttgcagtgagccgagatggcgacactgactccagcctgggtgccagagcgagactctttgtctcaaaaaaaaaaaaaaaaaaaaaaaaaaaaaaaaaaaaaaaaaaaaaaaaaaaaaaaaagaaaaaaacggcacga

SEQ ID NO: 1245 - DNA, 289 bp, Homo sapiens
  misc_feature (284)..(284): n equals a,t,g, or c
catttacccacctatcaacatgtttgctttctcttttgttggtgagaatgagtggcttcttgctcctagctagagccagtccttccatatgtgctttagattcttcctgttttgttcaagaatattgctcaagctattcttcctcctgtttcctgcatcagcatttcccctctctactagatcatctctgtcagtaaatgaacatgttgttgtttctcctagaagtactgtttctatatctagatagtactctagctagagttaaaaaaaaaaaaaaaaacctnggggg

SEQ ID NO: 1246 - DNA, 519 bp, Homo sapiens
ggcacgagccccaggccagccagggccaggcctactttggccacccttaaattagaatgtggggtcaggggtcacagaaaagccatttctctgacctagtgtttggcgtccgggaactctgtgcccaaccttcagaccctggcagtcctcactgaggccattggcccagagcccgccatcccccgaracccccgggagccgcctgttgccacgtccacacctgccacaccctctgccgggccccagcccctcccaaccgggaccgtgctggtccctgggggtcctgccccaccttgccttggggaggcatgggccctcctcctcccaccctgccggccgtcactcacctcttgcttctggtcccccaggcctagcccttggaaggagacaggagtctagggaggctgaagcccactcccggggaggcccgtgctcctccagccccagggacagcaaggaaaagagaagagagcagagcatttcatggctctaataaaaaaaaaaaaaaaaaaaactcga

SEQ ID NO: 1247 - DNA, 678 bp, Homo sapiens
gaattcggcacgctcttgggggtagtggatgcgggttgaggggtttcaggtgccctgggctgtcactttgtaaaggcttgccaacctagattgagatgggtggtaaaggaatcaattacacaatgccacacatttgcttgcttctgctgaatgccttagtagtttcatgtttattgctggaagccattctcttacagcatctagtgctgtgtaacgagctaccttaaaatgtaaaggcttaaaacagccatctttgatgtctttgcaggtctagaagtcaggaagggtaattattcagctccaagtggcattggctctagttactacctgatattccagggtggtagctggagtggtctcaagggtccaagctgacctcacttacaagctgggtgccttggcagggacagttaggaggctgtgtgtagcagagcctcactcggtctttgtattctccaggcctcttcagtggtttctttggcacttcttaaatgatgtcagggttccaggagttaatgttccaagagacaggaagtggatgctgcccatctctttttttttgtttgtttgtttgtttgtttttttgagatggagtcttactctgtcaccactgcactccagcctgggcaacagagcgagactctgtctcaaaaaaaaaaaaaaaaaaaaaaaactcga

SEQ ID NO: 1248 - DNA, 547 bp, Homo sapiens
  misc_feature (5)..(5): n equals a,t,g, or c
  misc_feature (22)..(22): n equals a,t,g, or c
gggcnccccaaaaattcccccnrggttttttttttttttttttgttttcaagaagaaagaagcaatgcagcaaagtggtgcagaacacaggagctggagccattcagacccaagtccaactcttgacctcgcccactttctctacagtcctgagcaattacacctgccaagcaccttcccaatggacagactggcaggccctactcccaacaggcatccagactgagcatcaccaaggatgggacaaacagaagcaatgcaagaggaaatgcgaacacgaacatgcaccactacaccacaacctatggaaacaatcaggcaaaacaagactaggagacatatgacaagaaaacaggcctggacgcttcaaaaatgccaatgtcacgaaagacaaaaactgggcatgctcttctggatcaaaggagactaaagagatataacaaccaaacacaataaaactatcctagattacatcctggattttttaaaagcaaaaaagaacaatttggtaacaactggggaaagtgttaatgtggctacattttaa

SEQ ID NO: 1249 - DNA, 470 bp, Homo sapiens
ggcacgagccagggagatgtggaccagaaaacctagctctgcaagctacccagagagggacaagattctcggtgcctatgtgtaagagttcacgccagtacacgtatacatcagtgcatatgtgtcagtgtgcgtgtgagcgtgtagagtggagggggtcactgacaccagccagggcgttgcataaccacctgacagagcaatggtttccccatggcttccccttcttgtctcgctttttcacttactgaattgtctccgcggtgttggcacgtctggccagagcctgggactgccctcctcatccttcccaccaacaccagagcacaaggccactgcccgtgactgaaccacagggatgctgcacacgtccagggatcctgtcctttcccttcctttgtaagagtgtcccagcctcctgtcccctacactcagaccaaactgttccatggtggtgactccagccctga

SEQ ID NO: 1250 - DNA, 1984 bp, Homo sapiens
aattcggcacgagaccggcgctagtcttgcgtcgcacagcaggattgcgctgctttctgatgaccttcgacatggatggcgatggtaatgaacgcttttcccgtaacgccccacccgcaaccgacccaggccggaatgaccctgatcgaggtcctggtatctgtgctgatcctcgctgtcggcctgctaggggcggcagtcattcagctcaatgcattgaaatacaccgacagttccaggatgaccagtcaggccagtttcattgcctacgacatgctcgaccggatccgcgccaattcgggtgctgattactcctggggccagggtgaacgcgcgccctccagcacctcggtcgcgagtgtgcgtgatctggacctgcacgactttgaagcgaatatcgtcgggttcgccggggaaagcgccaaggggtcggttgcggtcaatcagcgagaagtgaccatcagcatcagttgggacgactcccgtggagcgaaggctcaaggcacccgggaaacattcaccctgaccagccgggttgcagtcgatccgagggtgttgccatgagaggtccagtgtgcggtttcagcctggtggagatgctgctggcattggccctcggcctgatgttgatcctgggggtgacccagattgcactcagctcccgaaccacttatgccagccagagtgcggcttcgctgttgcaggatgatgcacggttcgcccttggcaagctgattcaggaaatacgccaggcgggcatgtttggctgcttgtccgctgcatcaatcagcaacgctcccgcaggttttgatcgtcccattggatggagtaccaccggcagttcccggtccctgacgctggtgaccgccgacgtcggggagggtggcagcaagccggactggacggtgctttccgattgcaccggctctgcccacgcctatgttggaagcccgccggcagcgacgcccgggcaaatccacttcccactgcgcaagctgacctacacctttgagggcgggcagctgaagttaagtacgctggcggccccgagcaaagcggtgctggtggataacgtgggggcattcgatatcagtttcggcgtggccgacaagcctggctcaacggttgtcagccgatatgaccccacccccggcgatgagtcgctcatccgcagcgtgcggattctgctgacacttcaggatccaaatgggttggtgaaagaccaggcctacagcgtggtcgcggcactacgtaatcgcctggagtagcgtgcccatgggttattacctctcccgttcgaggcaggcaggcatggttttgctgatcagcctggtattcctgctgctgttggcactcctcggagtgtcttcgatgcagggagcaatctcgcaagaaaaaattaccggcagccttcggcagcgcaaccagtcgtttcagcaggccgaaagcggcctcaggcttggcgagtctttggtgcaggcgtcaggtttcgccctgcgcccttgccactcgacggctgcgtgcgcgccacctgccgaatcggtttcggtagtggggccggggacgaaccccgtatcgactgtgacctggatagggatgaaagatggcgtctacggtattcaaaacctggggccgggaacgggtttggctcaactcccggcagaggcccaggccacggtctatcgcgtgacatcagtgggcgtcagtgggcactcgcgttcggtcctggagtctgtgtatgcccgtgtgggcagcgggcccggcgagcgtttccgacgaatcatgtggcgacaacttcaataggtgagcagcacgatgggcaaggattgcacaggcttcaccctgatcgaattactgatcgccgtggcctcgtgccgaattcggcacgagattaattcccctaaaaatctttgaaatagggcccgtatttaccctatagcaccccctctaccccctctagagccaaaaaaaaaaaaaaaaaaac

SEQ ID NO: 1251 - DNA, 352 bp, Homo sapiens
  misc_feature (290)..(291): n equals a,t,g, or c
  misc_feature (300)..(300): n equals a,t,g, or c
ggaaaattgcttagaggaaatggagtatattactggtataggtactctaaaatgtcttttgaattaagtcagagttagagggttgtgtctctaaaccgcatcttactggtattatgctatcagcctgtattgagagactttataggtaaagtccaatttaggctgtttggtattatctattaaaattagaatgttcatgctctgtaacctgctacttccacttctagaatttatctttggaagcacatatctgtccacagacctatatttacacacatgtatgagagtgnnccccggtgnaacattcattcattttaaccaaatgttttgatgtgtagggccctagcgattt

SEQ ID NO: 1252 - DNA, 478 bp, Homo sapiens
  misc_feature (410)..(410): n equals a,t,g, or c
  misc_feature (476)..(476): n equals a,t,g, or c
atttcttatgacatgggggtttgaattggttggcaaatgtttaattttaatatccataatcagtgaggtcctgctggctgtaatcattaattgtgaaatctaaggagcttagttcatggctctagaatttcacagaaaartgygmtatgatacgagcattaagtttatttcttctgatctttgatgcagctttgttcagtttatctgtttttgtatttattggtcatctacttcccatgccaaaagggactggtctacatagctgcgctaaacacctgatcaaatcactaaaagaaaatgtgttacctctaatgaattatcctgattgtaagttaaaaatcaatatttccccgtagtgaggtttgctttttaaaaagaakkcttaaaaaaaaaaaaaaaaaaacgagttnaagaaaaggaagcaagctcaggtaaggtgcacacattgggctaaggaagctagagcctgtggagangc

SEQ ID NO: 1253 - DNA, 1287 bp, Homo sapiens
  misc_feature (1188)..(1188): n equals a,t,g, or c
  misc_feature (1202)..(1202): n equals a,t,g, or c
  misc_feature (1230)..(1230): n equals a,t,g, or c
  misc_feature (1264)..(1264): n equals a,t,g, or c
  misc_feature (1277)..(1277): n equals a,t,g, or c
  misc_feature (1282)..(1282): n equals a,t,g, or c
aattcggcacgagaattttttttggtgatggcatgttcagaatcttggatccctaagttcaatatattggacatatttaggaactctggaaattatgttgttttcacatatctagtaacttactagatgaatcagtagatttcattaaagtatatctaataacagataattatgatgtacttctgggttgacatgcatgtctctcattatcagctatcagtattagtgtcatgctttggagacagttatcttttgaaggttttggggttcttatgaacctcatttttcccaggaagtttctgtaattcctcctatgcctattcttgtcttttctatctgcttgcagtgtacgttatttagatcagaggcaattatttttcaggaagaaagaaatcatcaagtgacactcctaaaggcagtaaagacaaaatttcagtctggaaccggtctcagaakgcctgtattagaatatgcaaagtccatccaaattatatccaaatatacttgtggcacagtgctaccagtttttaaaatgagacgttactatgtagggcagaagtgccaatgaggagagagaaggagctgttcagtttgccctccagccgccacctccttctattattggctgaatgaattagtgcaaaattagtagccaaaagggtagacagtgtgaatggaagggaggagaaggacagaaactttaatctccaggaaagcttatttatcctttaaaaaatggaaagttgggcaggcgcagtggctcacgcctgtaatgccagcactttgggaggccgaggcgggcagatcacgaggtcaggagatcgagaccatcctggctaacacagtgaaaccctgtctgtactaaaaaaaaaaaaatagaaaaagccaggcgtggtggcaggcgcctgtagtcccagctactcgggaggctgtggcaggagaatggtgtgaacctgggaggcggagcttgcagtgagccgagatcgcaccactgcactccagcctgggcaacagagcaagactccgcctcaaaaaaaaaaaaggaaagttgagtgtattccatgtacctgaacatgctatttaaaactgtgggctactttcagaatgtagactaatgkgktctcgaccattggaatgaatgagaatttgkatttgataggaaagtcagaaagtcctcgagagtctttntaaaaccgggccgngggccccatcgaatttttcaacccgggntgggggtacccaggtaaagtggtaccccaaattnggcccctataagnggagncggaa

SEQ ID NO: 1254 - DNA, 492 bp, Homo sapiens
  misc_feature (486)..(486): n equals a,t,g, or c
aagctggactcgcgcgcttgcaggtcgacactagtggatccmaaagaattcggcacgagcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaaawrmaaaaaaaaaaaaaaaaaaaaaaaaaaaaaaaaaaaaaanaaaaaa

SEQ ID NO: 1255 - DNA, 392 bp, Homo sapiens
gaattcggcacgagcgctgttgggtgtgtgtatgtttgcgctgggcgcgcttgccgtgccggtgaccggtttcggcagtatgcctgcgctctcgatggcgctgaccatgctcggctgctacgcgatagccatcctgctgttcgtgacgctggtgcgcaaaccggcttaacgttacttgatgacagacaggcaaaaaaaaacccgcttcggcggkttttttaagaattcggytaaagtcagatagcgataacgttagcagccgacgggcctttggcaccattggtgatttcgaactctacgcgctggccttcagcgagggtcttgaagccctggctggaaatagcagagaaatgaacgaaaacatctttgctgccatcttcaggggtaatgaa

SEQ ID NO: 1256 - DNA, 1302 bp, Homo sapiens
ggcaagatggctgccctgacagcggagcattttgcagcactccagagcctgctcaaggcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagatctctctgccacgcctggtcgatctggactggagagtggatatcaaaacctcctcagacagcatcagccgcatggccgtccccacctgcctgctccagatgaagatccaagaagatcccagcctatgcggagacaaaccctccatctcagctgtcaccgtggagctgagcaaagaaacactggacaccatgttagatggcctgggccgcatccgagaccaactctctgccgtggccagtaaatgatccagccagctgccagggccactgccatgacccagctgctcatgagtgataaatgtctccccatatgcaggctgcccttgcagctgcagctgacaacaggcaggatggtggggacagcagggggctactgccatccagaagttacagttggattgggaagaagcagccagatcccccgctgttctcactcatcttctttctctttctgaagctggagagcagaagcccccatctttgaaaagctcctgagtgcaacttaattaccaccatggcagggtgagggaacatttgcatcgtcagctgcctctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaacttcaaaaaaagtcgacgcggccgcaagttt

SEQ ID NO: 1257 - DNA, 538 bp, Homo sapiens
  misc_feature (502)..(502): n equals a,t,g, or c
ggcacgagctccaccaccagcagcgggtaaccccaggccttgccgaacgtcacggcaaagggcttgagggccaggcgcttggcagcgctgggctccacttggatcatgcctttgacgtaggcacgcaaggcagccttgtttttcttcatccagatagacgcgcgcttgcgctcttcgtgggcgtgttcgtgattgttctcatccacggctttttcgtgcagcagcaagaagggctgctcacgggccagcagacgttcgaaggtcaggaaggcgtcttccggcgcaccttcgctaggcgcgtcgaaaaagattttcaccaccgggaaagttgaactgtcgagtcgcatggcaaagctcctttgatgagattgattctcatcatagggcgcctggcgctggacagcattgcacagaatagccagaatgtttcgcaatccagccaaggcagttatcaccatggttcatcaccgcctcgaccagtacgacccctgccgggtccgcnacgccgccgcgatccctcgctcgattgttgcagtgg

SEQ ID NO: 1258 - DNA, 979 bp, Homo sapiens
caagctcggaaattaaccctcactaaagggaacaaaagctggagctcgcgcgcctgcaggtcgacactagtggatccaaagaattcggcacgagaaaaaatcctacatggatattggtaggaaagagagaaaggaagtggccagtgtcccgtggcctcttccaccttctggattgttgaagctggggcctggaggggatggtcctgccactcagcagggggcactaatgggaccaagctaacctgtccagtgagaatcctgcagggagacctgagggtaccaggaaagtgcaggggaaggcccgggaaatggagagagctggtctggaggggaggagcaagccgcgtggggcaggccatgtgccttttgcctgggggagtattactcatttggagctgtgcgtctggaacgcctgcctcacacacaaaggactggggcagatgtaagttctctgcagcaacgaagcgcagcagctgagagtaacttagaaagcacccagctaatgctggcatcccagatcgaccccctcctcgctgaatgttggcatctctgtgcctcagtttcctcatctgtaaatgggggtgataagaaatgtgtacacacctcccgggcagtggggaggattaaactgtgctctgacacgatccgggcatgttcagggtggtatctgcagtaaaccgcgctcggaaaatggcggcgcatcagggccagcggtgggagctctccgtgcttggcttgacgccattgtggaggtggaggaggggctgcaagactctgagcaggaagaccccgcaaagcaggaaagcagagccagagttgggggccagccgcagaaacgagagcccccgtgactttgaggcaccctttggagagggcaggaagcaggaagggtaaattttctccaaaacccaagaggcagagtgaccccacatgataactgagtttctcgagagtacttctagagcggccgcgggcccat

SEQ ID NO: 1259 - DNA, 734 bp, Homo sapiens
  misc_feature (678)..(678): n equals a,t,g, or c
  misc_feature (681)..(681): n equals a,t,g, or c
  misc_feature (694)..(694): n equals a,t,g, or c
  misc_feature (709)..(709): n equals a,t,g, or c
  misc_feature (732)..(732): n equals a,t,g, or c
ggcacagcatgcccttgactggcacaaaccgtgacagacatgcccttgactggcacaaaccatgacagacaaggccacctcctcagaagcggaacaacctattatcttttggcaatgggagctaacttcactgttttcttacaatacctggtttttcctatctttggtttccttttgattatctctcatccatctcagccactattctcctcccctcccttgtgtctacaacaccccattttaccaagtctcccatttaacctccccatccttttctttcccttaaagtctcatatgatactgcagtcctcatttgtcttcccaaaaaaaaaaaagaatttttttttttttaaggaatccttccttgactcctaaagactcctaaggatgctgaggcctcctcagcatgatttccatatacttactttctctgttggactgcagacaacttgaaagcaggaactttggcagtgtttccccagcaccagcatcatgcctggtccatagtagctaccaataaaaaagtaagcatcatgaacccaaaaaaaaaaaaaaaaaactcgagagtacttctagagcggccgcgggccatcgatttccacccgggtggggtaccaggtaagtgtacccaattcgccctatagtgagtcgtattacaattcatgggcgtcggtttanaangtcgtgactgggnaaacctgggggttanccaacttaaacgccttggagganat

SEQ ID NO: 1260 - DNA, 1977 bp, Homo sapiens
  misc_feature (664)..(664): n equals a,t,g, or c
  misc_feature (716)..(716): n equals a,t,g, or c
  misc_feature (1319)..(1319): n equals a,t,g, or c
gcaaaaacccaaaaggggacagcagtagtgggagaggccagcatctgtacaccccatcagggtccccgctgtgtgtgcccctcaggcggccaccagccctaccaggtcctcccctcccggcaggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcaggtatctgcctgtggcacctccatttgatcttgggggaggcattaactctagggttccgcagctgggagggtctcggcctctctgggaggggcagggagcagctcactcctccagggcatttttaggaaagggttttcagctagtgtttttccgtgcttgaatggcaccagccctgcctggggtagctagaagctgagtggacctgcagcacacccgagcagatgggctttgcctctgccccttttgtcccctaggctgtctgctgtggcccaccctgccaaggcccgagtgtgggggactttngaggtggctcccggcccggcttccaagtcctcccctccatagtgtggaagcntcccccgggaggtccctgccctacctgcccgcgtcccctcccagagtcctggaaagcccctccctttccatggaactgacgcttcacccgtcctcttctcagctctctggaccttcctgtggtttgttggtttctgcttcctcaccaaccagtgggcagtcaccaacccgaagacgtgctggtgggggccgactctgtgagggcagccatcaccttcagcttcttttccatcttctcctggcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggnttcagtcagcygctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaaggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcaaaaaaaaaaaaaaaaaaaaaaaaaaaaaaaaaaaaaaaaaaagggcggccgctcgcgatctagaac

SEQ ID NO: 1261 - DNA, 410 bp, Homo sapiens
ggcacgagaaaaatttctagcctcactagtatcagagaaatgcaaattgaaacaaggtgccatttttggactctagttagtgatggtagtgaaaaccagaatggtcctttctaaaacagcctgtgtgtcaaaaccataaaaatgcttctacctctttttaccctgttaattctacttctgagagtttttcctaaagaaataattcaaaataggaaaaagctaaaagcagaaaaatgttgaacatgacattatttatagctgtggaaagattggaggctgggcacagtggcttatgcttgtaatctcagcactttgtgaggccaagttgggaggattgcttgaacccaagagcttgagaccagcctgggaaacgtagtgagaccccatctcttaaaaaaaaaaaaaaaaaa

SEQ ID NO: 1262 - DNA, 1078 bp, Homo sapiens
ggagctcgcgcgcctgcaggtcgacactagtggatccaaagaattckgcacgagcacacctgkgcaggtggaagtggatgtggacgagcagcgcctggcggaaggtggtggggtctgctccttccacctgcaggcagccctgggggaaatgctgccctccccaccccccagggctctgagtgtggagggcaggggcaggaatggcgtccctcaggagccagcatggccctggagcccccgagtccctgaggaaagtgttgatgccctccagcatggggctccttctcatcctgtacgcccggctgccacccagcctggtgggccaggcaggcaggtggatagggtgggcaggccgggcaggggggcaggcggtcaggcagccctctcccacagtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctscctgcggcggaggttttatagcaaaaaaaaaaaaaaaaaaaacaaaaaaaaaaaa

SEQ ID NO: 1263 - DNA, 465 bp, Homo sapiens
actagtggatccaaagaattcggcacgagcccagggaagttaagcaacttgcccactcactcagtctaattggtgccggggcagggacagaactcactcaattccactgctttccccagtttctggtgagtgatgtgtgcctggcactgtgtgcacctggcactgtgtgtagtaggaatgctgtttcttctgtctgtaacctcctcccagttctgtaaacaaagacaaaaccatgccctgcccttaaagcctatagggttcaaatgccacctctttgatgatgctttccctataacaccatttgatacctctcatgggacttagcaagtaattgcaacgagaggcatatatgttagttcaatatagcaaacctttgttgagggcccactgtgtgccaggtatgtctcccctccctgaggactggaagcaaaaaaagagaagagaaaaaaaaaaaaaaaaaaaaaa

SEQ ID NO: 1264 - DNA, 1348 bp, Homo sapiens
  misc_feature (45)..(45): n equals a,t,g, or c
acgaagacaccagaccctgtggagcctgtggtgaccaccgaaggncagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagcctgtctgcagagattgtttcctgacacagccagtggcccctgagagcacagagaagacacccactgcagacccccagcccagcctgctctgcggccccctgcggctgtyagagagcggtgagacctggagcgaggtgtgggccgccatccccatgtcagatccccaggtgctgcacctgcaggkaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagtgctccgtgagctgagtctcccactgccctgcacaccaccacattggacctgtgctgtcctgggaggtggtgttggaggccccatgaagagcgccctggacttgcttgagggtgggccaacagcccagagytcaggacatttggctttggggggaaggaaaytgaggcccagagaggggcaaccaytggccaagggtcacccagcaagttttggytaagagcctggcctccagccccagcagtktggcccagagcaggggccgaytgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggscaccaaaaaaaaaaaaaaaaaaaaaac

SEQ ID NO: 1265 - DNA, 847 bp, Homo sapiens
  misc_feature (337)..(337): n equals a,t,g, or c
  misc_feature (407)..(407): n equals a,t,g, or c
  misc_feature (415)..(415): n equals a,t,g, or c
ggcacgagtgaaaccataaagaaaaccaagggggtgataaatataaaatccaacgtggttattacctggttacgggcaggactatgatagggaagtcactggttatgttctgtttcctaagctggggggcaggggtacatgggtgtgcactttattataatgcttccaaccgtataggtatattttatatattctgttttacatatttgagattgcatgaatgtgtaatgctcagtaacttaagagtaaatgaactgtgaagaattagagatggagttttgagggattttttgttttggtttgatttttggagaccagatcctggctttgccgtcangctgggaatgcagtgatgttatccatggcctcacttcagcctttaccctcctggggctcaggtgatcctnccaacttncgggcttcgattagctggggactccaggtgcacaccaccacacccagttgacttttaaatttttcgtggagatgagttctccctgtgtattgccccacgctggtctcaaattcctggcttatggaatcctccctgagccaggtgcctggccagtttttgggttgttttgtttttcttttttgagatggcaatttcgctttattgcctcaggctggagtgcagtggcgcgatctcggctcactgcaacctccatctcccaggtacaagcgattctcctgcctcagctactggggaagctgaggcaggagaatcacttgaacccaggaggcggaggttgcagtgagccaagatcacgccactggactccagtcctgagcaacagagccaagactccgtctcaaaaaagaaaaagaaaaaaaaaaaaaaaaaaaa

SEQ ID NO: 1266 - DNA, 863 bp, Homo sapiens
  misc_feature (1)..(1): n equals a,t,g, or c
  misc_feature (795)..(795): n equals a,t,g, or c
  misc_feature (849)..(849): n equals a,t,g, or c
nggggggggttgcggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcacacccattgccccgggaaccgtttctgctgtactatctggatactaaaatggtacggaagtanctctttggtcttccttacttcttggccttaagttaatagaaaattcagacttcnccaagtaaggcttc

SEQ ID NO: 1267 - DNA, 826 bp, Homo sapiens
ggcacagctggatttagtgacttgcttttagtgaatgtaatgtgtcagacaagacggagtattactttcaagaataagttacaaaaggagtcacgcatttatcctatgcatctcctgttgctttcttgcttgctggctggcaaagcaagctgtcatgttgtgagaagccctgtggataatcccttgtggcaaggaggtaatgcctatggccaacagccagtaaggactgggccttgccaacaaccacataagtgagcttgaaagtgaattgtccccattcaagccttgagatgactgcagcccgggccagcaacttgattgcagcgttttgagagaccctacaccagacacacctggctaatttctacttagactttttactccacaaaaactaagagataataaatctgttactttaaactgctgagtattgtttactttgccgtacgtaagcagtatagacagacttttacataaatcctgattccaatgcttatccattgtgcattatgattaagttatagcacaatctcagtttcctcatctctataaaaagtgaaaggaggcagaggccagcagatcacttgaggtcaggggtgcaagaccagcctggccaacatggtgaaaccccgtctctactaaaaatacaaaaattagccaggcgtggtggctcatgcccgtaatcccagctacttgggaggctgaggcaggggaattgcttgaatccaggaggcggaggttgcagtgagctgagatcatkccactgtacttcagcctggccgacagagtgagactccatctcaaaaaaaaaaaaaaaaaactcgag

SEQ ID NO: 1268 - DNA, 380 bp, Homo sapiens
  misc_feature (6)..(7): n equals a,t,g, or c
  misc_feature (11)..(11): n equals a,t,g, or c
  misc_feature (376)..(376): n equals a,t,g, or c
ggttcnnaccntagtggttccaaagaattcggcacgaggtgtatgtgcatactccactcacattgtcttttatttttaaatttaaaccaggtagtctgctttcatgggaatttttctctctcctgtttttgccaaacccaaataagttatattaacatattttctgggaaaaatgggtgtgattcaaagttagaacatttgttattttacttcagaaagtctttattgaacatctttcttgtgtaggaccctgtgtagaaaatgcaaagagaaatcatacttgtcctacaggaaattataatcttgtcgggaagataagatgcagactgatataattcaaggtaaaaaaaaaaaaaaaaaactcgagagttcttcnagag

SEQ ID NO: 1269 - DNA, 714 bp, Homo sapiens
  misc_feature (704)..(704): n equals a,t,g, or c
  misc_feature (709)..(709): n equals a,t,g, or c
  misc_feature (714)..(714): n equals a,t,g, or c
attcggcacgagaccaaagagaggcttgggacagaccctaccctctcagtcttcacaggacaacaaccctgcccgcaccttgatcttggacttctagcttccagagctgtgagaaaataaatgtctattgtttaagccatccagtttgtggtactttattacaacaaccctagcaaactagtacaaagggcatgcaattcattctcactggaataacactgtctgggtatttgtttaccttttctgcctgtgcagtgctatcagccagcatcactgtctggggtcttatggagtgcctgattcacaggcatggatcccacacaacagagcatctgaccaggacacttacttcacagcaaagctccagaggtcacctgtccctatcacacagcaccacccaaagtaatcaacctgaaagaacattagcactgcttactggaggaacagctgacttatcggtttggaggcaacactctccaaagatgggtgccatcttccaagatgctgtatttgcacttgactcacaggcctatttatggggcattgtttctaatagggagaatatatgggtcctggaacaatggcccccacccaaggggttccattcttgccaggaaacaccgcaagagtcccattgaggctgggcgtggtggtacacacctgtaatcccagctactcgagagtaccttctaggagcgggcggngggcncatcn

SEQ ID NO: 1270 - DNA, 1594 bp, Homo sapiens
ggcacgagcaaggacagcacaatgccatggcaaccgcttccatcaataacttaatttcatctctgctcttacatctttctctcctcagttctaaagctggaaaatttttaatttggaaagaacataagacggcttgtggttgctatgccaacagcacctgcctgcttcctaatgggctttccaatcataaaggaaagtcttagcaagtcacagaactttagactccaggggctctggagggcactccgcacagcacggcctctcacttggccgaggagaccactggcacccaggaggttaagttccctgtctgtccacagcaattctactagcccgcgctgaagttacaccaaggcaagcagcttaattttggccaacccgaaggatttaggcaggatttgggtggaaggcaggctgggcgacccttgaggagagttgctgtaagtatctttctacccccaaaatccagtatattagtcagcttgggctgctgtaacaaagtaccacagactgggcggcttgaacccaggaaggtggaggttgcagtgagccgaggttgcgccactgcactccagcctgggtgacagagcgagactccgtctcaaaaaaaaaaagaacgtgctgtcatcaaaataggcaccacctgagatcagagaacacagagtttcccctggcaaaaggagctccaaagggaagacagacacacccagccacccaggctggccatatctgggcactggaggaagtgtcccggcagcaagggctctggtgactgctctgtgaggattcctcgtggctgagacgttggcccggccccaccttggcacaatctagttggagcatccactagatgctcccatgagctgtgcagcccaaggttgaggtcagagatagcaaggccacctgggtgacagcatggtctgctgcatgccacgcccctcccctctttgtctttgctttgtgctttcttttcctaggaggtggcaggtgtacatttctggctctgagcccatgtcagacccccaaaggagcccccactgtcctgatcccctgcacggcaccccaccacaagcagcaggcacacgtggtgggaatcaggtaacgcagttcccccgggaagccccttccatggaagaccactcctgctgctgcagcctgctggtcctgtgccctttcaggatcagcccttcgaccccagccaagggccctggccaggcctccactgccggccccaaggcttaatgcacagcatgtgcctgccagatctgactccagaggatggaggaaaggcccaagaccacacagccctgggccacagcagagagcaggacactcctggtgtgcaggagaatttccaaggtgcagcacctcttgacagatacaccaggaggtttaatactttgtattaccttggtaaccagagaagaggaatcattaaaactcgaaaatagtgctgtgtgctgtgcagtggctcacacctgtaatccctgtgctttgacaggccaaggtaagaggatctcttgaaactaggtgttcagagccagcctggacaacacaggttgtatttacctctacaaaaaaaaaaaaaaaaaaa

SEQ ID NO: 1271 - DNA, 618 bp, Homo sapiens
  misc_feature (24)..(24): n equals a,t,g, or c
  misc_feature (39)..(39): n equals a,t,g, or c
  misc_feature (548)..(548): n equals a,t,g, or c
  misc_feature (560)..(560): n equals a,t,g, or c
  misc_feature (562)..(562): n equals a,t,g, or c
  misc_feature (584)..(584): n equals a,t,g, or c
tatgaccttgataaccccaagttngaaattaaccttcantaaagggaacaaaagctggagttcgcgcgcttgcagttcgacactagtggatcccaaagaattcggcacgagtcataatgagctactaggtaagccttctgggactttcagatattttggggaagattgatttttgttcttacatgctgtggacccttggccatcaaatggtatggggaagctcatccgtctgtctgtgatggtcatgtcagtcaggcgtctttttagtatttactgggtgctcagtactgtgccagatgctgtcgggagccgtggtggtatggaggaggagtgctccagaggactctgctgtgtggcaggccagcataaacaagccaaggggaaaaggcaggcatggaataaagggggagaataccagtgtgtgacttactgctgactgtgtggattagcctatcagcagtaatcaagcagggcggagggcattatctttgagccagaagagtgagcactggsccgagggtggagcatcaagagggggtgtaggaccncaaggcttcttncnggggagacaacgtcaataagcngtcagtagtcaccgacagttttgggaagcaaggg

SEQ ID NO: 1272 - DNA, 557 bp, Homo sapiens
  misc_feature (136)..(136): n equals a,t,g, or c
gcttttttcgggggaatgtttacagaggctgtgggtcagaatgaagcaacaccagaagctatggagactggggtttctgctgtgtttcaacttggttttttgtgttctcgggagaagacacccttggccgtgggcngtgagacctttgatgtgtgtttacgctgaccgcgagttgttgggatggcttctgcggtgggtggttctcttggtattctcggttttgaagcttatttttagactctgaactctccttcttggcaggagttgaatccccctgggggttttcaagttgttcttggactgctggtttttgaaatagaagcccctttggtggggtcccccataaacccaggcgctggtgcccaccttgtgatgtgaaggctcctgtaacacgacctcactttcctggccccgcactactcacctgccccacgggacacaggtacatggcttctgggtgtctgtccccgctgtacccagatctgcccccttgcccttgtccccagatcctccactcgctcctaggaaccgtacccctcccaaaacaaaaaaaaaaa

SEQ ID NO: 1273 - DNA, 568 bp, Homo sapiens
gtggatccaaagaattcgcacgagtgccgatcagctcggaccgaaaaaagtggtttwattcgggctggcttgttgcggtgtgagcggtctgttttatgccatggctttttggttcactggtctgccgttgctgagtttaattctgctgtgcattggcagggtgtttctcggcgtcggcgaaagctttgccagtacggggtctaccctatgggggattggcctggtggggccgttgcataccgcccgggttatctcatggaatggggtggcgacttacggtgcgatggctgccggggcaccgctcggtgtttacctcaatcagcactgggggttggctggggtggcggcgttgatcgtgttggcggtggcggtttcgctgtggctggcgagtgcgaacccaacgtgacgatcgccgccggtaagcgtattgcctttagcgcatgttggggcgtatttggacttacggtctgggacttgcaatgggtaccgtgggttttggcggcacgagagtacttctagagcggccgcgggcccatcgattttccacccgggtggggtaccaggtaat

SEQ ID NO: 1274 - DNA, 2019 bp, Homo sapiens
ttcaccatgttggccaggatggtctcaacctcctgacctcgtgatcctccctcctaggcctcccaaagtgctgggattacaggtgtgagccaccgcatctggctaccttacattttaaaataacccttatcactactgaaaatgatgtctttatatgtctatctccttatgttctgtttccttactctcctcccaggaacataaacttcatgagggcaaggactttgcctccttcacttttgtgtctctggtgcttagctccgtatttgaatatttgttggatgaatggataatgactattccaggactcgcttgatacagaactatcttctctagagaatggaaaggtaaacgtatcatttaccagccacttatcttaagtagagtcccagagtgtaggcttatgccatggagctcatgtgaatttccacttgggccatctgggattcttttctcaaaagagcctgatgccgggtgcacgggccggtcagctggcctggagggatataacccacatttacctttctcctcctggcagtattctagaatacctcactcactgcagcaagggagctttctctcctgggtcggtaggggatatggtttgaatgtagccctgaggagcgtctcaaatgacctttggcccagttgtcttgtgtcagtctcctggggagaaggatcatttactcaagtgaaaaacgaatcagtcaagcttgagagctgtagataacagcacagggagctgtgttttatggcctcaaagagtttaacccagattggaaaaaggtatttcactccagcagcaacagaggggagctgtaccttgcctctgactccagagaaacgggacatgtcacaggggtgaccaacagggcaccagccacagcagggagggtggaaacttgggcagcaagagtcacagttaatgcctggtgaggagtgaccattggagtgacgtggagctgcacggtaagcactggggacgtgccaaagaaggaggctgggtcagtcaggttttactgcaatgattctacttgaaaaacacactgaatttcagcgacttacaacatcaacaccacatttatgtatctcacctataggtgttcaggtcagctgtggtggttctgcttcaggctgtggatccagatcacgtctgccccacatggctctcacgctgggaccagcagcttctcttggcagctagcagaggtttgagaaggcagcccaaaccatgcaaactcattgaaaacctctgctcgggtgacatcctttaatatttcattggcaagacccagcgcagtggctcacacctgtaatcccagcactttggtgggccgaggagggcggatcacctgaggtcaggagttcaagaccagcctagacaacatggcgaaaactcatctgtactaaaaaatacaaaaattagctgggcttggtggtgggcgcctgtaatctcagctacttgggatgctgaggcaggagaattgcttgaacccaggagtcagaggttgcagtgagcccagatcattccactgtactctagcctgggtgacaaagtgagactttgccaaaaaaaaaaaaaaaaaaaaaattccattggcaaacaaatcacatagtcaagactagcatcagtgggttatgaaaatgtgctctgtggactctagtgggggaccctgcaaagtctggggcaaaggctgtggatgctgaattctgttacagggagggagtgaaaaattgagagtagtaatccagtctcccacggggcccatcacggctgtttggaggcacacatgagttaccatggcgacatcttgaatgagaagggagaaactcaatggtaagggcaagaagcagaagattgttcctttgttcctattactttgatacatattccttgatttgcaccttccaggctaaaattttgagcctccttgatttttaccttcaggctaaatttgagcctttggaagctcaaattacaggaccatgaacatctctccctggcaggaagcaacaagg

SEQ ID NO: 1275 - DNA, 654 bp, Homo sapiens
ggcacgagccgagggcgaatccatacatccgtcgtgtggactcgccctgacatcccctcaacgcttagactcggcattcttttcattgcctgatgccgtttcatgccttctttgcgtttcctcgctctggccctcctgctggccatccttcccgcacttcccaacgcccatgccgcgccggggattggcggcctgatcggcggcggctcccaggcctcagccaaggaagagccccagagcaacgcgcaacccagcgccgatgagcgcaaacaacgactgctcagccaggccgaggaaacccggcagcgcctgaccgatctcaaggccgaactcgccggcgcacccaaggagatcagcgaggcccagcgtacgctctccaaactggtgagcgaggacaacagcgatctgcccgagcgcctctccaagctttcggtgccggtactggagcaacgcctggcggcccgcgtggacgagctcgccctctggcaacaagcgctcagcgcggccaacagcatgctcatcagcgcgcagacccggcccgagcgcgcccaggccgatatcagcaagaaccagttgcgcatcgacgagatcaacggcctgctgaaaagcggtcgggagaacaacaagccgctgacggacgaacgtcgcgcgctg

SEQ ID NO: 1276 - DNA, 552 bp, Homo sapiens
  misc_feature (186)..(186): n equals a,t,g, or c
ggcacgagcttgttcttatgggctttatatgtcatctatatgttgatgaaaataaatttctatcccttgcccaagcctaaacttcatactagcatatccaactgcctactggacatctccatttataagcctagtagcctaataagcataacctcagacttaccaggcctcacactgaagtcatgnaacttcagcccaacccccatgccagggcaaaaccttgttgttacctcttattcctctcttgcctcatcccatccatgttcagtctgtcagtggatcctgtgagtccagtcttgaggatagttccaggatctgatcacttctcactgcctcttttgctgccaccacctctggcctggataattgcagcagcctcccagttagccttgctgtgtccatccttgttttccccttctgtctgctctcaacagaggagctagtgattctcttaggacagaataaatcatttaggttttcttcacatggtcctgaagaagcttcctacctcactcagtgtaaaaaccaaaaaaaaaaaaaaaaaaaactcga

SEQ ID NO: 1277 - DNA, 1487 bp, Homo sapiens
ggcacgagactgacttggcgcagcacccggcgggcggactgcttgccgatgcgtaccagaccgatggcatggccagcgtgcagggcgatcccggcgatgcggcgcaatatcccgaaggggagtttgcggatgaagacttggtctcgctgcctctgctgggccgcgcaaccactgccgtccaccagcgccgcctgctgatgctgctgggtgttggcttggtggtgctcgccttgattgccggctgggttctgcagcaagccaaccgctcggcgcagcagctgacggcgaccggccagtcgctgatgcagtcgcagcggcttgcaaagtccgtgtcgcaggccttggtgggcagcccccaggccttccccgacgtggtggagagctcgggcgtgctggcgcgcaacgtgcgcgcactcaacggcggcgacaacgaactggatgtgcaggcactgggcgagcctttccgcccgaactggatgccatcacgccgctggtggagcgtgccgagcgcaacgcgggcgtggtgatggggcagcaaaagatcctgacgcaggtgggcgacgctctgcggaccatcaaccgccagtcctcggacctgctggagatcgcggagacggtctcgtccctgaaacttcagcaaaatgcgcccgcctccgagatttctgccgcaggccagctcgtgatgttgacccagcgtatcggcaagtcggctaacgaattccaaacgacggagggcgtgagccccgaggcggtgttcctgctgggcaaggacttgaactccttcaaggaaatcgcacggggcatgctggacggtagcgccgacctccgcctggctgccacccgcgatgcccaaacccgcgagcaactggagtcgctcacggcgccatcctgggcaacctccagggtctggtgtccgcacgtgaggcgcaatcggccatcctggcagacagcgaaccgtgcgccgtcaactggaaggcctgcaaagcaagctgtcggcacaatcgggcatgggtgcgggccagttcgctgcgctcgccgtcgccggtatcttcgtcttgctgtgcggcgtgggtatttcgcgcgtgcagctgctggacagccgcagccgccaagccacggccgaagcacagcagcgtgatgccaagcgccaggaacaggaagccaagcgcatcaacgacgccaaccaggcggccattctgcgactgatgaacgaactgcaatcggtcgctgaaggggacctgacgcaggaagccaccgtgacggaggacatcacgggcgccatcgccgactcggtgaactacacggtggaagagtccgccagctggtgggcaacgtgcagaacaccgcggcccggatggcccagaccaccgcgcaggtggacagcacctctacggaactgctggcggcttcgaccgagcagctgcgtgaaatccgtgaaacgggccgttcggtgctcgagagtacttctagagcggccgcgggcccat

SEQ ID NO: 1278 - DNA, 898 bp, Homo sapiens
  misc_feature (469)..(469): n equals a,t,g, or c
  misc_feature (502)..(502): n equals a,t,g, or c
gaattcggcacgaggcctctgtcttttccactaaagctggtatttacttttcctgtattgagtggcttccactgcaagagtgactatgtagtgagtgctctattggtgacatccaaacttgggttyacggagacattttctattttcttgggcaggtcatccaaacactatctacctctctgcaatgtgtagcaatgaggggtgtcacagatgcacacaaactttgttacaaccattttcagttgcaataccctaaaggcactcccagggtgatgaagcccctccagcatcmtggarggagaatattctttcttggtttgtctgctccattcaaccctggactatgccaagctgccccactgcttagaggcttctggggctagtcaggtgggcatgtgggggatttcaaggtgcttgcccagtttagccctgccaggacctgctgcagctctgtcctgcccactgccgncacccccattcctcctaggcagcaacctgcagncaagtggctgtgcttccacattcacctccccagtgacccccacctcaggcttgtcagtttggtgtccaatttctagcaggacaggtggacaaaagacgtagtaccgttctgctgccagactgctacaaaacatcacattccattttctacaccaaactaccaggacagaaaagggagcaagagtcctcaaacctcccaagctgcttatttttccctctgtattgtaagatttttctccttaaaactgaggctgggctgagtgcagttgctcacgcctgtaatcccagctttgggaggctgaggtggatagatctcctgagtcaggagttcgagagcagcctagccaacatggcaaaaaccatctctactaaaaaaaaaaaaaaaaaaaaaactcga

SEQ ID NO: 1279 - DNA, 1182 bp, Homo sapiens
  misc_feature (1119)..(1119): n equals a,t,g, or c
  misc_feature (1128)..(1128): n equals a,t,g, or c
  misc_feature (1131)..(1131): n equals a,t,g, or c
  misc_feature (1147)..(1147): n equals a,t,g, or c
tcaaaacaagataaagttaaaaaaaaaaaaaaaacagtgacccttttgcataagccagaagagcagtgccttgcttcctgtgaaaaatgcttggcagttagcctgtgtaattatttagcaatcatgttaatagatgtttaagaataatggaactggagctgtactgagccaaggatggaaatgaagacatgtgagactattttttcttcatccaccgatactcttcagttacaaggatttaatttaaaagggttttaattaaatggaatccagaagctttggacgctccagtttttcttcttagagacaaaccctagctcagtttcctggagcttgactcagaatgcagcatggtactccggactgacagtgtgccagctttattcacttatctctctaccttttggcttgcatttatttcagggctggctgacattttgaccttatgtacaaagatggccgatacgattatttttcatcatatattacagaaaatactactcttgaaaaatactctgagaaatatgttctatggtcagataagtttgggaaacagtgaattattgttcctcctttgcagaatcacaatgcactgttagctaattaaagactctcagatgtcccactggaaagaatcatgtttagctttgtttaacctagcatttcccaaacttattagagcataaaactttgtttttgttttttttttaataagataggtagctatttccttagaacacagtttgggaaactttttgttcatttgttttaataagataccttaggtagctatttccttagaacacgagccgggtgcagtggctcacgcctgtaatcccagcactttgggaggcccaggcgggcggatcacctgaggtcaggagatcgagatcatccggcccaacatggtgaaaccccgtctctactaaaaagacaaaaattagccagccatggtggcaggcacctgtagtcctagctactgtggaggctgaggcaggagaatcacttgaacccgggatggggaggttgcagtgagctgagatggcgccactgtactccagcctgggcgacgagcaaaaactccttcaaaaaaaaaaaaaaaaaactcgagagtacttntagagcggncgngggcccatcgattttncacccgggtggggtaccaggtaagtggacccaatt

SEQ ID NO: 1280 - DNA, 598 bp, Homo sapiens
  misc_feature (515)..(515): n equals a,t,g, or c
  misc_feature (523)..(523): n equals a,t,g, or c
  misc_feature (558)..(558): n equals a,t,g, or c
ggcacgagggtcggcgggcagggcggggctgcatgcgatgacgtcgatgtgtccggccgcggcgctggcctggccgacctcggcgatttccttgatcgtcagcctggcgcccagctgggccgcggcgcgcgacaactgggccgcgtcgccatacaccacgcaggcgcgcccagccctgcgcgcagccttgacgacgatttcggggccgatgccggcggcatcgcccatggtgatgcccacgggcagggaggggttcacggtgctgggaatgggattgcgttgcggataatgctacacccgttcgcgggcgacggccgggcttactgcttgccgtttttcggcggttcgatgacgccgcattcgaaggtgaccgtggcgcgcttgggagcccaagccggtggcgttgtttggagtgatctccggcttgaagcagcttgcgttcccatggatttcgcaatgctgcttcgcgcgcttgcaacgcctgggttcttcagcttccaacccaagttcagcancttggctncccggaagcttttaagtttaacctggtaaagtgtncccttgttcgaaccttggcttgaaccttcggcttcaatgc

SEQ ID NO: 1281 - DNA, 1292 bp, Homo sapiens
  misc_feature (1143)..(1143): n equals a,t,g, or c
  misc_feature (1275)..(1275): n equals a,t,g, or c
tggagactccactctttggaagattctcttctgtaaacagaggccgttatgaatgaaaagttccttcccccactttgattgatcctggatgtgaatccatctgcccactgcagctcgtcaggagggaaggaacgaggctcccagagcagaggccctcgatgcttctgttgcgctgtgcccctagcctggggacccatttgtttcttaacatgctgaggccacccagatgggccctcatggctgcctcttctcacccccctccactttggtcctgggttctaggcctggctgcccacccgacaggcatgagccctgggacagggccccaccatggctgggtctctgcttcctcatcttcgagttgagatggtgaagcctcctttgcaggctactgtgagggtgagagggtggatgtaattgagcgaatgcatgttcagcccagtccaagtgctttagtaaacatttggttttaagattaagttagatagatagcctagctgttctttttgttttccccagtcaggaaagggacctaagggattccattcttctcaggagtgcaaagtttccttataaatcatttaggccagtcctctgatttttcagatggggaaactgaggcccagagagggttggtccttaaaaaaatataactgccaaccccatgcactgtggtgcccacttcatgccatccacagtgccaccacggtctgggagtgaggcaggtatggctgctaaccatccccacctcacttgggggaaacagaggttcactctgggggagaagcaggggagccagctctgtcttcccctcctcgggggccctgcttggagaaaaagctgagaaagagggtggggggtggggagttaggcaggctgtgtcctccaggcctgggagccttggctgggcagtgccggcctgggtggggtagtgattctcctgctcagcatctgcccctgtaggtggggagacttacattcttctcagtaacagtaacaggaaccatgatttaaatggacactctaggatgggcatggtggttcatgcccgtaatcccagcattttgggagactgaggtgggcggatcacttgaggtcaggagttccagaccagcctggccaacatggcaaaaaccccgtctntaccaaaagcataaaaaattagccaggcatggtgatgtgcgcctgtaatcccagctacttgggaggctgagacaggagaatcgtgccactgcactccagcctgggcaacacagtgagacgccgtcccccacnaaaaaaaaaaaaaaaaa

SEQ ID NO: 1282 - DNA, 1386 bp, Homo sapiens
gggcacgaaggttgatggaccgccacggctacaaggccgggatcctgctgggcctgtgcctgtatgcggcgggcgcgctgctgttcatgccggcggcggcagcggcgagctttccgtttttcctgttcgcgctgtttgtcatcgcctgcggcctgggctgcctggagaccgctgccaacccctatgccacggtgctgggggaaccccagggcgccgagcggcggttgaacctggcgcaatcattcaatggccttggccagttcttcggcccgctgattggcggcgcgatgttcttcagcgccggcagcacaccggcctcggacatgagttcgttgcagaccacctacgtggtgatcgcggttctggtactgctggtggcgctgctgatcgcccgcacgccgctgccggatttgcgcgcccaggaacaggcactgcaaccgacggccggcaaaggtctgtggcagcaccgggagtttgtcggtggggtgatcacgcagtttttctatgtggcggcccaggtcggagtcggcgcatttttcatcaactacgtcaccgagcattgggcacagatgggcaatcagcaagccgcctatctgctgtcgatcgcaatgctggccttcatgttcgggcgctttttcagtacctggctgatgggccgggtcagcgcgcagaagctgctgctgatttatgcgctgatcaatatcgcgttgtgcggcctggtggtgatcggcctggaaggtatctcagtgatcgcgctgatcgcagtgttcttcttcatgtcgatcatgttcccgacgctgttcgccatgggcgtgaagaacctcgggccgcacaccaagcgcggcagttcgttcatgatcatggcgatcgtcggcggcgccctgatgccctacttgatgggcaaggtggcggacaacagcacggtggcgctggcttacctgttgcctatggggtgtttcgtgattgtggcggtgtatgcccgtagtcgcttgcgccatccgtgaagtaccgccccggcgtcgtcccgaacgtacgccggaacatcgcaataaaggcactgacgttttcataacccaggtccagcgcaacccgggtcacgggtgcatgcgccgccagcaactccagggcgcgcaacaatcgcgcgcgctggcgccactggctgaaggtgaacccggtctcggcaacaaaccgccgggccagggtgcgcggcgagacaccggcccactgcgcccagtgttccagcaggcggttgtcgtcgggactgtcggccagcgcctgggcgatgcgcaacaggcgcgggtcccggggcagcggcaagccgaatggttcctggggcaacccggcgatttcatcaaggatcatctgggcgatccgtgactgtggcgg

SEQ ID NO: 1283 - DNA, 1004 bp, Homo sapiens
gcttcactggagttctaagttttctcccctctgttttgaatgagtcagctctgcttctcactactgctttcttccacatgccacggaggggttgccagcctcttgacctcagaccttagctctcagtcccatcgtttctccatctgcactaatgtgaatcactctaagtattctagtctctgatgtgttttgaaggcagaagcagtcagagggcactgctcaccaggctgggctgggcaggcagatcacacggaagccctgccctgtcacagttgttaatactgcagggagatggtggggagacactatggggaacttgaggagtcatggttcacaatgtacttctaaaccactgtgagtttttttgctcttgtctttggaatataatactttattgctgggggataatgagtatttactttaaaaaacagatgcatttctaagtccctctgttttgtcttgacttccagctccccaacatactcacattccactacttattctctattttaactttactgcttcttttacttttttttagttttacttttattttttatttttttgagacagartcttgctctgtcacacaggctggagtgcaatgacgcgattttggctcactgcaagctccgcctcccaggttcatgtcattctcctgcctcagcctcccaagtagctgggactacaggtgcccgccaccacgccctgctaattttttgtatttttagccgargcaggtggatcacctgargtcagcagtttgaaaccagcctggccaacatggcgaaaccccatctctactaaaaatacaaaattagcagggcgtggtggtgcactcctgtaatcctagctacttgggaggctgagacaggagaatcacttgaacccaggagccagaagtcgcagtgagccgtgatcatgccattgcaccccagcctgggcaaaaagagcgaaactccatctcaaaaaataaaaacaaaaaaaaaaaaaaaaaactcgag

SEQ ID NO: 1284 - DNA, 2658 bp, Homo sapiens
  misc_feature (1817)..(1817): n equals a,t,g, or c
  misc_feature (1832)..(1832): n equals a,t,g, or c
gagtaggcatagcggtttagataggaaattttaagaatgacaaattaaagaatcctggaaaatacactgtacattctgccaaggtttgtcaatatggatgctggtatagtaatgagaataaatcggtaaattcttttcataaaatgaaggaaagaaattactatgtgctctttaaaatgtgttgcatcagtgcctgatttgattgtaagggtcacatcttcaagacatgtgataccaccctttataccacattatagcattgtctaatgttgtaaagtttataaattgctttcactcagtcttcatctgattctcagaatgaccctatccaattgggaatatgggtttcattagtcttacattactaaggagattcagagagtctcaattggccaacatcatgcagttaaaaatgacaaatggggattttgaacccaagtcttcctgaccccagaacccgtgatctttgtactacatcatgcttcctgagaaattaaatggacctgtcttgcagaactgttcttcttctaactagggatctggaggagtctcaagtaaataggcagatggccttagggagggatgtctggaagcacctgtttggagtcccagcaggttggtggttttctgtctgtaggtctggcagctgggcatggtaacttagccatggaaaggggctgcaggaggaggtcctcagtgctcagacccagggcagaggactgtgtggctcctgtttgtttctccagatctactctctacacgccttcaccctgctctctgtttgggatggaatcaaaggacccctttgccccctggcttatggttgccttttgccaatggaagcagtgacagaggatcagattagaggtagaaggggagtgaggaaggagagtgaagagggataaattctccttctgcctctgatcctctgtcgctgcttccactgccacctactgcttccattggcaaaaggaaggatgccgtgaggttgccatgagcatgctgcagccttccagtctcctataagacagcttccccatggggtccttttcctattcctcctcttgccccttctgacctagccccaggtacagtactgtattacttaccttctcttataccttttccatacctttgtcgatggtctccttgttggactcctcacattacccagtttgagtgtgctttctatttcctgatgggctcctggctgatcagacctgaccccagaggacctgggtaccagaatctaatgcctggattaaggcacatgagcaagacgcagaccctgcaaatggaattgaaattacaatgacctagaacaagggagatagggccaagcatgccctagtgaacgagggacccaaatggggtaggactgggaagaaatctgacttgagactgatgggctaggactctgctagaagggcccttctggtcttccaggagacaagactattcacagacgctgcaaattggtggtgcaaggaaggcagcaggagctcaatagggtacagagtctaaggagagctggaggcatgaaccaagcagagtggctgggtgtttgaatccttgcttctagtggcagagactgaccggctattcatcgaacccatttttatttcctcctgggcacatggactatggtcctcgtgttcttgagttctagccaatggaatgtgggcagaagggatgtgctagcccttaaaccttccttactctctccctcctccttgcagctgtaaggaagagtctcagtaacatctattatttacttattcattctttcattcatttatttcattcactccctgaancaagagccaagggtncagcctctctaggaggtgactctcatgcccttttattatgctggcttgatactaatggagatgcggttgaccattgcaaaaacccctgttgagacacagcagagttggccagcattcttatggtacttcggatgtggatcctgtgatggctacagcataaaacactgcattagcctccatcttctatccttttcccttcaaaaatgatgatcatttcattgagtgcccaccctgcaccaggtgcttctgatactttatgaaatatgatgttttaaatatgaaaatgggggcttacataatgctgtgactaatttgagccttgctcagcagttaggcagcttcaatcttcttattaatatacagggagtggttgctgataataggcacattttcaagcccaaaggcatcttgacagtgcatgctgaggattgggggaaataggaaacctccaaggaatactcctgatatctttgcatctgtatacacatatgagttgtcttagtgtttttaccatagaagatccttaaaagttgacacaggcaggctctgggtatgtgcatcgagagatatttcccagagtctgtttttttgacatcctttcaccatcattttatctcttagcaggaatcagttgcccaacaactcctgtgatcatctgcaaacctctttacagttttcagtgtctcaaggtaatacataaagaaggaagaaacaaaagagtatgagtatcactattcatggatactaattaccaaatgtacttttttgaattaaatccttgtttgaatggaggttgcacagagatgaatgttttgttagcagactt

SEQ ID NO: 1285 - DNA, 1446 bp, Homo sapiens
ttttttttttttttttttaagatcaatattcattcttcatttgccctcgtaacgaaaatagatttttaaatgcctcaaatatacaaacatcattgatgcacacacattccagaaatgcagaggtatgctgctgccacggggtaggggtgcgggaggcggcctggcctcatggccgcagaccgtgccccagcccgggcctggcaggtagctggccactgataaatgccactgggatcctaggagaagctggggaccatgcgtgaggtactgaaggggaccatggtggatggcatcctgggcactttgtagcttgtctgagggaaaggcctctgctgccatagaaaagctggacacatgtcaccctggggccctgacatcctaaaatgccccactgactaccagtcactaggagaaaggtctccggctatgcccttcccagtgatgcttgccccagagtgactggtcacaggtgggggacaggtttgctccagaaaccgtaggcctttcttgtctggccccctaaagaggacccaagatcaggaaaactccccagtttaaaaaaatatctgtccatctgtatataaaatacctattattagctggagttgcacacatgcaggaccaggagagactgcctgaggttctgcctggaccgaaggaggcctcgctcacagcacctctgtgaggggactggtgctcctgggaagtcacttctcttggtgaccgagctgacaccccctccacttggaaagcacagggactgagcaggcgggacctgtgctggagggagaccctcctggtgaggaactatgcgggccttctgggcctcagcagctccagcccactcctggcctggcaggccacctgcccacccacccacccatctgcctctgggcccccagtgaagtcagaagaggcaggagccccgcaggctgtgagcctggcgcaggtcggctgacagcgagcttctcatctgcctggtggtagagcggacgctctcggcagcctgcacggcccggctcagggccttgttgagctcctctaggtcgcccaggtcgagctggatggagtgccggtgtctccgggctggtgggggagaggctgtgggcggccacttggcagctggttgggctgaggtaggtcctgcaggcgcatagtacacagcggcaggtggataaggcatgatgggaaccgaggagatgtaggcaaaggctggaggggctggtgctgggggcgctgttgccagataccacagtccggggggtgggcgtggcgacgaccccgcctgcttgctcctctgcttggggctgggagttgaaggtgcttttctcctcgtggtggccttctctgccccagaggtggctgagcctggaccatctgcctctgggggagacccaacttgaccacacaggggacactgaagggtatcagcgggaggcggtccca

SEQ ID NO: 1286 - DNA, 465 bp, Homo sapiens
  misc_feature (357)..(357): n equals a,t,g, or c
  misc_feature (395)..(395): n equals a,t,g, or c
  misc_feature (440)..(440): n equals a,t,g, or c
gaattcggcacgagctcacttgaaatccatgacactacatagaaaatggactctaaaatctgcctggcaatgattctacatttccctaatcccttcactttcctactctcccctactctcttagaatgttctgtatctccttatctttcttcaatctccctgaatattctccctgttccttgctttcagttcaggaattggtgccccaatttttttatgttgtttgattttttttttttttttgagacagagtctggctctgtcactggggctggagtgcagtggtgcaatcatggctcactgcaatctctgcctcccaggctcgagagtattctagagcggccgcgggcccatcgnttttccaaccgggtggggtaccaggtaagtgtaacccnattcggcctatagtgagtccgtaattaaaattcaactgggcggtnggtttaaaaacgtccgtggaactgg

SEQ ID NO: 1287 - DNA, 2987 bp, Homo sapiens
ggcacgagctggtggcatggacattcaaggtaaagctctctatattagatttcttctcaccctttgtcagatggtagtaagtgttatggggaaacgaaggcaggggaggagggggctgggtggagcagctgctgtggggagagagatctgcaggaggtggggatgctgtgtgacttgagagagtagcttgccctctctgggctcctgcctgtgtgtgctgggggaacgatggcgcccactgcccctggtgctgtctttgccacatcattccttggggacttctgcccaccagctgctcagaccgtagctgtgctggctatgctcttcctgtgcaggtattgactctgagtcctcatacagcctgttatgatgcgcattttacagatcagtagactgagacctgggcaggccctctgactacagactgagctcattactgcacacagcgtgctgccagtacatgctgggctctggggtgctggagccgcagtcctggccccatcaatacaatccaaagtgagctggctctgatgaggaagaggccaagatgccccactcagggaagtcttcctgggagaggtggtagccaggcagacctgggagtaggaggaggtagggctgggctttgtagacaccacacttggtgggacagaggcctgctagggagagggcctgtgtccttgccaccagcccatcttccacgccatgtccccctgcactctttgaagggagatggtctcttttggggctaagctggggtcctggagccagaagagaactgagatttgctgtggggggttgggagctgttccatttttagtggctgctacaggaagagcggccgagtgtttccccttgtccctgcagaaggctggagtgtaactgtccttgggaactgggtcagctgatagcagggctgggggtgggggtggggatcctgaatcctccagcagatgtcctcattgccctgatctgggtggccagtgcctgtgctggacacggtcctcagtcatcggagcccactgagtctccccctgaccctgcagagaatttcaaagaggcgaagttccttccagtggcctcacaaaggctatctggcttaggagccattacctgaagccagaatttctgagttccaagtcccagctccatcacggaacttggcccaaggcccttaacccctctgggcctcagttttgtcatctttgaaatggggatcttagagatgcctacctgtcaagggacttgtgaggcgcaacgggaccacacgcagggcctggccagagtgccgtagtttcttcggttgccatgatgggacggtgaaactcctcacactcttctttctgccttgaagattctagacctggctgggtgttcatctccctttttgcctttgcttgaggcagtttatggcatggctgtgttattcacgtcgccaggtctcctcctggtggacgttgaggccattttcatttttttactcttaaaaacgacagggcagtgcacatcttcgcatctccggggtgggtcaggtctctgacctctttgccagtgtgacttattacccctttctttctttgtttttctttttgagacagtgtcttgctctgtcgccaggctggaatgcagtggtgtgatcatagatcatagctcactgcaacctccagctcctggctcaaatgatcctcccacttcagccgatattaatccattttcatgctgctgataaagacgtatttgagaccgggcaatttacaaaagaaagaggtttaatggagttacagttccacacagctgggctggggaagccccacaatcatggcagaaggcaaggaggagcaagtcacatcttatacggatggcagctggcaaagagagtgagagagcttctgcagggaaactcctgtttttaaaaccatcagatctcgtgagacttattctctatcacgagaatagcacgggaaagacccacccccatgattcattgatctcccactgggtccctgctacaacacaagggaattatgggagctacaagatgagatttgggtggggacacagagccagaccatatcagcctcccaagtagctggaactacaggtgtgcgccaacatgcctggctaattttttaaatttctgtagagacggggtctcactgtgtcacccaggccggtcttgaactcctgggctcaagtgatccaccctcctcggcgtcccacagtgctggataataggcgtgagccactgtgcccagccatttcccccttatttttagcatcactacagtagctgtgatctctgagctttggggatatcccctccccaacattttactctgaaaattcgaacatctggaaacgtcaaggctttgtacagtggacacctgtgtactcggcagccaccttccgtgatgaacatgccttatatttgctttgtcctcaatctgtgattcgggactggatttctcttgtttcctggtgggacccacactgcttgtcaattacttattttgttccccttcatcccagtcttgctgtgactttcagatacccccgggtcttatatacactcagggttatacccagaaaacatttctcctgggggatttgtctctaggtagggggccctcttgaatagtcagggggagaaagaaagactcaagaccagctctgaggaggcggcaggggtgccccttccctctacctgtgggctccttggggaagaaggacaagtgagtgccatgagaaatacccctggggattttgtggagctggaatgtgctggtggaccatgaatccacaaggacttgggcatcgaactcccttgactgggacccacagcaagggaggctctgcagcatcaccttaatcaaatggactcaccctctctgggtgatgtatcctggtgcttcctcttctgttcatcagtcaatcaacaaataaatggctgggcgtggaggcatatgcctgtaatcccagaaactttg

SEQ ID NO: 1288 - DNA, 674 bp, Homo sapiens
tgcccctgaagagtaagaatgaatatgacatgttgattcttgaagtggccaaataaatcacccgacggtgaagttctgcaatggatgaaggtggcagtgagaggaaagcagagagaatgcagagacaggatcctaggcaagaagacaaaggcctggacacagagaaggagatcaaagtgtggctctgggtacaaagtgagagtgagtgtgcaggaagtgaacaaggtcagtagaactaggaaaagcmaaaggtcaaggaaaccagcatttggagacagrtaatgatgtcacctttggaccaagggagattgaagcttctgtaaggcraaagtaaatgttcctggttagtaatccaggttcttggtaattggtattaagtttgtcatgtgctgtggctcatgccaagtccatccatataaagacaaccatgttmgaataagaaagacaaagaactctcagagtctgttcctgagatagagcaggtcctgagaggcttatcaaaagttcagaaactaaggcaaaattttggccatgatattcacaaaattgaagagaaacagcatttaataatacagccaagcataaaaaaaaccaagacaacctaaaaccccaatgccatttgtattgaaggtgagtggggagctcaccggtggtctcaagaacttggcagatgc

SEQ ID NO: 1289 - DNA, 2439 bp, Homo sapiens
ggcacgagggagttttgacagcagagagcagatgctagtggtttcctagagaggggttttgagggaagtgttgctgggagtcatgaacagacctgtctggcggcttttctcaaggacacctcagcaaagaactagcatttcagcctctctggggagactggattgcagtttccattccacagaatcagtgtggttcagctgggctcggtgggaggggctggtggtgggaatctgccaggcagtgccagtcccatcccatgacctcccaatagatgcgccacatgaggcaggtggcaccagcacgacgcgcgcagctcgaacactctgggcttcatgcctcgctctgcctcctctctctgctgtccttgctacctacacttgaggccaacatgtcagggtttcaccaggcccctctgaccctgctcccctcctgcacccagggagatggggaagccaggggccaccacacgcagccaagtttctggagaacagagatgaagtgtcccgtggaggctttgctggagcatctggccacaagggcagtggtgggcaggaacggagaccatggagcccagcaagagcacaggacagcttcagagggccaacagcagcctctggctgagtcctctccttggtggcagccaccccatgggtgaccaccagttccttcccgggtgctgggagttcccaccctgccctgtgggccttctctgggtcccatgatgcactcccccaacccgctgggcaggcttcagtatgaggaggctctggtactcagtaaacgtctgtgagctaacacacctccagctgagaaaggagtccataggaagtagccctcatgggtcagaaaggacttaggggactcaggaagatggaagaaaacccctccgaggttgcggcacaccagaccgctatggttttctgcctcctggactcttactggcctgtattttatcacaggcgagatcacattgcacattcagttttgaatctagctattttcacccaacctaatctcataagcattttcctgtgtgctctaaatgctcataagcttcattttaaatgtctccattatgtccactccctcacttggacctaggccaaaggcacctctgtttgaagcatccaatgaaggcccttcagagcccaggccaggtcttgcccaaggtgggggagcggcggcacacaggggccagctctccaggctgcagatgcctgcctggtggctcctgctctcccgcactcactggtgaccaggacaacatctcttgcacctcagctttctcatctacaaagcagagccaggattagagttgaagctgaaagaagggggaccctgttgccaggctgctccagctcccctcagcagcatcagagccctgagccctgaaccaccagccaaaacttgtcacccaagggctttgctgctggggtgatgggacatccagggggtcctgagacaagggggtcctttgggttcttgcatgcctgacacccaacatcaggagtgggcgtggctggtggggcatcactgggtgccctgaagctgggctcttggttctggcccctggtgtggcccccagggcaggggaacggctgagctgttgggatggagcagaaaccaaaggccaaaggtttttataactcattcaaggtcaccaagcaagccagaacagagccagcacaagaccctggggctgggaagtctgggcctgcactccctgcctcccacctagagcagaggcagcagcctgtgtcaccccaaaccaggccccaggccccagcagtggtcccatctctgggtgacttcttgcccacagcaaggtgcccttggccctacccacacatggctgacctccacgccaggactgtccaggctcggctctttctaggccccgtagaccccatcagcctccaccagcatttgttgacccagcctaaggacaggtggtctgcacacccagggccattgctaatcaggccacctcccccaaggccttccaccttccagacccaacttaggctttattccaccacctggccctccatccgggcttcctaggctctggccagtcctgctcctccctccagagccatgaccagtcgccggcccaggacagaccgggtgcaactgaggaccctcccggtggtcacctgatcgtactgggggtatcagccggacaccccgcctccagaacccgctgcctctgtccagagcggcccagccccagcaggctggcagctcggtgcaaacaacgggatgcagcgggcgggatgcgagccccacgatccctgggtcggaagccaagggcttaagcccccacgttctttctggctcgcggcggcttcgtgcgccccaccttccccgcagttctgagagaggcggtagcagggttcagatggagggaaggacagggcgcggaaaggggaggggac

SEQ ID NO: 1290 - DNA, 297 bp, Homo sapiens
gaattcggcacaggtctaaatgagatggcacgggtatgcttctgttctttttctggacgttgtttagagagtcagtagatcataataattcagacacttttttttckggaccataaaatatctgarsccayataataacaaacatacagcacggtgaataagaacccaacttttgagccagatcactttgcatggaatccccattctatcattctatcatttctgggctgtgggaacctcagacaagttacttaacttcttcaatgctcagattaaaaaaaaaaaaaaaaaactcga

SEQ ID NO: 1291 - DNA, 1632 bp, Homo sapiens
gaaagactcgatttgggagcctactggggcaaggcgactggggaggtgtacgtgttagtcaagtggaggtcaggtgggttatcttctgcctccttcactggcttcatgtgaacttgcctgtgacagaatatcttgccctagatgtcctcttccctcttgccatcgtgcaaaagcattcgatcttatgaccgtgagttcttatttgtggatgctaactggggtaatctcagggagtactggggccatggctctttcccttgcttctctttctgctcactgctttgctttcaggtgcttagctgctcctttttatttctttgcaggactgggaaagcatgggaggaggattttgataagtttcttgttctctgcgtggtgatggggtggtctgagggccaagttaataagcctacctttggttattaccctggaaaattgagggttgatggtagggttatgattgtggcctgtgtatttgcaatttttctttgtcagtgtggctttctgtcatcttcctttttctccagtgagggttctgccactgtctcaatcccttggttcctgcaaaaaacagctaaatgtgctctcagggccagtggtgatgttctgtgttgcagccccagctcttgaaagtgacctggcccagatgagctctgcctgcttgtcatctttaggtcctgctgcccctgctgcctcagccctcaggctcctaactgctcaagccagaaggagctacaaagccaaatcatttgtcatttttctctggcagattgttttaaaatctccctcccctcttttattttaattatgccacctgtgttaatcctatagcctgcttctttgctttgtggattactgatttcaagttctataacttggggaaagttaggttgagtgaatgggaggacagacactgaatgtgtgttttggaaaaatggactctctatcttcagattattcagcttctccacctatcacctctacaacttggccttcattggagaagttttagttggcttattcctggaacaagaccacctagaggcttttagccttgtcagcctgccctcttctgaggtttggaccttgttttaaattgtgtgcatggtgggcttgagactctcttgtaatggaggtaatgggactatcactgaggggttcagcctatccaggtaggctaccgttctagtcatacccatcacttaaattctgccacagtctgcacagacggttggtcctccaggcatattgtcctattaagccaaataggtggacatcatgggatggatgaggtcatcatgaaaacagatttactggatttatggacctagtatatactatgtaacagatggaaaactgaattttacaatctataggtacctttgaaaggtcataaagggtaaaagtctatagttttccagaaaataattcttaaaactgggttttatgtctagatttaaatcatgtatctgtctgtagtgcttcaaatgtggccaggtgtggtagctcacacctgtaattcccagcgctttgggaatttgaggcaagaggattgctagaggccaggattttgagaccagcttcggcaatacggtgagaccttgtctctaccaaaaaaaaaaaaaaaaaaaa

SEQ ID NO: 1292 - DNA, 1149 bp, Homo sapiens
cagcgggaactaatcatgttggtgataataataatgacagctctggtctcccatgtcccaagcgtccactctgtgcctcatgctgttcccttcaccagcagttagttctccatctaatctttcttctgagaaaggcagggcagtcacggctccaactttacagatgaggaaattgaggctcggggggaagtcactgcctgaggtcaatgggcaagtcggggggcggtgccaggacccatgcctaggtcacaccccaagtagagttctgaccatggggttcagagttagcagagggtacggtggaccaccccatctgcagtcctccctggaggtcagatccgggactgctggactgtgtaacttcagggagggactgtactctctgcctcacagtcttcatcaataaaatgaggatgacacgggtccctgcttcacagggatcccagggctcagaacacagtggggctcagggacaattctcaggttcatgcagttgatcaacaaatgcacattatagcctgaggaacatagggagaccccatctttacacaatttttttttttttgagccagagtctcactctgttgcccaggctggagtgcagtggcgcaacctcagctcactgcaacctctggctcccaggatcaggccattctcttgcctcagctactcgggaggctgaggcaggagaatagcttgaacccgggaggtggaggttgcagtgagcggagatcgcgccgttgcactccagcctgggtgacggagagagactccatctcaaaaaaaaaaaaaacaaaaaaaaaaaaccaaaacaaggctgggcgcggtgcttacgcctgtaatctcagcacttttggaggctggggcaggggtatcacctgaggtcatgagttgaagaccatcctgaccaacatggaaaaaccccgtccctgctgaaaaatacaaaattagccgggtgtggtggtgcatgcctgtaatcccagctactcgggaggctgaggcaggagaatggcttgaacctgggaggcggaggttgcggtgagctgagatggcgccattgcactccagcctgggcaacaagagagaaactccgtctcaaacaaaaataaaaacaaaacaaaacaaacccacaaaaaaaaaaaaaaaaaa

SEQ ID NO: 1293 - DNA, 1405 bp, Homo sapiens
  misc_feature (604)..(604): n equals a,t,g, or c
  misc_feature (842)..(842): n equals a,t,g, or c
  misc_feature (1079)..(1079): n equals a,t,g, or c
  misc_feature (1334)..(1334): n equals a,t,g, or c
ggcacagtggaccccagactccctctccgcctttctctgcctggggagacccactgtgtgcatggcatcactgactcccatacctctggctatcaaaggtttctgccatggccaccctggaagsaaaccagagggaggtagacagggagatcaggtcccttctactctggttcctgctctgtgaaattgtctcaggctggctgtgtccagarggtccctggttctctcarggatgccaaatctacaagaatctctcctcttccagttcctataacctctccttccttttgtctctttagaccttggagtagtagcagccaggttctttctatctctgggttagtgcattatctctggtggctcccttacccaggactttgggaatggtctttttgtaatacattctcctcaaataattcaattttgagtgttctgtatgtatcctgctgggaggttgttatatacaaatcactgtgcccgtttagcagagaaggagactgaagctcagggaggttaagtgtctttctctaggtcgtattgtggagaaagtggctgactggggacttgaatgaggtccctagtttcatgctcggagggcaaagangaatgtccaattggcctgagataagcctctggtaaaatgtactgtacataataggtaatcaataaatgttggctgatgacaaacatgttttctttgttcattagttatagtgattatgttctaaataactccmacaaggaartcagcacatttggaatatcawtatctttccatgataatatctttccmyggaaagawaatgatattccmaactgggagtgtcccwagcaratctgantctgtgtattggccctggggtgggccagccccttagactctatggtctcattctctttgtttacaaaattgagataaggccttattctctccccaccccacccatccatattgttttgagaataaaatgagaggatgtgtgtcaagggtgtattttggcaatagtctctgagccattttctgagcacctccatactgttgacactcaagtaatatttcatcagcattccattcaggntcctcccttaatgaggtgtgcgatgtacaagagtygtgaggtggcaaaggatgggctcctgaggaaacacttaggaaactgggctttctgccattaaaagagacaaacctttgtggtgacctaattaaagtttttaaaattcaatttggaaagttagcaagctagctcctktccaggwaaaataaggagtcagtgcatgacctaaccggtcccgggctgcttgccattccaaacaactgcagtaagtttatcacnttctttcagggactgaggtttccaggcacagacttggataaggaaggatgtcctatggggtcacattgatg

SEQ ID NO: 1294 - DNA, 919 bp, Homo sapiens
  misc_feature (41)..(41): n equals a,t,g, or c
aattcggcagaggtccaattcagtttttcaggccagtgcancttgataccaaaaccaataaaacaaacaaacaaacaaaaaacataaagctatagaccaaagtctcatagatttagatgcaaaatcctaaaattgaaaaaaaaagtctagtcatatccataaactgtatcatcaccaagagatgtttattagggcaatcaaaagatgatttattattttttaaaaaatcaatgtggccttcccttcctctttcttttgattcccctctttgagtttttatgtgtctcttttgccttcccttcccagagtggaggagttagacctgcattgtgggatgagaggagttgtggctatgtgtctgctggcaccaagagggctgagggtgaggtgtggaagggacagggggaggagatgggcagcattgttaagagattggtaccactgagcaaatatgttgagaatgatgatggcaaggtttctccctgttagagaaggtatttgtagaaataggaatgaggagagctagaaaacctggagtgtgggattagaatagaactcatatcttttaaatacataggaacaatagagaaattgttgggtgtgcccatatacatatattttgtgattcattctaccgagaggacataaatgcagtcacagctcagtaacagtaaacacaccaactgccaagttattatttcctaaatactatccacaaaaaaggggaccagggatgattcctagtcggagattgggagaaaaagaagatgagcctgaatcatttcatgtacctaacagaaagaaaatactctggctgggctcagtggctcatgtttgtaattctagcatgttaggargtcsargtgggtgtgttgcttgagcccaggartttgagaccagcccaggcaacatggcaata

SEQ ID NO: 1295 - DNA, 1964 bp, Homo sapiens
actgcaggtcgacactagtggatccaaagaattcggcacaggccctctgtaggagktaattttcatggcagttcgtttgattaaaccggcggtattcgcagtgctcgccgggttttctgtgttgtggctcagccctgcaagcctggcggccagttttgactgtgaccgggcgaagcgcctgacgagaaaaccatctgtgccacgcgctccctcaatgatcaggacgtgaccatggcgctgctttatgacctgaaccggcacttcatggccatgggcgggcgcggttcgttgatggatgatcaggctgtgtggctcaagcaacggcatacgtgcggcgcccaagtcagttgcctgagcaaagcctatacggagcgtattgcgatgttgcgtattttattgatgagcgggtgatgacgaaggggccgttctgaagcagttacagatcttgtaatagttttgcattgtaggaaattcttgtttcgcctgtacgattcaagtccttttcccacaacaggacctacatgaacaccctctcggagcctcccagtcgtctttccccaagacatgcactgtcgccgttcccgctgatcgcctgcctccgggccaagcatcccgtcttccgattgcctaccttamccggtccctcgaccgtgcgttgccgtgcccggcattctgaaaaacttgaagagrtactgaaaaatggaatggttagcggatccaacggcctggctcggcctgttgactttgattgtgctgragctggtgctgggcatcgacaacctggtgtttatykygatcmtggcgmccaagttgccgccggagcagcgtgaccgtgcgcggctgatcggtttgtccctggcgttgctgatgcgtctgggcctgttggcaagtatttcctggttggtgaccctgacccaaccgctgttcgaggtgttcgacaagagtttctcgggccgtgacttgatcatgctgtttggtggtgtgttcctgttgttcaaggccaccatggaattgcatgagcgccttgaggggcatgtggctcagcgcactggcaacgtggcttatgcgatgttctggccgatcgttgcgcagattgtggtgctggatgcggtgttctccctggatgcagtgattactgccgtgggcatggtggatgagctggcggtgatgatgatcgcgrtgatcatttccatcggcctgatgatcgttgccagcaagccgctgacccgtttcgtcaacgcccacccgacggtgatcatgctgtgcctgggcttcctgatgatgatcggttttgccctgaccgcagagggcctgggcttycacattcccaaaggctatctgtacgcggccatcggcttctcgatcctgatcgagctgttcaaccagatcgcccggtcgcgccgcaagaagtcggcccagggcacgctgccgaggcgtgagcgtacggcccacgcggtgatgcgtttgctcggcgggcggaatctggcagtggaggaggtgggtgaagaggtcgccgacctgctggataaccctgatgccaacggcgggccgctgttcgaccggcgcgagcgggtgatgatcagtggcgtgctgcaactggctgaacgcccgatccgtacgctgatgacgcctcgggcgaaggtggactctatagatctgtcggacgatcccgasacyatccgcctgaaactgagmattcgtcttactcgcgcctgcccttgatccgcaacggtaatgtcgacgagccattgggctttgtgcacaagaaggagttgctcaaggaatacctggccggtaacgagccgaacctggagcacctggcgcgccgggcggtcaacttgctggagagcttttcgattctcaatgccttggagcagatgcgtgaggagtcgactcacattgccttcgtgatcaacgaatttggcgactttatcggggtgttgagcatgaccgacatcctcgag

SEQ ID NO: 1296 - DNA, 1618 bp, Homo sapiens
taacgcgcctgcaggtcgacactagtggatccaaagaattsggcacagtaaaaaaaaaagaaaaaaaaagaatactgcctcacatcaaatggtctatgttacttagtatatatgatcaagtaacatgcagtcatcatcaaaactgtattacaatgtttagaagagtttcctattgacaaaataaataaaatgtttctgctttatgattaaataaatccatcattgtttatgcatgattaagttgcaaaaagtttcagaggttataaaggttttaaagatgcttctatatcctttggttttgcttttatctttgaaattggatacaaaagccacaatctttgctgtgttggaagatgtataggaatagaaacatgaaacccacaaacataaaggtttaccttgaagtggtagactttttaaaaatgagaacacttgaattagaaatactgaaagcttaccaaaagtttgtcaaaccgggaatcaagacctattgtgtcgctcatccttgaccccacatctactcactttccaactcctatgtagcaaatcccctaaatacctctcaaatttattcacttgtctccatacctacagccatcaatcactctcgtcaaagtcaatgctgtctattaactggttcttaaaattgctacattcttttctgtgcctcggcttttactccttactatcctaaattctatattcaggcagggtgattcttgtattggagacaaagagagagcacatagaccaaggtgttttggaaacagtcggccctccctatctgcaggttccacatctgcagctctaaccaactgcagatcaaaaatactgggaagaagtatataaaaacaaaataatacaaataagaaacaacacagtataacaatgatttacatagcatttacattgtattagatataagtactctagaaatgatttgaagtattgtttgacacttgaacaacatgagggttagggatgccaatctcccccgcacacagtcaaaaatctgtgtttaacttttgagttcccaaaaacttacctattatccaattgttgacaggaagccttactgataatacagtcaattaacacatattttgcacgtcatatatattatatactgtattcctacaatgaagtaagctagagaaaatgttaacaaaattataaagaataaaacacatattttatatacttttttagagagagagttctcactatctttgcaaggctggactcgaatttctgggctcaagcaatccttctgtctctgcctcctgagtagctgggactacaggcacttgctaccacacccagctcctatatttattatttattaagtggaagtggatcatcttcatccttctcatcttcaggtggagtaggctgaggaggagcagggagaagagggttgggtgttgctgtctcaggggtggcagaggcagaagaaagtataagtgaacccatgcagttcaaacccatattgttcaagtatcagctgtaaacaggagggcgtgtataggttatatgcaaatattaaaccactttatatgagggacttgggcatccatgaattttggcatttagaggttcctggaaccaatccctcgag

SEQ ID NO: 1297 - DNA, 1759 bp, Homo sapiens
  misc_feature (618)..(618): n equals a,t,g, or c
  misc_feature (1095)..(1095): n equals a,t,g, or c
ggttgttttgttttgctttttgaaagtgtggtccaagaaccacctgaatcagactcacttggatgtagttaaaaagcgcagatccctaaggccccttcagacctaatagtcagaaacactggggctggagcccagactgcacccctccccccgccccgccccgcccaggatccctggtgattcctgtgcatatcgaagtttgaaaagcatgcttttccttgaaattaagagacagtgaacccagttgtctgcaaagagataggggacagaaacttacatgtacctaggacgaagatggttctttctgtacctttgtcccttcccttcatctgcactgcccaccttctgtgcccttttgcatgctcacacatccttctgtatgatcaacggacttgggcacgctgcacactccttggcttatgaaactttcacactgtcagcagagggcgccagagaccctccaaaagccacggaatgctccatttgctcgttgccctccttttgcattccaggcttttgcattctattctaggcatctagttttccaggyttaggyctgtcccccacctcactgattctcaaagggacattggatctcaggagagtgcacagcttctnagaaacgcacttattgtggggcctggaaatttatttaatgcctctgagcccaaatttcacatcctaacaaggaactaatttattagcctgttactgtagttcttttaatggttaaatgaggtaacaggtgaatgtgcccatgaaggtcagcagcccagtgactgccagcaccctgccactgccaccactggtgcaagtgtaagcatggacactggcaaccctgctcccacctgcaccctgccacaggtacaagtgcacacaggaatgcagcagctcgacttctgctggtaccccaaccccrccaaggcataagcaccctgcggcgctgccacaggtgccagaacacgtgagtgagcacagatcctgctgccaccgscccaaagaagcactttgtctggcmccacccwtcagagggttgtggctaatggaccaggaacamyyttggmccytytgwtgcagcaggttcccawtytyamnggggccagatacaaagctggggkcctggtaccactycccagacttagagtccaccaggagtgctgagctgagccgtggcccctaaaatcttccagaaatgaacccagtcaactgaacctaccttataccgcaatgaaacccccaagggcagcaaagaagagaaaagcaaagaaaaaaacatgcatcgaaaggacagcaacttcagaggttgagggaacatcatcccacacagataagaaggaatcagcacaagaactctggcaactcaaaatgccagawtgttttcttacctccaaatgaccacacaagttccccagcaatggtccctacctggggctgaaatgacagaaaaagaattcagattaccgacaggaacagagaacattatcattgacatccaggagaaagttgaaacccaatccaaggaatctaaggaatataataaaacaatacaggagataacatatgaaatggcattttgaggaagaaccaaactgatctgatagacctgaaaaactcacttcaagaatttcataatacaatcacgaatattaacagcagaatcaaccaagctgaggaaagaatctgagagtttgaagcccagttctacaaaataaacaaaaataaagaaaaaacaataaaaaaaaaaaaaaaaaacctcgag

SEQ ID NO: 1298 - DNA, 924 bp, Homo sapiens
  misc_feature (1)..(1): n equals a,t,g, or c
ngacagccgtatcagcctgctggtgaataacgccggtgtgggcgccacggcttcgctgctggagtcggatgccgacaaaatggacgcgatgattctgctgaacgtactggcgctgacccgcctggccaaagccgcggcaaccaactttgtcgcccagggccgtggcacgatcatcaacatcggctcgattgtcgctctcgctcccaaagtgctgaacggcgtgtatggcggtaccaaagcgttcgtgcaggcgttcagcgaatcgctgcagcatgagctgagtgacaagggcgtagtggtccaggtggtgctgccaggcgctaccgccacggagttctgggacatcgccggcctgcctgtgaacaacctgccggaagccatggtgatgaccaccgaaaacctggtggacgccgccctggcaggccttgcccagggcgaagccgtgacgattccgtccctgccggacagcgcagattgggacacctacgaacgcgcgcggctggccctgggtccgaacctgtcgcaccgtgaacccgccgctcgttatgggttgaagtaatccggactagcgcaggccgggtttaaacgcaggcttcctgattgcctgggaggcctgttcatacccgtaggcgaccgacagcaacgtggcttcgctcaaatttttcccatagaagtgaacggctgtcggcatcccttcgtcgtccatgcccgatggtatggagataccgggataaccggccaccgccgagtagtagtaactgtatgagtgaaagttggacatcattgcatcaagcttatgctcggccagcggcttatcgatggtgcttttgaaaatcgggccgatggcagcccataactcattgcgcgcctcatcactgatatccatcccgttgatcatggtgagcatctgttgatccggcacac

SEQ ID NO: 1299 - DNA, 3061 bp, Homo sapiens
  misc_feature (2755)..(2755): n equals a,t,g, or c
  misc_feature (2849)..(2849): n equals a,t,g, or c
  misc_feature (2919)..(2919): n equals a,t,g, or c
  misc_feature (2983)..(2983): n equals a,t,g, or c
  misc_feature (2987)..(2987): n equals a,t,g, or c
  misc_feature (2998)..(2998): n equals a,t,g, or c
  misc_feature (3027)..(3027): n equals a,t,g, or c
gtgtgggggccaccttcggtggcggccgctctagaactagtggatcccccgggctgcagggaattcggcacgagcaacattgaagaccgggacgagcttgcctaccacatcagcatcatgttctatataataggaggtgtggccactctcctcctcatccttgtcatcattgtgttcaaggagaaacctaaatatccccccagcagggcccaatccctgagctatgccttgacctctcctgatgcctcatacttaggttccatcgcccggctcttcaaaaatctcaactttgtgctgcttgtcatcacctatggtctgaatgctggtgctttttatgccttgtccactcttctgaatcgcatggtgatctggcactacccgggggaagaagtgaatgctggaagaattggcctgacgatcgtcattgcaggaatgcttggggctgtgatctcaggaatctggctggataggtccaaaacctacaaagagacaaccctggtagtctatatcatgacactggtgggcatggtggtgtacacgtttaccttgaacctgggacacctgtgggtagtgttcatcactgctggcacaatgggcttctttatgactggctatctcccactgggatttgagtttgctgtggagctcacgtacccagaatcagaaggcatctcctccggcctcctcaacatatctgcacaggtatttgggatcatctttaccatctcccagggccagattattgacaactatggaaccaagcctgggaacatcttcctgtgtgtgttccttactcttggagcagccctcactgcattcattaaggcagatctccggagacagaaagcaaacaaagaaactcttgagaacaaactccaagaggaggaggaggagagcaacaccagcaaagtgcccactgctgtgtcagaggatcatctctgagaggaaggtggtgacaactcagggaacacgaacaccccaccttttccttcagcacagctctcaccgccagcacaaagggcttcgctagagatgtttttggagggaatcagtgggactatttgtggcatggatggcctattcctcctagaacccacgtaagagcttggatgatttagttggagaaaattgcacctatcaccaaatgcaaatttgattcccacctccacccccttttaggttatgggagttggtgttgggacagggtggcagagaatattggagtcaatcctagcttggtctcttgccttccctcttttcctccatccatcgtggacaatgcctgcaaaattttcacaggaagaaagcctattcaggatattaacttgaaatttccagtgtcctaagagcctctcatgaagcccagttctaataagtggcaagctgctctgccggggtcatctcctgggtcatcggactgattgctcaagttctgcaggagaggaagcaccattagaacaactccatcagaacagctccaccgggacttgtgggcctaaattttcctggcctaacgggtctgtctccaaaccctctttcctaagagctgagcaaaccaaccataataaacttgacaaaagactttgttgtggccatgacagagataccgactcaggagggctacctacctaggtgtgatcatgctgggggctaccttctgagtatatttgtgaaagcacatatttgggaactctggtagcttgagttgggaatgggaaggttcttttttacagaagtacttccccagggacttctgtgtgtcacagtcacctctgatgcctttatcttgatgttgcattgggaatctcagccatcagcccaagtgcttgttttattccaaggcagggtaatccccgtcaacttactctaacctttgctgaaaactaatcttgattcattctactctgaaaatccaaaggtgcttctgagagataagagggaaggggtagaaggaaaggtgccccttgaaatgggaattgagcctgttagaattaaaagcttatctcacctctgctggggacagtatttgcaccaccaacccctctcctcacctgctttgagcgataatctttatcagatattctaaacttaaagggattccctttaaaccaactcaagctgatctttcctatctagcctgctgtttggctgtactcatgggctttggtaatatctcctaaaaatgaggttttggtaatttttcctatgcattgggcaactgtgatcgtgaccactgtgctgtcttgctccagccactgccctggcctcagcatatcagggcagcctgtgctggctgcaatactgtggtgcttgggccactgcctgagaggagccaggtttgtgtgtgtctgcatgtgtgtgtgtgtgtgtttgtacagattcaagcaatggatgcaaggaacatgctgtatgtaatagaagaaagaagtccacgttttcggcagaagtagtgagtcagtgtggaagagaggtgagggtgtgctttactttttgataaagagaaagatgtttactcataaacccttcaaaaggtattaacaaaatgtttaccaaacctattgctttattttaaaaacataatttgtgttttctatttgtaagatctgacatttcgaggcaataaaaacttctcagaaaaaaaaaaaaaaaaaaaaactcgagggggggcccggtacccaattcgccctatagtgagtcgtattacaattcactggccgtcgttttacaacgtcgtgactgggaaaaccctggcgtnacccaacttaatcgccttgcagcacatccccctttcgccagctggcgtaatagcgaagaggcccgcaccgatcgcccttcccaacagttgcgcngcctgaatgggcgaatggcaaattgtaagcgttaatattttggttaaaattcgcgttaaatttttgtttnaatcagctcattttttaaccaataggccgaaatcggcaaaatcccttattaatcaaaagaatanaccnaaatagggttnaatgttgttccatttggaacaagagtccnctattaaagacgtggactccacgtcaaagggcga

SEQ ID NO: 1300 - DNA, 1256 bp, Homo sapiens
  misc_feature (1240)..(1240): n equals a,t,g, or c
tcgacccacgcgtccgagcaaccgcagcttctagtatccagactccagcgccgccccgggcgcggaccccaaccccgacccagagcttctccagcggcggcgcacgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccamcgttggcatgaagtgtatgaagtgcttggaagacgatgaggtgcagaagatgaggatggctgtcattgggggcgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaactgggggaaggggtgctccttaaatatatatagatatgtatatatacatgtttttctattaaaaatagacagtaaaatwctaaaaaaaaaaaaaaaamcycggggggggnccggtacccattcgcc

SEQ ID NO: 1301 - DNA, 705 bp, Homo sapiens
  misc_feature (1)..(1): n equals a,t,g, or c
  misc_feature (654)..(654): n equals a,t,g, or c
  misc_feature (683)..(683): n equals a,t,g, or c
nagcaaccgcagcttctagtatccagactccagcgccgccccgggcgcggaccccaaccccgacccagagcttctccagcggcggcgcacgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctattttagttgccacagcatggtatgggcaatagaatcgttcaagaattctatggaccctatgaaccccagttcaatgnccagggtaacgaatttggttcaggctctntttcactgggctgggctgctgc

SEQ ID NO: 1302 - DNA, 1040 bp, Homo sapiens
  misc_feature (33)..(33): n equals a,t,g, or c
cctggcaggtaccggctccggtaattcccgggntcgacccacgcgtccgcggcgcccgtaagcggacgctgttaggggtggcggggggttggcggcggttcgagaggctctgggccggcagtctaagctctcgcagcctggctcttgcagccgcaccctcaagcaacggatccccatggcgcttgttgggcgcgttgtgcctgcagcggccacctgtagtctccaagccgttgaccccattgcaggaagagatggcgtctctactgcagcagattgagatagagagaagcctgtattcagaccacgagcttcgtgctctggatgaaaaccagcgactggcaaagaagaaagctgaccttcatgatgaagaagatgaacaggatatattgctggcgcaagatttggaagatatgtgggagcagaaatttctacagttcaaacttggagctcgcataacagaagctgatgaaaagaatgaccgaacatccctgaacaggaagctagacaggaaccttgtcctgttagtcagagagaagtttggagaccaggatgtttggatactgccccaggcagagtggcagcctggggagacccttcgaggaacagctgaacgaaccctggccacactctcagaaaacaacatggaagccaagttcctaggaaatgcaccctgtgggcactacacattcaagttcccccaggcaatgcggacagagagtaacctcggagccaaggtgttcttcttcaaagcactgctattaactggagacttttcccaggctgggaataagggccatcatgtgtgggtcactaaggatgagctgggtgactatttgaaaccaaaatacctggcccaagttaggaggtttgtttcagacctctgatgggccgagctgcctgtggacggtgctcagacaagtctgggattagagcctcaaggacattgtgtgattgcctcacatttgcaggtaatatcaagcagcaaactaaattctgagaaataaacgagtctattacwaaaaaaaaaaaaaaaaatcgca

SEQ ID NO: 1303 - DNA, 2034 bp, Homo sapiens
  misc_feature (14)..(14): n equals a,t,g, or c
  misc_feature (382)..(382): n equals a,t,g, or c
  misc_feature (1999)..(1999): n equals a,t,g, or c
  misc_feature (2027)..(2027): n equals a,t,g, or c
actcactaagggancaaagctggagctccaccgcggtggcggccgctctagaactagtggatcccccgggctgcaggaattcggcacgagatctaccgggagakggaytctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcntccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctrggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctacaaaaaaaaaaaaaaaaaaactccanaattacttcctaaaaccggcccgcgggncccatcc

SEQ ID NO: 1304 - DNA, 1208 bp, Homo sapiens
cccgggtcgacccacgcgtccgggagaaagctgcactctgttgagctccagggcgcagtggagggagggagtgaaggagctctctgtacccaaggaaagtgcagctgagactcagacaagattacaatgaaccaactcagcttcctgctgtttctcatagcgaccaccagaggatggagtacagatgaggctaatacttacttcaaggaatggacctgttcttcgtctccatctctgcccagaagctgcaaggaaatcaaagacgaatgtcctagtgcatttgatggcctgtattttctccgcactgagaatggtgttatctaccagaccttctgtgacatgacctctgggggtggcggctggaccctggtggccagcgtgcatgagaatgacatgcgtgggaagtgcacggtgggcgatcgctggtccagtcagcagggcagcaaagcagactacccagagggggacggcaactgggccaactacaacacctttggatctgcagaggcggccacgagcgatgactacaagaaccctggctactacgacatccaggccaaggacctgggcatctggcacgtgcccaataagtcccccatgcagcactggagaaacagctccctgctgaggtaccgcacggacactggcttcctccagacactgggacataatctgtttggcatctaccagaaatatccagtgaaatatggagaaggaaagtgttggactgacaacggcccggtgatccctgtggtctatgattttggcgacgcccagaaaacagcatcttattactcaccctatggccagcgggaattcactgcgggatttgttcagttcagggtatttaataacgagagagcagccaacgccttgtgtgctggaatgagggtcaccggatgtaacactgagcaccactgcattggtggaggaggatactttccagaggccagtccccagcagtgtggagatttttctggttttgattggagtggatatggaactcatgttggttacagcagcagccgtgagataactgaggcagctgtgcttctattctatcgttgagagttttgtgggagggaacccagacctctcctcccaaccatgagatcccaaggatggagaacaacttacccagtagctagaatgttaatggcagaagagaaaacaataaatcatattgactcaaaaaaaaaaaaaaaaaa

SEQ ID NO: 1305 - DNA, 1817 bp, Homo sapiens
ccacgcgtccgatttacacaaaaaaggaaagtcacaagcctgtttaaaatgaagtgaccaccttttcttgcatagactaaataactcgaactggcatttttaggttggaaagacagctgaattagtagttaagtctgatagccaagtaagttttaaaaaccaaagcatccaggatgcacacccctgcaccatttgctgtgcgaattaatagttctgtctctctctctctttcttttttctttttattctttgagatggattttcgctcttgtcgcccaggctggagtacaatggcacgatcttggctcactgcaacctccgcctcccgggttcaagcgattcttctgctgggattacagcatatgccaccatgcccagattatttttttgtatttgtagtagagacggggtttcaccatgtcagtcaggctggtcttgaactcctgacctcaggtgatccacccgcctcagcctcccacactgctgggattacaggcatgagccaccgctcctggcctctctttcttttttaaacaaagaactttgcacttggccagagaggaggagaaagcccattttctcccttcctaagctagatccaaataaaagaaagttcagttttcccccataactattcttgggtcatgaactttgatctggagtttgttttgtttcaggaatgtgtgcacccagcttgctgatccaacaaagtctattgcttaccagtctagcttgatgaagccttttggccagaagtcaatttgttttggatcagagaaatttcctgacaaggtatatttgttttctagtgacagaaaggcaaaggaacaagtcctagttgttgttgttgttgttgaatactaaatttaagatatgtcagcttgctttcaatgagccttgggcttctgttattgcttgagcatttggaactcgagcttccagagaaatttgaggtcctcgcttgttctctgccttcaagaaacaatgacctgattctgtctttaaaaaaaaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccccaaaaaaaaaaaaaaaaaaaaaaaaaaaaaaaaaaaaaaaaaaaaaaaaaaaaaaaaaaaaaaaaaaaaaaaa

SEQ ID NO: 1306 - DNA, 2290 bp, Homo sapiens
gcccacgcgtccgcccacgcgtccggatctccaggacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtctttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcttctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaaaaaaaaaaaaaaa

SEQ ID NO: 1307 - DNA, 3564 bp, Homo sapiens
gcgtccgcctgtggccgtcaagcgcttccacatcaaaaaattcaagaactttgctaacgtaccggcagacaccatgctgaggcacctgcgggccaccgatgccatgaagaacttctccgagttccggcaggaggccagcatgctgcacgcgctgcagcacccctgcatcgtggcgctcatcggcatcagcatccacccgctctgcttcgccctggagctcgcgccgctcagcagcctcaacaccgtgctgtccgagaacgccagagattcttcctttatacccctgggacacatgctcacccaaaaaatagcctaccagatcgcctcgggcctggcctacctgcacaagaaaaacatcatcttctgtgacctgaagtcggacaacattctggtgtggtcccttgacgtcaaggagcacatcaacatcaagctatctgactacgggatttcgaggcagtcattccatgagggcgccctaggcgtggagggcactcctggctaccaggccccagagatcaggcctcgcattgtatatgatgagaaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacactaagccagagaagcgaccgctggccctgtcggtggtgagccagatgaaggacccgacttttgccaccttcatgtatgaactgtgctgtgggaagcagacagccttcttctcatcccagggccaggagtacaccgtggtgttttgggatggaaaagaggagtccaggaactacacggtggtgaacacagagaagggcctcatggaggtgcagaggatgtgctgccctgggatgaaggtgagctgccagctccaggtccagagatccctgtggacagccaccgaggaccagaaaatctacatctacaccctcaagggcatgtgccccttaaacacaccccaacaggccttggatactccagctgtcgtcacctgcttcttggccgtgcctgttattaaaaagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggcgcggtggagatgttatcgtcattggcctggagaaggattctggcgcccagcggggccgagtcattgccgtcttaaaagcccgagagctgactccgcatggggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctgcccctgaactccttgctgctaagaagtgctgagaagttactcgcctggcggtggctccagggttctctggttctctggagcagagttctctgaataccccatcccccaactgctgattttacagccccagggaagacagtggtatcaggctgggagcggcccctctggcctcccccatcagtttgcaggagcaggggtgcaggatcctgttctgagctgggtcaaacaaagcagggccgggccttcctgccatccccaggtctcagatggaattacactagaggccctccgctgggaagcacttgaggtagggcaggaggggggctgtgacccctgccctttccccgccagagacctcaggctctcagcacattccacaggctcctgagtccccgaggcctgggccagcttgggcaagccaagatcagatgtctctgtgttcgggaaggtctccgtgtgggaaagcccttgggggatcccgggtgaggagtgttgccccatccagagaatgaatgagttcctttaagtgccaccgccagcaagcccagaggcacacagtccgagtgcacccacttagcctttacattcctctccaccgacaaaaggaaggggaaactcaatcagcaggacttcagaaagggccttgtgtttatagctttgtcaagtaaatttggacgcagctggagcacaggccctgttcgtttgcacataataatcttgtttatcactttaaaaaattcagtaatatctcagcagtcaggcttctggttgtgaaatcacattgtatgggatttataccaaattatgtatttgctaaacattcactgcacacgtgtacagcggagtacgaaaaggaacgttgtccacaggggatttatggatacaacagcaaacattttataaactatgcacatgcattacacacatgcacacacatatgcacacacatgtgcaaacatagccacttttttgtcaagagttaccctttggggctccttaaaccagaatgggagtttgaaagagagatcatactccagctgaagtttgttgacccttttctaaaattaaaaagatcaaatttagtatttgctggatatgcagggagatgagactcttttaatctcaaaataaacagattctttcaaaaaaaaaaaaaaaaaaaaaaaaaaaaaaaaaaaaaaaaaaaaaaaaa

SEQ ID NO: 1308 - DNA, 961 bp, Homo sapiens
gcgtaatcttcaggaaggtcagtctggtagcatagtgtggattgggttgggggatggggaaggagagcagaaaattattgaaatatccaggtgcataaaagtctactttgattatggagaactacacacttgttcagtcaccctcattggagacgggggatggcatacgaaaagaatgctgatttcaggctgggcacggtggctcatgcctttagtcccggcgctttgggaggctgaggcgggtgaatcaggggttcaagaccagcctggccaatgtggtgaaaccctgtctctactaaaaatcaaaaaaaaaaaaaaaaaaaaatggctgatttcagagtcatattcaggtttaaattctgtcattcagcccaaactcattactttatgttacttatgggaacctcatctaaaaagcaaggatcctgatacctgcctcatattgtggcaaggatcaaatgagtcaaataagatgctttgtgaaagtgaggacaggatctatcctcaacacctagtgcaattctttttacacattaggtacttagtaatttgggttgaattgtgttgaactaacctggcggtataggcaaaatttggaagtttggttttcagaaagtcttgacttcctcttatctctaagtaattggcatgtcctctaattcatattttcccccctcatctgttgggtgaaatactgtttatcctttagtactaaaattaaaagttacctcattcttctagctagctgattttttttttaatctaggctaaatcatgaatacatttacatttaaataaaatattacagttgaaagtaaagggtcctttcattatctccacttccaattccagtaccctgtgtaaaggaaaacatatacatcttgcagacattttttaatgtgtttgtaatataggtacataaaaatatatgtgcttgttttaagcaaaaaaaaaaaaaaaa

SEQ ID NO: 1309 - DNA, 1149 bp, Homo sapiens
  misc_feature (837)..(837): n equals a,t,g, or c
acccactgacaggcattatgacctaacaggaggttggtagcagtagatccaagcatgcatgttgcctggcctgtagattggccttatcaggtttctgggtgcctctgccttaagatcctgaaggmaaattttgtttcaacagtttggaagtcatctgtgggtccagcttgactttggaggaataagaagatacttctagagtatgggaatgattccagataatttctgggatttgaatctacttgagtttaagggcctgggacctaatttggtttagtatagaatttgaagaattaatttataggcagctgaatacccaaaacttgggtggtggtcctgtggtttggctgagctgtccgggcataacctggttctctgttatgttaaggctttctgggaagccagccactctgcgcaggagtgaaacatgaagttgttttctgaggacctgttttggtgggattgtttgggcagaggactgtgtttatgcagggcaaatcccagaaagataagaggaagctagagaaacttaatgtacctgaattcttcatggtgtatttgcaaactaacttaacatagattcttttgactatggtaagtttgaatctctccttgccaaacaacattataagtttagttttcttcttcctcttgcagccggtacagaaaggtgtaagtggtggctgaaaattgaggaagcttcatctgaccaatgtgggtgctggtttcttgtgaaatgtgtccctaagcctccttctccttgcaggcagccacccacccaggtgtctaagataggacatgctcctttctttctctaatccsatcctgaggttgccngcaaagccaatatgaccactactgagaaatagtaatgacttctacaaatgcaagggtcttaccctcctctttcccttaaamaccctcccttttccttagaccccgtttttgccatcccccaaatgtgtggtatggtgaaactaatcccctgaatgtgaattgctatccttattgccctattaaagaagagccagctggtatattgtcaggaagcactatttaaaatgtgaactgttatagagtaaataaataaatactctacaggaaaaaaaaaaaaaaaaaaaaaaaaaaaaaaaaaaaaaaagggcggcc

SEQ ID NO: 1310 - DNA, 2076 bp, Homo sapiens
ccacgcgtccgcccacgcgtccgcggacgcgtgggctgtgactgaaatcattttcccatatgagcagaccctgtgtgtcaggcctgtttcccatatgagcagagcctgtgtgcaagtctgtttctggcatgtccctcattgaggaagggaagcaaaagctggttattgccaggcctattaacacttaatatgcaaattctatcatcctgaaactggggcatctgaggaaaaggtgaccttgctggatggctttatttgcatggctctgcctgtctgcagtggttgagtcctcatcacctggtatgtgtatgagcaaatgtgtgctgatcgtgatgcccaggcagaaacctcttgaagactgctgcaggcatgctttaaaaatgaccagtcactcatcagagaagctgggtgatctgactccagagggactgaagtcagagaagtcacaagagcacctaggattcaaataaatagcgtcagagtcctatagcaacctccaagtagcaccgtcttacttggctcttgtgagcaaagactgcagtaccttaaattaaggcctctctttaaaacatatgtggaagactaggggatccttggccacctggtctcagagaaatcatatgagagtaacaggcatttccttattgtatttgtactacactcttcctacttttccattcctgaacaccctctaattaccactgttttggggatgctttttttctgaaagaacggggagtacaggggccaaaagggaggtgcttctattacagggcaagttagatcagataagaagatctagcagtgatttaaactccaggaatatgaagagtgcattctggtgtccagacagttgtgaagggctcggcaaatataagagcaccattggctacatggagagcaaaggctgtctttgaagaccccagggaggtcttcacttttgcctaaattcagatttgccgtgaaaattccaaagagagcagatatttggatttgccctcctttgggcatctacctgactgttgtgtgtgtgggaaagtcagtgtgtatgtgtagagtgtgcttaggagtgagtgagtggtcaggcctcctggctaggtgtgttgtccatagttttgttgttgttgttgttgttgttcagagttttgaatcttacgttttctagagctgctcatgttttcccttcctttttgtcgttgtagtatttgacagttgtcttttccatcaaaaacatactggccctaggctggttagagcaaggggttatgcctgttaggcagcatcttacgcccagtgttctcccagatattctgcctaacaggtttaagtaggagattaaatagtcagtttatctaaaccctctatttttccaaactagcttgagaggtcttttcatctatttttactccatgggcctctgatatgctgagatgtgacacggttatgattatggtatcaccgttacagaggcaaagggataaaggtctaccagggccaacgtaaccagaatgtgaggagagtgaagagtcggtctccgctttgcacagtaccagaatgtgaggttgccactggagagtggagagtcggtctccactttgcacagttggagctgttctcctctaactcctttgctgggttttctggttgaaattggcccctactcctctccagccctttactgggttttctggttgaaattggcccctactcctctccagccctttattgggttttctgtttgaaattggcccctactcctctccagtgtctgctttttgaatccttctgttcgtgtgtgtgtgtgtgtgtgtgtgtgttccctatgatactggcagtggcaataattttccacccagagagaagcttgtggtccacaatgctcgaagaatgaatttccaagtatttgccagtggaaacggagcagaggctatgacaagagtgatttagtgttgcactttcagagcaattatctactgcagtaataaattgaaaatatcagcaagaaaaaaaaaaaaaaaaaaaaaaaaaaaaaaaaaaaaaaaaaaaaaaaaaaaaaaaaaaaaaaaaaaaaaaaaa

SEQ ID NO: 1311 - DNA, 1828 bp, Homo sapiens
ccacgcgtccggcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggctggaccctggagagtttctgcacccccttcaggacccccacagttccccgctgtggtccctggaccatcgctggaggtggcccgagctcacatgctggctttggggccacagcagctgctggcccaggatgaggagggggacacgtgagtataagggatagggttgtctgcagactcttggcttggtgggggctgttctcacggctgtcccccacctgtcctcaggctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggctgtgcttaactctggggtccaggttgacctggaagccagagacttcgagggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccaggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagctcttcgttcccagaaacccagatgtaatccccctacgtggtgcttggggcatcccgataccatctcagtaaatctcctacaatggcctcctcaccctccccgggacccacacccttcaggtcctcaccctgagacaggagggacctctgagatcagggacccttaggtctcactgctctctgattcagagctcagctgggcccccagttccagaccccagcattcccggtcactccctccctaatctgagcatcactcaagctctttattaaactcaatttgggccagaaaaaaaaaaaaaaacaaaaaaaaaaaaaaaaaaagg

SEQ ID NO: 1312 - DNA, 1940 bp, Homo sapiens
acgcgtccgcttcccagaaaatagatgacatcagtgccccttgctactttctcagtcctcactattgctttgagggcccaggtactgaaactggttgtcttgagttttgtgtcagctttttctccagtccattatccccctcccttgcttctgaagcagtctaggttaaactagccaggcaggtagttgtggaactggtgattttcaaaagccccactttagagatcaggccacagctttttatatcgcacaggacacatcagcctgagctgctgcctcatgcctgtttccccaggaacctcactcctttggtagaaccttgggattttagaaattgtggctttccataactcatttactccaacagttgaagttacacacattgctcccaaatttggaaatagaccacagtaccttacctttcattccccatctggcctttaccttctttgcttcagtggttgaaaacagttgccatattcaaagtatagtagatttcaacctcacacaaatgacaagtcccattttacaatcctaggaaggcccaccaatttcatttcacgcgccagggcggctgcagttggaggccgagggcagccctctgctcactgaatgtcttgcatgtgctgactgctgcccgcagtgctgaacatgccccaccgcccaggcccagcactgcttgttgggtcagcatctagtgctgctgtcacatctttgtctgcacagccagtaggattgcctcagccagggggtttatcagaaggtgtgcaaggcctttgggggaactgagcccctatagtgggcagtctcctttaccttcccacctccctgaaaagcacagaagacagtgccttggtttgtgttttgaagcaaacaagtcagctttctggctttgccccaaaactgtgatggaacataataaaactggagatatggtttttaacactgcaaaaaggaaaaagcatcaagtttctacttctggctggaaagcaaaaccaatctcagctgacaaggctgggcaaactaagttttcctgagcccattttcctttgagccctgacctagcctggccttacctcattaaggtttggttaaagcagtggaaaggaggaggaggcaggggtggatgggggtgtggggaggggatgagcactctgcagccgattaatctgttggtaggggcccagcttcttgggagtgcttattcagcccaagagtggaggctgtttacagcgagccctggagatggcagcttgtctccagctggggaggggtcaggcccctaaattgaagaccactttggtagcagaactgtagggactggtgagtcaactcacagattctgcagcagctgctccacccacaataaagcaaacgccgacaggctagaccccagattgcaggggctgccactacaaggtgggaccacaggctgcctcaccgggattgtttgccactaaatagctggagtcacagattgagataaatgccaccttcaaggttgcagtgaaaagcataatcctatgtgatgaatttatatgtgttattttttaaaaagctattttattactgcatgttcccgtcccgtcttgtgaatgtgagtccccgccaccacgtgaggtgcagtcgttgcagcggctggtgcaggagtgccactggcgcgtgtgtgatagcatctcgtaggtgttgctgcacaagagttaaccagagtcaatgccaaacacatagtatgagaagtgtactttttaagaaattaatttatttgagttcaaatatttttgaaatataaaaattggttgtattttttaaagctataattcttgtagacattctgtggttaaaaatttgattgtgcttattaaaaatggtcatctatgttttgcacttcagctacgtgaaaataaaatttctttgggaaggtgaaaaaaaaaaaaaaaaaa

SEQ ID NO: 1313 - DNA, 4818 bp, Homo sapiens
  misc_feature (3468)..(3468): n equals a,t,g, or c
gcgtccggagcgcccggcgcggagagcgcgggagcggagcagtagcccgatccggggccgcgggccgagctgccgatctttctcctggcctgccctccatgtcggggagctatcgtcgtcttcaagctacagatgcacatgttgaatggagctcttctggcattgctgtttcctgtggtaaacactcggctgctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttatttttttttttttcctccctgaggaagcaagtcgtgacttgacttggagaacacccagttcttgataaaatcatgggagagggcagtaggatgtttggtgtatttctttttcctcctttctgtccctttcttctaccactcttcctttcccagctcttccccctacgatgtctccttgagcctggggtgtagtgctgggcgctggattttcctccttccctttggctctctctctgctcctagtggccttacatggggagattgcagtgagcggctctttcactctgttgtcggtgctttaacaacagctggttgaggagaaagggaacaacaagtagtagttcttttggcatcgaagtaatgagattgggttgtgtttcatttctccactgccagggacctccaggcttatgctggcgtcccatttagtctccagcacagcccttaccacgggggactgaggccttgtttctataccagcggcaagcccagagccgagggatttcacagctcgtggtcaagacagaaccagccagattctggtcactggtgtcccctgactcaaagtaaacagccaaccagccactccctccaggatgctgcctggggtgggaggtgagagcaccacccagcccaagggctagattccattgagagggttggagatctattgcaatgacaaatccaaagtgaagagggtcaagatatatacagtactaggccagaccctgtgtaagttctgcctgtgagagttgagaactgatgcatatcccaatcagaagtgagcacagaaaactgtgatttgaatcatacactctgttttaggaaaatgttgataatagataccattttaatcttgagtgccccttaaatgtgttccctctccctttccctctccccccacccctccccctcccccctccctccctctttccctctctcaggcagcttcagggaagaatgagctggaattggctggttggttggtttttgagtttggagaatcctcgcatcagggcccatttctggaagattctgtagatctgtttcttggttttacagggccagtgttgattccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctcccttcccctgtcccactctaggcaacacagttgacctagaccagttccagtatttccagtttgaccgtgtttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatntggcccatcttcctcccaaaggcacaacagtaacatgttcctctgtcagcctgtgaaggcatgcagggttttgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaaaaaaaaaaaaaaaaaaaa

SEQ ID NO: 1314 - DNA, 3568 bp, Homo sapiens
gcagcttcccgaggctccgcaccagccgcgcttctgtccgcctgcagggcattccagaaagatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaatccagcattggaacttctgatcttcaagcagggattctcaacctgtggtttaggggttcatcggggctgagcgtgacaagaggaaggaatggrcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctyagactgccacccactgkccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacacc

SEQ ID NO: 1315 - DNA, 1437 bp, Homo sapiens
  misc_feature (1392)..(1392): n equals a,t,g, or c
ccacgcgtccgatggtttactgtgtagtctccccaagaagggccactctgttctgcgtactgctgttaggcacaagatgtgaaataatatctgtgaggtcttcatttggtgaatatgataaaatcaatagcattttaaagggtctcctaaaaataccatttaatgaattttaaaaattaatagtgaattattattattgagaacatttgttaaattagtgttttcttggtttggattggatgtaatgcataaacttcaaagatgtaaaaactgtatttaaaacattttttaaattttttgtagagatgggggtctcaccacgttgcctagggtggtctcgagctcttgggctcaagtgatcctcccacctcagcctccaaaagtgttagattacagtcctgagccatcatggacttaactatccttaattttgtatcacctatggagaacatgtattaactttgtaatwaaaaagttttwmkgcstkgtrywkcarytytttttttttttktaaaagggtttgaagkccaggcgcggtggctcacacctgtaatcccggcactttgggaggccgaggtgggcacatgacctgaggttgggggtttgagaccaacctgacmaamaaggagmwrsccmwkmtgtgstkaaaatamaaawttakcygggcacwggatgrcasrtrcctgyrrtcycagctacycggaaggctgagrcatggcaatcacttgagaccaggaggttgaggctacagcaaactatgatctggctrctgcactccatcctgggcaacaagagcraagactctgtctcaaaaaaaaaaaaaaaaaaaaaagtcttctgtattttgtataaattggtggtggttggatctagaggcttgagcacagatgatttaatgagatcagtttccaggtttgcagattcacaaacctttgttctcttaaattcttcttctttcttctcttttttggagacagagtcttcctctgtcaccaggctggagtgtagtggcacaatcaaggcttattgcagcctctacctcccaggctcaagaaatcctcccaccttagcttcttaaatagctgggactacaggcgcacgccaccaccatgcctggctaatttttgtaattttttgtagagacatgatttcaccatgttgcttaggctggtctcaaactcctgagctcaagcagtctgcctacctgggcctcccagagtgctggaattacaggcgtgagccactgtgctggctgttcttttaactttttaagttggcctgagaaagcttgcagagccttattctccagatgtctctttttacaattattcttctaactgccaaaagaagtaagaagtctcccgttttactgtgttgtatttcaattttttntttttttttaaaagggtttgaagtccaggcgcggtggctcacacc

SEQ ID NO: 1316 - DNA, 2175 bp, Homo sapiens
ccacgcgtccgcccatgccgaggtgagtccgcgggagccgccgccgccgccgtcccgtcccagctgccgccccgcgcggccccgccgccggccaggatgctggaggaagcgggcgaggtgctggagaacatgctgaaggcgtcttgtctgcctctcggcttcatcgtcttcctgcccgctgtgctgctgctggtggcgccgccgctgcctgccgccgacgccgcgcacgagttcaccgtgtaccgcatgcagcagtacgacctgcagggccagccctacggcacacggaatgcagtgctgaacacggaggcgcgcacgatggcggcggaggtgctgagccgccgctgcgtgctcatgcggctactggacttctcctacgagcagtaccagaaggccctgcggcagtcggcgggcgccgtggtcatcatcctgcccagggccatggccgccgtgccccaggacgtcgtccggcaattcatggagatcgagccggagatgctggccatggagaccgccgtccccgtgtactttgccgtggaggacgaggccctgctgtctatctacaagcagacccaggctgcctccgcctcccagggctccgcctctgctgctgaagtactgctgcgcacggccactgccaacggcttccagatggtcaccagcggggtacagagcaaggccgtgagtgactggctgattgccagcgtggaggggcggctgacggggctgggcggagaggaccttcccaccatcgtcatcgtggcccactacgacgcctttggagtggccccctggctgtcgctgggcgcggactccaacgggagcggcgtctctgtgctgctggagctggcacgcctcttctcccggctctacacctacaagcgcacgcacgccgcctacaacctcctgttctttgcgtctggaggaggcaagtttaactaccagggaaccaagcgctggctggaagacaacctggaccacacagactccagcctgcttcaggacaatgtggccttcgtgctgtgcctggacaccgtgggccggggcagcagcctgcacctgcacgtgtccaagccgcctcgggagggcaccctgcagcacgccttcctgcgggagctggagacggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgttcacagagcagatgcagatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctacgaccagctgaagcaagtgatgaatgcgtacagagtcaagccggccgtctttgacctgctcctggctgttggcattgctgcctacctcggcatggcctacgtggctgtccagcacttcagcctcctctacaagaccgtccagaggctgctcgtgaaggccaagacacagtgacacagccacccccacagccggagcccccgccgctccacagtccctggggccgagcacgagtgagtggacactgccccgccgcgggcggccctgcagggacaggggccctctccctccccggcggtggttggaacactgaattacagagcttttttctgttgctctccgagactggggggggattgtttcttcttttccttgtctttgaacttccttggaggagagcttgggagacgtcccggggccaggctacggacttgcggacgagccccccagtcctgggagccggccgccctcggtctggtgtaagcacacatgcacgattaaagaggagacgccgggaaaaaaaaaaaaaaaaaaaaaaaaaaaaaaaaaaaaaaaaaaaaa

SEQ ID NO: 1317 - DNA, 1356 bp, Homo sapiens
ggtcattaagtcctagtctcattaattgttttcaagcttttcgcctacattttagactaaccctgcttattcctgtgaatcaagtagtgatctcctgcagcttggaagaaaaaataagggatgggtaatgtaaaaatctggatcaatatactggttctgggcaattatcctgcaaattctgccaggtaataaaagtgagtagggtgcccataatccggaagtttctttgtttaggaaaataaaaacaaggaacttcatagacccccccaaaggggaattctatatcttgacaagtaaaattttagatggaaattatctacaacaccacacttacggaaattgctatcctcactctattatttgcaaaagggttatacacagtagcaccttctaactgaagtattaaacagagtttccattgctgtcgtattttgcttaattattatccttatagcagggataatagttactaacaaaaaggaagcatgaaagttttactatcactgagcctggtaggactttttattgggtttagtgatgcagttttaaatgaaacatgccgcttttggattaatacctctagtaaaggaaatttacagatacttaaaaatcaaatccaaattattgataggctcaggaaaatgccagcttcagcctgagtggctacaaacctctttaataaattccagtcttcttatggattggttaacgccttattaagccctctcttgcttatatgtcttgtattgatatttggactctgtatatacaatactataactcgaattgtttcttctcgcctagaagcaatcaaactccaaatggtgctgtaaactgaaccacacatggacaggccattcttccgaggacccttagattgatcccaggggagccctagctgctattccccattcacgcccttttcagcaggaagtagccagaaggagtcgccgcccaaaatcccctaacagcagttagtgtggcatctccacaggaagtaatgttgtaggagttactaagaaattattttaggcagatagagaggaaaaggggtccttgggaagttttcattttttaaagcatctctggaaaagtttcttgtaaagccccggctcttagagccaggctggcaacctttgatatgcaaatgtaagccattagaaaccaggtccacccaggccaggtgtggtgctcacgcctgtaatcccaacactttgggaagcctaggcaggtggatcacctgaggtcaggagttcgagaccagcctggccaacatggtgaaaccccgcctctaataaaaacacaaaaaactaaaaaaaaaaaaaaaaaaaaaaaaaaaaaaaaaaaaaaaaaaaa

SEQ ID NO: 1318 - DNA, 2908 bp, Homo sapiens
  misc_feature (1653)..(1653): n equals a,t,g, or c
  misc_feature (1655)..(1655): n equals a,t,g, or c
  misc_feature (2850)..(2850): n equals a,t,g, or c
gagctctagactgatcgtagtaagttttgtgacttaacaatgaaagaaagtagaaagatgctttgggttttcaaaatgttgttttttaaaattgttctttgggtgaatttactcagtgctgctttgagttgtatacagaaacaaatgttgggaattgctcctcagaaatgtgttcctaagttgtgttttcaactttacatcatgaggtgaagcattagggaaagagattctttcgatttgtttaataatctaattatacagaccaaagtgctttacgtttctgctctatgttaatgttttagaatggtgattttgctgattaatttagacctggcaattgaaataatgtgctcagaataataacatggttatagttcttgtatgataaagtattcaatttcagaatagtgttggaatcctgagtttgaataatgtgttgtatttagaaacatagccctatctgttttaaacaaataatttgttggccgattgtccatggttgagcatgacaaaaatacctcgtcgaaaggcaagcttaggtaactgctggcaaaacactgggtgcactatttttctggataaaatttatagttattttctatattacccttcaaaagggatctcttcaggttaaaaatcacgcttatgctgaagtctttatctggtgttaactaaaaatctcatatgggttcataaccgaggtcactaataattcatttttatcacttgtaaaaatttgctcaaaattccaaaaaaatattgatttgttttttagtgattttgcaggctgaccccaacctaagttttgataacatctggtaagtcagtatagttctgtgacttcatgttttaactaagaaggaaaattcatagatattcctattagattttataaaccttcaaaagtctgaaacttaattttgagtctaaattttctgacactggccccttttaatattgtaagtttttgttcactttcttaagtaaaaaaaacatttaattactagttagcccttaactgggaaactcaggtaatgaactgctgacttttctaaagttctttaactgatcaattctgtatagagggatatttatctaaccactttccgtattttacaagtgctctttctaaaaaggaataactattatagctctatttccccaatctctataggactcatgagagattgcttgtgtaaatataaaagcaccatatgtgttcttaactcctatggctgcttgaagctcatgatgaaaaagtctttttgtcagttttaattgttaagtacagaacaaacaattgtttggtgatggcctggttgaaagagagcatataaatatatcccagtggaactcaccaaagaagaccacacctcagaaattattgcattttctcattatgtgttgggtttgatttgcttttgtttttaatgcagctcttttaatataaagattcttgatacagtgaaatctcttatttcaagtgtaagttattcttcacccaccccttcccctgccattgtatttcccatctgtttcaaggagtttcaacaatttacattgcatcgtatgcagtaggtactgctttttcagaaagacctggaaaacatacctgctatgaatattttgttcagatgtagccatttacctggntntcaaggttgccttctgtggagaggatcttagacaaaaatcttccttgtatttacttgggttaagtgaagtccaaattcttacagtatgctatttcaggatttctgatattaaaaaagaaaaaacaaaatctttatatctcttattaacacttcccccaagaagggttgtgctgttatttattttctattataagaaaagttcattctttaagtagtttcttttacctctaatctaatttcataccaaatacctgatcaatagaaatgatatatttaagcagcaaagattcctaatccatcattatgaaaagtgtcagcatacttagtagtgaacagataaagtcaatttgaatataattccactttgtttttagagactaaattaagattcaattaacattatcctatgaattctgaatgtgataatgtgattcaaacagtcaaattttattaagctcttagtaactcaggatagcattccatactaacctcaagttagcaaaacaaattagttaaacagcttggttcttagcagactgcttaaaagatcaagaaaattttctcatcttttctttctacttagaaacattgcaagaaaccttggacagtcttcaccagacctgccatgattttataagatttaggcctcagtgacatgctcctgaaagtttcctgccagccatccaaactaagcatccactcattccatcttcccaaagtcactcaccgataaaggtagcatccttaagttcatttttgaaaggtggaggaggatctccccctgcccaaaggaatttttttatcagaataccttgaaaggggggtatataaatttggaaaacttaatttcttggctgtgtttgataacagttcctatgcatggtttttaatgtgaggtaaatttgtttctttcttcagaatacctctctccaccccccaccttattcttcctctttaatgaatatttttattggagctcaaactccatgacttacgtgctcactaagttttcttttttccccttgtttactctgtctgtatgtatgtcaaaagctggcaaaacctctaaaactgtcaagaaaatgcttgaaagttgatttgtcatagtgcaaattcatgataaaatgtcttaatgttatttggatatgtagtacatagaaacagaaaaataaagtcatttttataacttaaaatnaaaaaaaaaaaaaaaaaaaaaaaaaaaaaaaaaaaaaaaaaaaaaaaaaaaaaaaaaa

SEQ ID NO: 1319 - DNA, 978 bp, Homo sapiens
  misc_feature (2)..(2): n equals a,t,g, or c
  misc_feature (27)..(27): n equals a,t,g, or c
angagttgcatgcaagsgtaagttggncccytsgrggatctttagagcggccgccctttttttttttttttgcatgtctgagtttgtggaataagattcatatttactacaagtaatggaattggagattcagaggggagaaagtcacttatcacattagtgtaattttctgatggtaggattatggagagttttaggttttccctttttttccccaacttctctcccctcagtattttaaaaataacattgtgtgggttgtttttttttgtttttgattgttttttgtttttcaaacaggtctcactcctatccatgtaggctagagtgcagtagtgcaatcttggctcactgcagcctcgacttcctgagctcaggtgatcttcccacctcagtctcctgagtagctgggactccaggtgtgtgccaccatgcctggctaaatttttgtatttttattagatacagggtctcaccatgttgcccagactggtcttgaactcctgggcctgcccacctcagcctcccaaagtgctagaattacaggcatgtgccaccatatccagcctaataacattgtttttaatgttcattaagtcatcccaccctctcagtcttgcagaagcctctcaagagggacagaatcagttgcaaagtaccatttctgaccctgagacatggatattatttgttcatttaaatgtcacctgaaaaacccactcactcaaatggtctgtgaagcttgcaaaaacaggaatgcttaccctcctgggtcctgaatttttggttctcttggactctttgaaattcttctttctcagaaaggagccctctttctatttcccctcaaagttgtgacttgaccctcacatccctttcttctccagggccccttgataagattcttttaaaatttctttggagggcatcccttttaggaagacggacgcgtgggtcgaccgggaattccggacggta

SEQ ID NO: 1320 - DNA, 1262 bp, Homo sapiens
gaaaaaaacaaacaaaacaaaaacatactacatggtgttctttacttgtctgtggtttttaaatgaacatatattagtatgcaattgtagtaatgtttcactttgttattctctacctcttaaagaaaaaattaccttcttttacaatctaacacactacttttttaacaggtgttttaagcatctgtttgtatttgttgaacaaatatttcttaacattgtatataccaggaacctaattgtatacttttcagagttaaactatgcaatctgttcttcagtaaatgaagctttgaccgtgcagtcaaatccattaaaagttcttccatgggaaattaggagagtttcaaactcacagtgtcttagtttgatttctgttccttataacaatacctgaaactgggtaattaataaagaaaaggaatttatttctttgttatggaggctgggaagtctaaggtcaaagggtggcatctgtgagagccttcttgctggtggggactctgcagtgtcctggggcagcgcaggcactacatggtaagggggtaagtgagctagtgtgttcgcccaggtctgtcttcctcatcttatgaagccaccagttctcttcctgtaataatccattaatccactaatccattgagggactgatggcagagctctcatgatccacgttgaggattaagtttcaacatgagttttggaggggacatttaaaccatagcacatagtaacaaagctactttttcttacaggaatttcagtaatcagagatttggggggaagctatgtggctattattataaaactgagttctaacagggcaaatccagagttgaattacttctaactctggtaccacagcagttgcctttttttcaccactaacaaactttcttaaatatacgtacgaaatatttaaagcaccagccaccccaacaaagagctgcttatggctgggcgtggtgctgacgcctgtaatcccaacagtttgggaggctgaggcaggtggatcacctggtcaggagatcgagaccatcctggctaacacagtgaaaccccatctctactaaaaatacaaaaaattagccgggcatggtggtgggcgcctgtagtcccagctactcagagaggctgaggcaggagaatggcgtgaacccaggaggcggagcttgcagtgagccaagatcgtgtcactgcacttctgcctgggcgacagagcaagactctgtctcacaaaaaaaaaaaaaaagggcggccgc

SEQ ID NO: 1321 - DNA, 3798 bp, Homo sapiens
ccacgcgtccggggcttcatacaggaaatctattgctgtgtcaagttccagagaaaagcttctgttcgtccaagttactaaccaggctaaaccacatagacgtgaaggaaggggctagaaggaagggagtgccccactgttgatggggtaagaggatcctgtactgagaagttgaccagagagggtctcaccatgcgcacagttccttctgtaccagtgtggaggaaaagtactgagtgaagggcagaaaaagagaaaacagaaatgctctgcccttggagaactgctaacctagggctactgttgattttgactatcttcttagtggccgaagcggagggtgctgctcaaccaaacaactcattaatgctgcaaactagcaaggagaatcatgctttagcttcaagcagtttatgtatggatgaaaaacagattacacagaactactcgaaagtactcgcagaagttaacacttcatggcctgtaaagatggctacaaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgatgagagaataacctgggtctccagacctgatcagaattcggaccttcagattcgtaccgtggccatcactcatgacgggtattacagatgcataatggtaacacctgatgggaatttccatcgtggatatcacctccaagtgttagttacacctgaagtgaccctgtttcaaaacaggaatagaactgcagtatgcaaggcagttgcagggaagccagctgcgcatatctcctggatcccagagggcgattgtgccactaagcaagaatactggagcaatggcacagtgactgttaagagtacatgccactgggaggtccacaatgtgtctaccgtgaactgccacgtctcccatttgactggcaacaagagtctgtacatagagctacttcctgttccaggtgccaaaaaatcagcaaaattatatattccatatatcatccttactattattattttgaccatcgtgggattcatttggttgttgaaagtcaatggctgcagaaaatataaattgaataaaacagaatctactccagttgttgaggaggatgaaatgcagccctatgccagctacacagagaagaacaatcctctctatgatactacaaacaaggtgaaggcatctgaggcattacaaagtgaagttgacacagacctccatactttataagttgttggactctagtaccaagaaacaacaacaaacgagatacattataattactgtctgattttcttacagttctagaatgaagacttatattgaaattaggttttccaaggttcttagaagacattttaatggattctcattcatacccttgtataattggaatttttgattcttagctgctaccagctagttctctgaagaactgatgttattacaaagaaaatacatgcccatgaccaaatattcaaattgtgcaggacagtaaataatgaaaaccaaatttcctcaagaaataactgaagaaggagcaagtgtgaacagtttcttgtgtatcctttcagaatattttaatgtacatatgacatgtgtatatgcctatggtatatgtgtcaatttatgtgtccccttacatatacatgcacatatctttgtcaaggcaccagtgggaacaatacactgcattactgttctatacatatgaaaacctaataatataagtcttagagatcattttatatcatgacaagtagagctacctcattctttttaatggttatataaaattccattgtatagttatatcattatttaattaaaaacaaccctaatgatggatatttagattcttttaagttttgtttatttcttttaagttttgtttgtggtataaacaataccacatagaatgtttcttgtgcatatatctctttgtttttgagtatatctgtaggataactttcttgagtggaattgtcaggtcaaagggtttgtgcattttactattgatatatatgttaaattgtgtcaaatatatatgtcaaattccctccaacattgtttaaatgtgcctttccctaaatttctattttaataactgtactattcctgcttctacagttgccactttctctttttaatcaaccagattaaatatgatgtgagattataataagaattatactatttaataaaaatggatttatatttttggtcatgtttgtaagagagtgaatgcacgtgtgagaacattagcttcttctgaactcattatatctccacagaggtgttgatacttgatgcctaacagttttgcagatgtgctacattggaattgtgtatttttatggtgtacattctattgtgatatatttattgaataattaatgtctattgaccatataagtggcgaaaaatgcaccatagaggacatggggtatttatttacaaactatgagctacataataagcaagtggccatgggatggcatgaccctcccctccatatttttgtggagcaaaatattggcaatgtttatgtaaatcattgttaatatcatgaaattatttttaattaaaaacataagtctatttgctccatagcagaaaaaacatgagaagttttttcatcatgatagaaattgaaacaaaatatattcattcttcaatcataccatctgagatttttaagacagctattttgtcttataagtatatttttctccctctagacatttcagttactatggattttgtcctcaaagggacctttagtctattttggatgtaaagctaatctaatgacacttggcacatgatattttgatcaagccattttgacttgaccaaaaagcagtgtccattaggtttctgcatataaatattaccaagcaatgttcacaatagacatcattacactgtccttgaaatttattaattcttcatccaaccctggttgagctgaggctcatagttaggttcaagactatctgtttaaatattactgaaaaacaaagtaagacagtactatgcttacctcttaacttgataatgtcaaaacaggcatgttaaatgacatcatagaaaagacttcaagataatttatagaagttaaattatattgtacagaaaataattgtatgaaaatctctactatggggctggaacatggttgaacattagaatgatataaaaaattatatatattctccaaatccacgctagacctgtcaaattagagaatctagagattagacctggcgtgtcagcaaggtcatccaggaagcagaggctgagacggagttaggtgtgattacttacatagtcgattacattttacaaataacattttatatgtctcatttactgtgctttctccccatcccattttgtatcttttcctttgctttgctagatttgtcaattttctctctctttctgtctctctctctttcaatatctctaataatttgaaagtaattcatcataactaaatatctattggggttatgcttcacttacaaacttctgaaaacggctttactgagatataattgatatatttaagtgtacagtttgttaaattttgcacatatttaaaatgtggactttggtaaatgttgacatagttttacatctgtgaaaccatcagcataatcaagataataaacttgtccatcaccccccaaaaaaaaaaaaaaaaaaaaa

SEQ ID NO: 1322 - DNA, 4415 bp, Homo sapiens
ctctagctctcagcggctgcgaagtctgtaaacctggtggccaagtgattgtaagtcaggagactttccttcggtttctgcctttgatggcaatttccttcggtttctgcctttgatggcaagaggtggagattgtggcggcgattacagagaacgtctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggtttatacaacaaccagatcaccgatgtcggagccaggtacgtcaccaaaatcctggatgaatgcaaaggcctcacgcatcttaaactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaacgatgaagtggcagagagtttggcagaaatgttgaaagtcaaccagacgttaaagcatttatggcttatccagaatcagatcacagctaaggggactgcccagctggcagatgcgttacagagcaacactggcataacagagatttgcctaaatggaaacctgataaaaccagaggaggccaaagtctatgaagatgagaagcggattatctgtttctgagaggatgctttcctgttcatggggtttttgccctggagcctcagcagcaaatgccactctgggcagtcttttgtgtcagtgtcttaaaggggcctgcgcaggcgggactatcaggagtccactgcctccatgatgcaagccagcttcctgtgcagaaggtctggtcggcaaactccctaagtacccgctacaattctgcagaaaaagaatgtgtcttgcgagctgttgtagttacagtaaatacactgtgaagagactttattgcctattataattatttttatctgaagctagaggaataaagctgtgagcaaacagaggaggccagcctcacctcattccaacacctgccatagggaccaacgggagcgagttggtcaccgctcttttcattgaagagttgaggatgtggcacaaagttggtgccaagcttcttgaataaaacgtgtttgatggattagtattatacctgaaatattttcttccttctcagcactttcccatgtattgatactggtcccacttcacagctggagacaccggagtatgtgcagtgtgggatttgactcctccaaggttttgtggaaagttaatgtcaaggaaaggatgcaccacgggcttttaattttaatcctggagtctcactgtctgctggcaaagatagagaatgccctcagctcttagctggtctaagaatgacgatgccttcaaaatgctgcttccactcagggcttctcctctgctaggctaccctcctctagaaggctgagtaccatgggctacagtgtctggccttgggaagaagtgattctgtccctccaaagaaatagggcatggcttgcccctgtggccctggcatccaaatggctgcttttgtctcccttacctcgtgaagaggggaagtctcttcctgcctcccaagcagctgaagggtgactaaacgggcgccaagactcaggggatcggctgggaactgggccagcagagcatgttggacaccccccaccatggtgggcttgtggtggctgctccatgagggtgggggtgatactactagatcacttgtcctcttgcccgctcatttgttaataaaatactgaaaacaaaaaaaaaaaaaaaaaaaaaaaaa

SEQ ID NO: 1323 - DNA, 3099 bp, Homo sapiens
ccacgcgtccgggaagccgccggctggtcccctccccgcggcgcctgtagccttatctctgcaccctgagggccccgggaggaggcgcgggcgcgccgggagggaccggcggcggcatgggccgggggccctgggatgcgggcccgtctcgccgcctgctgccgctgttgctgctgctcggcctggcccgcggcgccgcgggagcgccgggccccgacggtttagacgtctgtgccacttgccatgaacatgccacatgccagcaaagagaagggaagaagatctgtatttgcaactatggatttgtagggaacgggaggactcagtgtgttgataaaaatgagtgccagtttggagccactcttgtctgtgggaaccacacatcttgccacaacacccccgggggcttctattgcatttgcctggaaggatatcgagccacaaacaacaacaagacattcattcccaacgatggcaccttttgtacagacatagatgagtgtgaagtttctggcctgtgcaggcatggagggcgatgcgtgaacactcatgggagctttgaatgctactgtatggatggatacttgccaaggaatggacctgaacctttccacccgaccaccgatgccacatcatgcacagaaatagactgtggtacccctcctgaggttccagatggctatatcataggaaattatacgtctagtctgggcagccaggttcgttatgcttgcagagaaggattcttcagtgttccagaagatacagtttcaagctgcacaggcctgggcacatgggagtccccaaaattacattgccaagagatcaactgtggcaaccctccagaaatgcggcacgccatcttggtaggaaatcacagctccaggctgggcggtgtggctcgctatgtctgtcaagagggctttgagagccctggaggaaagatcacttctgtttgcacagagaaaggcacctggagagaaagtactttaacatgcacagaaattctgacaaagattaatgatgtatcactgtttaatgatacctgtgtgagatggcaaataaactcaagaagaataaaccccaagatctcatatgtgatatccataaaaggacaacggttggaccctatggaatcagttcgtgaggagacagtcaacttgaccacagacagcaggaccccagaagtgtgcctagccctgtacccaggcaccaactacaccgtgaacatctccacagcacctcccaggcgctcgatgccagccgtcatcggtttccagacagctgaagttgatctcttagaagatgatggaagtttcaatatttcaatatttaatgaaacttgtttgaaattgaacaggcgttctaggaaagttggatcagaacacatgtaccaatttaccgttctgggtcagaggtggtatctggctaacttttctcatgcaacatcgtttaacttcacaacgagggaacaagtgcctgtagtgtgtttggatctgtaccctacgactgattatacggtgaatgtgaccctgctgagatctcctaagcggcactcagtgcaaataacaatagcaactcccccagcagtaaaacagaccatcagtaacatttcaggatttaatgaaacctgcttgagatggagaagcatcaagacagctgatatggaggagatgtatttattccacatttggggccagagatggtatcagaaggaatttgcccaggaaatgacctttaatatcagtagcagcagccgagatcccgaggtgtgcttggacctacgtccgggtaccaactacaatgtcagtctccgggctctgtcttcggaacttcctgtggtcatctccctgacaacccagataacagagcctcccctcccggaagtagaattttttacggtgcacagaggacctctaccacgcctcagactgaggaaagccaaggagaaaaatggaccaatcagttcatatcaggtgttagtgcttcccctggccctccaaagcacattttcttgtgattctgaaggcgcttcctccttctttagcaacgcctctgatgctgatggatacgtggctgcagaactactggccaaagatgttccagatgatgccatggagatacctataggagacaggctgtactatggggaatattataatgcacccttgaaaagagggagtgattactgcattatattacgaatcacaagtgaatggaataaggtgagaagacactcctgtgcagtttgggctcaggtgaaagattcgtcactcatgctgctgcagatggcgggtgttggactgggttccctggctgttgtgatcattctcacattcctctccttctcagcggtgtgatggcagatggacactgagtggggaggatgcactgctgctgggcaggtgttctggcagcttctcaggtgcccgcacagaggctccgtgtgacttccgtccagggagcatgtgggcctgcaactttctccattcccagctggtccccattcctggatttaagatggtggctatccctgaggagtcaccataaggagaaaactcaggaattctgagtcttccctgctacaggaccagttctgtgcaatgaacttgagactcctgatgtacactgtgatattgaccgaaggctacatacagatctgtgaatcttggctgggacttcctctgagtgatgcctgagggtcagctcctctagacattgactgcaagagaatctctgcaacctcctatataaaagcatttctgttaattcattcagaatccattctttacaatatgcagtgagatgggcttaagtttgggctagagtttgactttatgaaggaggtcattgaaaaagagaacagtgacgtaggcaaatgtttcaagcactttagaaacagtacttttcctataattagttgatatactaatgagaaaatatactagcctggccatgccaataagtttcctgctgtgtctgttaggcagcattgctttgatgcaatttctattgtcctatatattcaaaagtaatgtctacattccagtaaaaatatcccgtaattaaaaaaaaaaaaaaaaaaaaaaaaaaaaaaaa

SEQ ID NO: 1324 - DNA, 2338 bp, Homo sapiens
  misc_feature (3)..(3): n equals a,t,g, or c
  misc_feature (6)..(6): n equals a,t,g, or c
  misc_feature (9)..(9): n equals a,t,g, or c
  misc_feature (11)..(12): n equals a,t,g, or c
  misc_feature (17)..(18): n equals a,t,g, or c
  misc_feature (21)..(21): n equals a,t,g, or c
  misc_feature (23)..(23): n equals a,t,g, or c
  misc_feature (25)..(34): n equals a,t,g, or c
  misc_feature (37)..(38): n equals a,t,g, or c
crnatndwndnnsdaynnctnbnrnnnnnnnnnnamnntacggtgggaggtctatataagcagagctctctggctaactagagaacccactgcttactggcttatcgaaattaatacgactcactatagggagacccaagcttgatatcgaattcgcggccgctcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaagactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacagccctgactcagaagcctgatgtctacatccccgagaccctggagcccgggcagccggtgacggtcatctgtgtgtttaactgggcctttgaggaatgtccacccccttctttctcctggacgggggctgccctctcctcccaaggaaccaaaccaacgacctcccacttctcagtgctcagcttcacgcccagaccccaggaccacaacaccgacctcacctgccatgtggacttctccagaaagggtgtgagcgtacagaggaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactactccccgaagctgctgggcccctcctgctcctgggaggctgagggtctgcactgcagctgctcctcccaggccagcccggccccctctctgcgctggtggcttggggaggagctgctggaggggaacagcagccaggactccttcgaggtcacccccagctcagccgggccctgggccaacagctccctgagcctccatggagggctcagctctggcctcaggctccgctgtgaggcctggaacgtccatggggcccagagtggatccatcctgcagctgccagataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaag

SEQ ID NO: 1325 - DNA, 607 bp, Homo sapiens
tcgacccacgcgtccgcccacgcgtccgcttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctctcctgtggtttcaaattattaaacacacttccatttctcttggaaaaaaaaaaaaaaaaaaaaaaaaaaaagggcggccgc

SEQ ID NO: 1326 - DNA, 2006 bp, Homo sapiens
cccacgcgtccgcggacgcgtgggattttctcttaagaaaaaaaaaggaagacgttttaataggaaaagaaaaacaagaagcagtagcagctaggtaatttaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactggaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcaaaaaaaaaaaaaaaaaaaaaaaaaaaaaaaaaaaagggcggccgctctagaggatccc

SEQ ID NO: 1327 - DNA, 1731 bp, Homo sapiens
gagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgccccgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaaaaaaaaaaaaaaaaaaaaaaaaaaaaaaaaaaaaaaaaaaaaaaaaaaaaaaaaaaaa

SEQ ID NO: 1328 - DNA, 3070 bp, Homo sapiens
gttggagccttagaccttcgaagtgacctatagaaggtacgcctgcaggtaccggtccggaattcccgggtcgacccacgcgtccgcaacgtatgaggagtctgatttcttcacatccttgtcaacatttgttgttgttgttgttgttgttgtttttaattttagctatcctagtagatgtgaagtggtatctcgtgctttttatttgcatttctctaatgactagtgatgttgaacatcttttcatgtgcttgttggccattcgtatatcttcttggagaaatgtctattaagtcctttgcccaatttcaaattggcttgtctttttgttgagttataaccattgaattttaattgctgtaaaacactccatgagtacatgtagcatgcactcaataactattagctaatactatagttgtaattatttttgccacatgtggcctgaattggaaggaaattgcctagtttttccaagtaggagtggagatgtaacaaaacctgtatttaaggccaataaagatttgactctgtcagtgttgatactttgcttttaattgatgctcccaaatcaagaaattagaaacgtgtatacataagaatcagtttatctttggcagaaatcagtatattatcaatgtttaattaattcctaagaattaatggcaatagtgcctctagttttagctgagatttagatcatctttcttcattctgccctgttatgcgacatttgctataaatgccacaatgagaattttttgaaacctgggtcagagaagcctactttttatatttaataagtatgtgattgatgtattatcattggtttatgcttattgcatcttggttttatggggtgttcaaaagaagatagatgagaataggtgatccaaagtaatttagaattttatcctccagttgggactgaaccatcttgaactgatgaatatattctaccaggtttataggtagatatgccgtttcattatatcggtgatttggagtgagacagtagcttttaagcagaacaacagccatatgtaagtctaaatttggttattttctttgaataagcaatggaaactgtatgcattcaggaactggtgattcagatatcttctgaaggccctctctcccctgtgctcccacagcttttgtcctgaactctcctgtctccttgcgatgcctctgtgcctatacctattttgtgaactctgcctgcaatgccgtcccaagtcagttggtgactcctcaaacctcactgaagtctttcggggtggattcaaatgctgcttttagccattaaaatctgttacatctgttacatactttcacaatagcacttatcctagtgtagttttaaaaatgcacttaaaaatttttaaagcagtgcatgcatgcagtaaacaaaattggacagtacagaaataaatggtgaagacagtctcccagttttcttccccatggatagcactttctcttttttatccttccaaagatattttgtgctgatacaagaatttttataccgtatgaagtgcttattcatcttatcttttacttcagggtaatttatgagtaatgaaaaaattcaagcattacaaaaatgtagagtgtgtgaagcaaaaggtcccctttactttgatccctaacactagccctttccaaataacactgtcctaattaacattcctctctccagaagtaacctctgttataagccttgtctgtgccttcagattgttctgcttacacttatatgcctatttaaaagtgtatatttttgtattttgtttgtttgtttgtttgagacagagtttcgctcttgttgcccaggctgaagtgcaatggcactatctctgctcactacaacctgtgtctccctggttcaagtgattctcctggctcagcctcctgagtagctaggattacaggtgcacgccaccatgcccggctaatttttgtatttttagtagagatggagtttcaccatgttggccaggctggtcacgaactcctgacctcaggttatccacccaccttggcctttcaaactgctgggattacaaggcatgagccactgtgcccggccaagaatttttttatcgataccatagtgagctctctgcctcttcggaacgatgtccactttgcttatgatcaacccaagcaggactcttctctccctggacgcctctcccctggtctggaatcttccagttctgccagaattggcctttcccagatgctgcaaacttccagttgaacccctttttctgtgtggcccctggggctgcgagaccaaaatccatgagttctgtgtaccctagacctttggaaggtgagagcagggccctgagaaaaggcaaaacgcctcctctccctgatgatacccctacccgccctactcctcaccagaattgtcagtggcctttcaccacagtggtccttcctgcctgagccctgcactgtcccagaccacacagaagtctggtcacctctgggcgcctgggatggtcaccgaagagaagcacgctgtccccgtcttctcctggcttctgccagaaaatcgaacaagtgcaattaacacactgttactgccgaagcctgaaactcccaggacttgtccttgatccttccagaaaccaccaggtccggcacttggagccccccggagagggacctcccagccgagccctcaaagaactccatgaaatcaggaactgcttgatgaaatgtatctccttgtacctggaagatgaagcccaaacacccacacctctgtctcccccagggctcgggatgtctccagcagcccggccacgcagcttcccaggtgggctcggggaggtgggagcagggaccatctctgtcccctccaccctcactccatccacctcggagaccaccctcccccagccagatacggaataaaactacagacgcagaaaaaaaaaaaaaaaaaaagggcggccgctctagaggatccctcgaggggccccagcttacgcgtgcatgcgacgtcatagctctctccctatagtgagtcgtattataagggagcaaa

SEQ ID NO: 1329 - DNA, 3436 bp, Homo sapiens
aattcccgggtcgacccacgcgtccgctcgctgcggcggcgactgagccaggctgggccgcgtccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcctggacctgctggcacagggcaacgcatccctgaggctgcagagcgtgcgtgtggcggacgaagggcagcttcacctgcttcgtgagcatccgggatttcggcagcgctgccgtcagcctgcaggtggccgctccctactcgaagcccagcatgaccctggagcccaacaaggacctgcggcccgggggacatggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcactgctccttctcccccgagcctggcttcagcctgacacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacatttcccccagaggccctgtgggtgaccgtggggctctctgtctgtctcattgcactgctggtggccctgcctttcgtgtgctggagaaagatcaaacagagctgtgaggaggagaatgcaggagccgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgcctttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcccggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1330 - DNA, 5330 bp, Homo sapiens
ccacgcgtccggttaagaaatagtcgatcagttgaggagtagaggagtgaagaccttggaaagttgccaaaagcctcgagaatttctctacatgtgtgacatgttctcaggactcaactttttcttttaggtttggaagacccgcagaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttagatattttggcagttcaagagggaaagcattttcactcacataaccaccagcattcccataatcatttaaattcagaaaatcaaactgtgaccagtgtatccacaaaaagaaaccataaatgtgatccagagaaagagacagttgaagtgtctgtaaaatctgatgataaacatatgcatgaccataatcaccgcctacgtcatcaccatcgtttgcatcatcatcttgatcataacaacactcaccattttcataatgattccattactcccagtgagcgtggggagcctagcaatgaaccttcaacagagaccaataaaacccaggaacaatctgatgttaaactaccgaaaggaaagaggaagaaaaaagggaggaaaagtaatgaaaattctgaggttattacaccaggttttccccctaaccatgatcagggtgaacagtatgagcataatcgggtccacaaacctgatcgtgtacataacccaggtcattctcatgtacatcttccagaacgtaatggtcatgatcctggtcgtggacaccaagatcttgatcctgataatgaaggtgaacttcgacatactagaaagagagaagcaccacatgttaaaaataatgcaataatttctttgagaaaagatctaaatgaagatgaccatcatcatgaatgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccattctcagggtggacatgatcacagtcaccaacatgcacatgggcatggacattctcatggacatgaatctaacaagtttttggaagaatatgatgctgtattgaaaggacttgttgctctaggaggcatttacttgctatttatcattgaacactgcattagaatgtttaagcactacaaacaacaaagaggaaaacagaaatggtttatgaaacagaacacagaagaatcaactattggaagaaagctttcagatcacaagttaaacaatacaccagattctgactggcttcaactcaagcctcttgccggaactgatgactcggttgtttctgaagatcgacttaatgaaactgaactgacagatttagaaggccaacaagaatcccctcctaaaaattacctttgtatagaagaggagaaaatcatagaccattctcacagtgatggattacataccattcatgagcatgatctccatgctgctgcacataaccaccacggcgagaacaaaactgtgctgaggaagcataatcaccagtggcaccacaagcattctcatcattcccatggcccctgtcattctggatccgatctgaaagaaacaggaatagctaatatagcctggatggtgatcatgggggatggcatccacaacttcagtgatgggctcgcaattggtgcagctttcagtgctggattgacaggaggaatcagtacttctatagccgtcttctgtcatgaactgccacatgaattaggagattttgcagttcttcttaaagcaggcatgactgtaaagcaagcaattgtatacaacctcctctctgccatgatggcttacataggcatgctcataggcacagctgttggtcagtatgccaataacatcacactttggatctttgcagtcactgcaggcatgttcctctatgtagccttggtggatatgcttccagaaatgttgcatggtgatggtgacaatgaagaacatggcttttgtcctgtggggcaattcatccttcagaatttaggattgctctttggatttgccattatgctggtgattgccctctatgaagataaaattgtgtttgacatccagttttgacctttcccagtaatcactgttgattacgagaatgttaccatgcagctttgcatctgttccttgtactgtatgcacattgctcaaaggaaagtcagtggcttgcactacttacaagtttcatagatttgagcctaaccacaagaggctggtgcttagtactgttttccctgcacgtaggggtcttttaaaaatataaagcttgtgataaagagaggagaatatgggactccatgaaccagtgttgatatgtttgattaagacttttcacaaaataatcatataaaacactagtctctttattagtagaaacttctgtggctatgcagaaatagagatcgaaccaaaaaaaatcatttaaactttaaaaatattttaaatggactttggggagacattttttgtgtgttttaagaatgaattgtagtgctctttaattcagctacatatattcatgtggtgatagggatcaacttgacacaactttgaaactgcataaagtagacataggaactagaggaaagctcaggctgcattagagtatgaatttagcattgggaaaagcccttattcttgaatctagagttactatttttgtatatatttgcatagtgtttaaacctgcagcctaaactactgaaatttgtgattgtatgtttgtgtgagcttcagtttaatgaaagattcataatggttctttgtattattataatacttggtgttggggtgttctttctgttttgttttttactttaattttgttttgattttttttttttttttttttttggcgggggtaggtgagggtttggagcatgtggtctttttaaaaaattgtaaccctctagaaaatatcaaagaaatgaaccagacgtggtttaaatagttgattttcctattttaacagtaccaactagttaattgggaaatgtaagttctgaatgttcacattgctttaccagtttggcactggaaccaagagcacatgtcgtggctggctacaaggttgtaaagcagaaaatcgaagtttaccatgtctgtaatgtgtacatgaagtgtcaatttagaacagttactaggataaactccattattgccatggctgtcatggtacccaagtgacttggaagatgcatttaaattactcagctgaaatcacttgatcatcttgtgccaagatatgctgttggtgcctgatagggattagtcttttaggtgccctgttctcctaccataattgtgaatgatttgtgagaagtgcaagccatgtttatcctgaatttttacttaataatttgtattactagtcatatgcatgtagctttctgtttacatcctatgccacatggtcttcatttatgccaggtaaactgtatttgaactatgtgcagctagctttgttttaatctgcttggcaaccagtgtagctgctgtaacaatctatcttattgttcaaatatataagagccaaactcttttccattccatctaaaatgttttcatttagtactcttctttcctcctactctatgaacttcaaaacaaaaacaaaactttgagagcagcacatgcatccaggtatttatagattattgccagtgtcttttctgtatgctataagcaagggagcttaggtgttatttctttaatttatgcttgaatctgaaaaattatttctgacttactccatggcctccttataataagtagaagttttatatataattaattttcagcattgggcactgaattaggacagtcctcatctcattgcttggcccttcaagcaacctagctaaaaggtgctgatattttatttagtactgccaacttcaagtgatttagatatctatctatctagatttctgaaccaagatatatttatagttcacttttgggtttttatacccacggtaggattctgcattccagcattaaatctgcttcattttagaacctttataaaagcaatagctggaatatactcccagttttaaaataaatgcctgattgatttaaagcaagtaggttatgctgaagtatataaagaagttttatattctctcaaaaatggtattatctttctttatttgctagattcttacaaatcttttaagagggctgtaacagttgctgctagtattagggttccacatcattctaatgtatagtttcaagtcttaatagacaatctgaattccactacatttcttttggctccaacattccttttagcttgaccagtctaatttaaaatgtgtttgttggaggtcattaacgttacttgtacaatgctgtcactgtgtgacatccatatgaattttggtatatatcaatcaatcaatcaatcacattgcattcaatcaatcagctgtgattgattgattatgcttagaaatactatagtaactagatgcagtgtgaattttttccattaacaaacaaacaagtcagtggcttaaatgtgattatggtcctgcaaggtgattcttgctaaaatatctaaacttttgttttgttttaactgaatcattttttaacttaaaaagctggaaaatatcaaatgctgtttttttttttttcattgtcaacagtggtgtgtcattttatgtatgttcctaatgcttatggaactcctccaaaataaagttactcaaagagagcaaaaaaaaaaaaaaaa

SEQ ID NO: 1331 - DNA, 3495 bp, Homo sapiens
ccacgcgtccggatgctgcaacccatattcttcatttgtcacttcgtttctgccttttgtgttttatgtgtaccatcatctccccacatggactgtgtatagtctgttctaattctctcttatcattgattcctggcactggacagacacgaacaatgtttgacagagagtcattctcataaactagattaaatacatatgggtgcccttatgagaggtatccaattcttgtttctctgctatttcagttcttcttgtttacctagtgaggtgcagaacacatacccagaggttaatttgccctttaattggggaccttaactactggacttcaaaatgtcaagaatttactgcagtgtgcacaactaaataaaggaaattcaacaattagttatctgcaaaacacaaagttctgattgcaaacccagacctaccatatctccaatttccacaagcaaggcattaaacacttaaatcaaagtattgtattagctttatctcctggtggaggccttaaaagacacaaatgcattacggtgccattaaataagtggtttgtggagtcgactgggttacagggattgtacctaggctaacaatctgatccactagcaataaattgttggtctagatatctggttgccttcacactcagcaattggcatttacatgacaattagtttccttctcaaaattgcttaggtaataatgctttattgccttccatttataaagacaaatccttctgcagtaaaaagacagccacaagaataaagcatatgtaatggtggtattccataaattgaccaatttttccattagagctttacagatttgaaagaccttagtctccccacaaaacttacatacaatgtgcttttcagggtaattattaaacagtgagtgacattcatattgaaagcaaggtaatgagtagtttgaatggctacaggagggcaattttaggtgcttgttttattttaaaggaaataacattggtctgtagttaattttgccagtagtgggaagctggagtaggctccaagccagcaagcagacaggatacctctgtctctagggaaaatgcaattggaaaacagtccctataagataaaaagataactgcattgattcagatctcctcagcctcatcttcttggaggctgtatttgtgtgtcttcacctgatcatttgtggaagaaatctgcttcagctcggaatgcttttcattttctttaaaaggtagaggaaaaatagtataatgaaaaatatattgctttggagttgattactttttaataggaaaagaacactgtattctaggtgagaattagctgcatgcctttgtaaagagcagtatcaatccaggcatatatatttgtatgaaacatgtttagaaatgctatgagctagctgtggtatttttgttgttgtcattgtcattattgttatgccctggcttctgaggatggaggcaagggcatgtgagttagagttttgtctccataagaataaatgtttgtcccttagagatttcccattttcaacagcagagcaggctgaagctggaaatattaaaatacacatgacttctcgaagacagttggatgcctttagcaaaaaaaaatcaaaaacttcaaaaagggtgattaactaaatgcccaacaggaaattcagaaaataataaaccctaaaatcaatgtattttattttctaaatatcacactaagatacttattggtaagatatatacatatctctggactataatttttttctggaaatggatatctctgaccagtgatgaagtccactattgaaaaagtataactccttcactggttgctggtagaatctaagatgggctctgtaaactctgtaagaaatgaatttcttacctacccaaacccctctcccatcaaatctgatttgatgagaattctctaaatgagaattttcaccttctaacctattggaaattcagtactgtgaacaaatattacaactttatacctgtctgaaaggctataattggagtactatgttattttaatgcaatcaagataattttatgcctatatacctgtacagacatacacagcaaatgcacaacatctaccccacacacacaataagcatgcatcacacacacacacacactctgcacacacagactcccacatgcaccacacacccacaaactgcagtctctgttattgttggctcatctacattctcactcatgtgcacagcaccctttattttccaagaaatttctaaatactgtatacgattagattggcacaaaggtagttgtgggttttgccatcatttttagtagcgccattttaaaaaaccactattttaaaaataatcgcaaaaaccgcagttacctttgccccaacctatatttcacagacattgtccactttgaaaactgtacgtttagaaatacgaggttttgtcgtgttcatttaaactcccccagacaagtctactctcattggtaacttggagctgctcagttgggttgacctttctagcaggaagcagtgagcctgagtaccactaactttaagagctcttctgcagggctgaggctcaggagagaccacagtgaaggaggaagtagatacttgctgctttacttcctttaagcagggtgtacactggttgagctgagcctgcagatgcaccatggaccagtcttgtttttcctatgacagaaaggctgtgcagcaaactaacctgcaggcaaatggggaaatctactggaaatggaagagaaaaaaataaatgaattatccaagcattctcgataatgaagaagtaatcaatggcaaatgccaaaaagctcaacaggttaaaaaacttggaataaagataaaatgtaataaggaagtaataactgaagtgggaagaaatgaataggaggtgccttaccaattgctcaatttaggacttgtgaatcctgtcatcatgtacatgtgtctaaatcttaagcactatgtttctgttactctaaattcctaatggtacttttggggccattttaatggaatggattcaaatgcattgtcaatgaaagccaggtttctgccccccggttgcttagattcagtgatgatgccatttccggattggatagcctatctaactgaaaatagttagaattgagcatgttaaaacataacataggccgggcgcggtggctcacgcctgtaatcccagcactttgggaggccgaggcgggcagatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcaagactccgtctcaaaaaaaaaaaaaaaaa

SEQ ID NO: 1332 - DNA, 1489 bp, Homo sapiens
gtcgacccacgcgtccggccggagggacgatgagctgcgcggggcgggcgggccctgcccggctcgccgcgctagccctgctgacctgcagcctgtggccggcacgggcagacaacgcgagccaggagtactacacagcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaaaaaaaaaaaaaaaaaaaaaaaaaaaa

SEQ ID NO: 1333 - DNA, 1994 bp, Homo sapiens
  misc_feature (1166)..(1166): n equals a,t,g, or c
  misc_feature (1954)..(1954): n equals a,t,g, or c
  misc_feature (1967)..(1967): n equals a,t,g, or c
  misc_feature (1983)..(1983): n equals a,t,g, or c
  misc_feature (1992)..(1992): n equals a,t,g, or c
gcttgggaaaccagacccaagcctccagcagtggagtaccatgaatgaatttagtcctcataaggatcattctggatgcatgtggagactagactggaggagttcaagactagaagcagagaagccagttagaagagtgttgcaatagaaagtaagaaacagaactcttgagctggggagaatcttgatattaaacaaagaaaaagtgaattggatgccctgataacttatttagctggaaaggtcatccctaaaagacttgaagtaaagtgaagaagagataatggagataagaactagagtggtgtggctctgcctctgcctctgcctctgcctctgcctctgcctctccctcttctctcttccctmttccctctcccctctcccctctcccctctccctctcggtctccctctccctctctttccacggtctccctctgatgccgagccgaagctggactgtactgctgccatctcagctcactgcaacctccctgcctgattctcctgcctcagcctgccgagtgcctgcgattgcaggcgcgcgccaccacgcgtgactggttttcgtacttttttggtggagacggggtttcgctgtgttggccgggctggtctccagctcctaaccgcgagtgatccgtcagccttggcctcccgaggtgccgggattgcagacggagtctggttcactcagtgctcaatggtgcccaggctggagtgcagtagcgtgatctcagctcgctacaacctccayctcccagccgcctgccttggcctcccaaagtgccgagattgcagcctctgcccggccgccaccccgtctgggaagtgaggagcgtctctgcctggccgcccatcgtctgggatgtgaggagccyctctgcctggctgcccagtctggaaagtgaggagcgtctctgcccggccgccatcccatctaggaagtgaggagcgcctcttcccggccgccatcccatctaggaagtgaggagcgtctctgcccggccgcccatcgtctgagatgtggggagcgcctctgccccgccgccccgtctgggatgtgaggagcgcctctgcccggccgygaccccgtctgggaggtgaggagcgtctctgcccrgccgccccgtctgagaagtgaggagaccctccgccyggcanccgccccgtctgagaagtgaggagcccctcygcccggcagccgccccgtctgagaagtgaggagccyctccgcccggcagccaccccrtctgggaagtgaggagcgtctccgcccggcagccrccccgtccgggagggaggtgggggggtcagccccccgcccggccagccgccccgtccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctrtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgygagaaacacccaagaatgatcaataaaaaaawaaataaaaaaaaaaaanaaaaaaaaaaatntcggggggggcccggncccaattcncc

SEQ ID NO: 1334 - DNA, 2753 bp, Homo sapiens
ccacgcgtccgcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgatctttgagctttggcaagacagagaaaagcccagtgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaagaatttcttgaagtgatttatctaaaataaaggttggcaaactttttctgtaaagggccagattgtaaatatttcagactgtgtggaccaaaaggccacatacagtctctgtcataactactcaactctgtttctgaagcaggaaagccaccacagacagtacataaaggaatatgtgtagctgggttcccaggccggacaaaacagatggtgaccagatttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactgattagaagaatacttgatgtttatgatgattgtggtacaagatagttttaagtatgttctaaatatttgtctgctgtagtctatttgctgtatatgctgaaatttttgtatgccatttagtatttttatagtttaggaaaatattttctaagaccagttttagatgactcttattcctgtagtaatattcaatttgctgtacctgcttggtggttagaaggaggctagaagatgaattcaggcactttcttccaataaaactaattatggctcattccctttgacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1335 - DNA, 2892 bp, Homo sapiens
  misc_feature (858)..(858): n equals a,t,g, or c
agactctgagtccagctccgaagaggaagaggaattcggtgtggttggaaatcgctctcgctttgccaagggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcmatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacagatgggtgatagatctgccactctgaaaagacagtctttggatcaagtcaccaacagaacagatacagtaaaaatccaaagcataaagaaagaaggatagttccaaattctccaggtatcccaagcttaagagagraactccagcttgatccagtgctcttacmaacmaacctgrgagcnacmggcctccagagaccgccgatgargagcaagtagagagttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggyatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgttttttttttctttacatgatgttcagcttggtattaaccaaacttaaattttttttccagaagtattaaaatttagttaaagcaaaaaaaaaaaaaaaaaaaaaaaaaaaaaaaaagggcggccgc

SEQ ID NO: 1336 - DNA, 1592 bp, Homo sapiens
ccacgcgtccgagcaatttataaattgataccagtaatacggtgccttgacaaactagattgtttgagccatgttatgtgacctcatcttgttatttaatataaaaatggcaatttatcatctgataatactgcagtttttctgtagtgtttgctctgagcctgacactgcactgagtatttccccactgtaggtcatattattgtccccattttgccgatgaagacctgagaggtgggtaggggcaggaaagtggtcagtgaggtgctggtggggtggaggggccaaggatcagctgaggctttctgacctgagagctggcagtgcccacccaacagctctacctgttacatttctgttatcctcatgccatcctctgaataaacatccatcacgctggtccttggtacccacgacaatgacagcttgtcagccctgggccagtgctgtggcacgtggacatggggaagcccagaggtggcaaggatggagtgggttccatgtggggaggataagggtgcatggagctggcaggggagttaagaccgggaaggccagtgggagccagcccgggggcaggggacctggaatgccagcatcagaagacttccccgcatgaggctcttggtaactggggctcacctcccttctgtctgctgcaggatggggtgcatgaagtccaagttcctccaggtcggaggcaatacattctcaaaaactgaaaccagcgccagcccacactgtcctgtgtacgtgccggatcccacatccaccatcaagccggtgagtaggggaggtcccagtttccctgggggctgacggatgctgccccaacattgccctaacagcctcctgtcttcccaaggttgggcagggtgagcttggggtgaaagggagctgactggccaccaacagtgtcctgactcgactctccgggacgcagcgccagccagcatgcataggggcaaagaagtcatctctctttcctgcagcccaggcttggcccctcagcctgagctccaccaaacaggtgtgagtgagcatctcaggcctccggcctgggcagaagcaaaagcagtgctgagaaacgagtgaacagtaatgatagcagctgaagtgacaatgtaatggtagtatcagcagcattgcaaaaatacagtaacaattgtcatactaatagtaccaaccataattgcgtgagtataagaccaagagtagcagcaggaacaacagcaagagttgtaaaaagagaagcagtcatgctaggagaggtatttaccaacttcttttatgtttatacaaagctgactatgaacccagcactgttgtaagcctttacggttattaacaccctaatcctcacaataatcctattgtgtgacacacaaatacattcttcttgaaaataaaaacacaggccaggtgcagtggctcacacttgtactcccagcattttgggaggctgaggcaggaggattacttgagcccaggagttcgaactgcatgagctatgatcacgccactgcactccagcctgggcaatacagggagaccctgtctctttaaaaaaaaaaaaaaaaaaaaaaaaaaaa

SEQ ID NO: 1337 - DNA, 5257 bp, Homo sapiens
ccacgcgtccgcattttaacatctctaaatcaggatctgtcttataatcaaaagtgcatcatatttaacagatggcgtgttttctttcttagtagtacctaaagtaatacaacttaaaattgatggcattttagatttaataaaatatgttcatttctttgttcatttttggtctggtgaggctttggccctgttgtgtagttatttattttgtttatagtatttgtaaacaccagtgttctcaagaggctcattcatcaatatttaactgcaaatttgtttcccagtctcagttttctataatgtaatccatttgtggggaaggggaagctaaaaatcagtatttctgccagtattttctatatagatgtcataaaacaaaaataccatcatgtattaatatttctacatgtgcaagacagcactttgaattataaaacccaacttattcttttgcaatgctaaactggttgatcttcaaatcctactaccatgttggaggttcatatagcaacaatgtaaacacacacatgtaccataacctaaatataacaaaacagaccagttaactattctcactcatttaagtctcttgcagggattcaagtcagacttattgatatattaaaatattacaaaatccaaggtgatgcatatttcctgcctagggttttaaaagtgtgttttaacttaatattatgttctttcagaattgatacatgactatctgtcattagaaaatgcccatctaattatgaggatttcaaaactactccatcctccaaagaaaaatcacatttttgccactagatgctattgtaaaaccttttagaaacttgaaagttttgttgtttaaaatttctttgtttttaaagaattcagtgatggtttccaccaatgcattaactttaaatacctttcattttgagaggcaaaatttgatttatggataaaatatatatacttatgagagacgaataaattcatagttctcgagaacccatggggatattttatgagttaataatgccttttctgaaaccaactttagcctttatcttaaaaccttttaaaatttatgcaatatttcatacacactttaaaatttaactttagctttttacaagaaacttctaccaaaaaatgcaatagtcattaacttgctctctttaattatcaaaatataatctagctagtatttaatttaacattttatttatttttactaagtaaattttgtaatagcaggataattttggacttcattctagagtcaattggctcccagtgaaagacaatgtaaaattacattgattttgttttccaattacagaagtaatacatagtcattatagaacattttggaatatataaaatgtatgtaaagagaaggaaaagtcacccaaaacttaagcacattaaaaataatcacaattaacatttttgtattttcttactatctttttttctatatgtttatgtataggcatgtatataatcatatacatgtaaacatcaaactatgtatacagtttacatttcctatcattagtaagtattttcacatatcattaactattattcaacatcttattttttcatgattatattgcctttatggacatgcagtaattcattcaatcattccccaattattggatatttaagttgtttcaattttttttactattataaattccatcaagcataaaactgacacaattgaagtactactgagagagaggaacacaagcattagagtaattactggaggtgccatggagatgaacatgacagtgatgtaccaagtggattggacagtgaggttcaaatcacagagacttcttagtggagaacaaggaagaaaggcaaacctggagtcccagccatagaaacagaaaggaaatgattgatatgaaaactagtatgttagaaacttagaaggacttggcaaatgatgaatattcatgaggtatgagtcaaagatcacttgaaagtttatgtgatgggaagaactgctgccataaacagaaattgtcaaatttggaggagaaggccattgaccctagaggtgaaaccgaagctctgatggactctcacagctggagatgaaaatacgagttatacacggagaatgtaatggtgaatccatgggaataattgatatatttgagggtaattcagcacaagtggaggaaaacagggtccagttgaaatctttcagaatgacccatattttgatgaaaaggagtaagaaccagtgagaaaagagtagtctgaaagtggggaggagagggaaaaggagagaatgaattagaactccagtaatagagattcactgggagcccaggaaggatgagaactgcaggctcaaatccacaatggtaagggccacaggcaactatgccaagacaggccactgagaagttaattgtaacctttaaagaaccacaaaaagacttcactggtgttatgaccctaagccagcttgaacaagtaggctatcaagaacaagtaggtgatagccatgattttgagcttttggtggtgaaagaaaagaaaatgtgggatgtgcgtccaaggcagtcataggaggtttggtgagatggtgaaccgcatgggtgtcctgttctccatagaatgtctccttccaaccaatccaggctctcgccatgaagctgcctgggaagtagaagagggaattcatatggccaaaccactttgttgacctaaaaattactgcttaaaaaataatttttagaacttttaaaggaatcatttattcaagggggaaaaaaatctctttttcaggcaaccactgagaaaacggaaccgaatagtcaagaggacaagaatgatggtggaaaatcaagaaaagggaatatagaacttgcctcatcaggtttgtttcataagagactagttttaaggcaaatcatggtaactgtttaagatgtaatggaaatagtcaagaatttttcctactgagccacagaaaagtagtaattagactccaggagtggtgcggttgtgctgccacctagaggcttcctggggaagttctgcccgtatggttaatgttgctgtgaaaataggagcccatgctctttcttaaagctacccagttttattttgttttttaaaatatttatccctataatcataaagaatactgtgttcttccatataaatcatgctaaaaattgagggtaggattttgacacacagtaacagcaatagataagcgagaggtcaaaaacataaaaatagacgctgaaatggtaaagctcacatatagttaaaaatgaatatagtgccatgaatctggacagtgagtataatatactgtattcgttgttttaggaagaagaccctgttcccgaaagtcttgttcctcaatatttttttgcagccttatcaatatgtttaacacttttcttcttttgataaacagtaaaacctctcaccctctttcaataccaaattattattttttataaggcctttctccagtgtttaccacttgagaaacataatttgtcaattaccaaattatttttaggtaacatttttaaataaattaaatatcacttaaaataatagcatttactttttcaaactagattgtgccttcacattttgatatgcccccttaggtagtgacttttccaccccttctaaagtgaacctaattcttctttatgtatcagagaacactttattttcattgcattatatacatataccccacaatccgtaacacattccaattaagaaattctgatgttaaaatggagcattgaaatacaaaaaaaggaagcatcaggttgctgctcattcactgggatagaaactacctgtagatgttctcttatctagcccagctgtcataattatatatttcgtgtcagcattctgttccatgtggtgttattcagatgtaaaccgtgacccttactaaaaacttaagttcttcatagtgtggttataggacgtgatttgtgttgcttgttgttcaataccatgaaagagctttgggaattccagcatcttaggctcttttatatctctgagcacactgtcattcagcttatattgccaggacgggatatggactgaatgtacttcatggcattgcagaataaatggtcctatagatatttgattttcttttccttctgtacgtttctggatgtaactccattgcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtgaagtgcagagtggaggaaagcggttaaacccacaagttaacatggccccatattacagctagctgctgctgtggcagttgtgaataatgaagatttatttctctcctcatcttttttcctatctttaatctgtagtttttctttttcgtgtgtgtgtgtgtgtgtgtgtgtgtgtgtgtgatggagttttgctcttgttgcccaggctggaatgcagcggtgtgatctctgctcaccacaacttctacctcctgggttcaagtgattctcctgccttaggctcccgagtagctgggattataggcgtctgccaccacgcccagctaatttttatatttttagtagagacggggtttcaccatgttggccaggctattctttgtggaaaagtgtaatataagttctaaagccttgcagttaggttttagtttgctgtgtgtgtttgcttatttgctttttaacctgtcagcttactggctagtctctctccaataatcatctatttgttagcaatggtaattctgatgccactggatttggataacaagaaacctagaaaattattattctgatataataggttttaaagtcttgtttttattaaagtttcttccttgtttagagtctcatctcattcacattagtttgatttgttttcaggtacagagtctaaaaatattcatcagttacaccagttgttcgcaaccttgattactcttgggaatttaaaaaataacaagctagctgggtgtggtggctcacaactgtaatcccagcactttgggaggccagggcaggaggatcacttgagcccaggagttcaagactagcctgggcaacccagaaagtcttcatctctaaaaaaaaaaaaaaaaaaaaaa

SEQ ID NO: 1338 - DNA, 2876 bp, Homo sapiens
ccacgcgtccggcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcctcggcgtcctcggatgaagaaggcagccaggatgaatccttagattccaagactactttgacatcagatgagtcagtaaaggaccatactactgcaggcagagtagttgctggtcaaatatttcttgattcagaagaatctgaattagaatcctctattcaagaagaggaagacagcctcaagagccaagagggggaaagtgtcacagaagatatcagctttctagagtctccaaatccagaaaacaaggactatgaagagccaaagaaagtacggaaaccaggtagtctggacattttccttgctttttgatttatttaggggacaactgaaaattttaagctaatgaataaagaggctgaagaagactggcttcactgattattacccacaaataatatatggagtgtagtttggagagaatttctagattttaatataccaaagttattcacttaacagatttgacccaagttacataagctgaattccatagatgagattgcatttatctttttattaatatcctgacgtttctttttggaatcaagtatgtaaatacctttctcactgagaaatttaaaaaaataatatgtcagggtagcatacaaaacagaaactcaggaagaactgtctaacatgccactatggttattttcaggattgtggtaggattattactacaataaccttgtcgatcatcctaggtaatttgatttaggtgtttatccctcagctgacgcttgtgtgtacttccatcctattctaactttcacaatcttgaaacctctacttttcaatttaaaacttgacctttttcacaatagtcttctaaatattaatccttttaaaaattattaatgtatgcattctaccatgtcttgttgcccttctgtcatttattatttcaatgatcactgccttatctgtttattattccattactaaccactctcaggaactgatccaaattggaactttttaaaaaaatagaatttttttttactacaaatataccattctcatgaatagaaaactatttttaaaaaattaaaagtacatgaatcccatcaactagaaataacagctgctcacatcatggagaatattctctcaggatttttttaggtgtatcagtagttttaagaaaagtaaattgggtcaaaatgtgtattctatgttgcagcctgcattttgcacttaacagtttaccatgaatgtttttccatgtcatttagcttattttcaatttgatagttaatggctataaaaaattttatttgtaaatatatggtaccataaaccaaaacgtttatgttttgctgggagatcattttagatgtatctttgtgcctatctgtgaaaatttccttagaattcttaaagtaaatttgctgaattggatgtaaaagtttaaaagacagtagatacacattgttaaattgttcttcagaaaagtgattctgtttacttcctctgaaaatacctctttccctgtacctcacccaagtgtgtattaccattttaaaatttttactaaatataatttaattcattcttcattttttaattagggattttttttttttttttttagtttttatatttttagagacatggtctcactctgtcactcaggctggagtgcagtggcacgatcatagttcactgcagccttgaactcaggtgatctccctctttggcctcccaaagtgctgggattacaggcatgagacactacatcaagcctgggaaatttttaaacatgcataaaagtagagggtaaaatgacaccccttaccaaccctcactcagcttcaataaacatcaacattctgctggtcttttcatctttactaccctacacacatttgccctttttttctttcctagaatattttaaggcaaattccgcatgtgcttttacatctctgtgtctctctctagtaagaatgttcttttcagcaaaatcacagaattagccattactcctttattacctaatacccagactgtttaatttttctagttgcttcaagtgtctgtttacaatttatttgtttgaattcatttctaagctactcaggaggctgagtcaggagaattgcttgaacccaagaggcagaggttgcagtgagctgagatcgtgccactgtactccagcctgggtgacaaagtgagactccatgtcaaaacaaaacaaaacaaaacaaaacaaaacaaaacaaacaacacaattgaataatatccctcagttattatttagagaagagatgactcaatataaatgtaatatgtgatcatttggtcacagaatgaatttcagtcattgcttaggtaagcctggtaaaaaaaaaaaaaaacgggattccatgattagtgtgttgaaaagggggttgccaaagtgtaacagacagagccgggtgcagtggctcacgcctgtaatcccagaactttgggaggccaaggcaggcggatcacgaggtcaagagattgagacaatcctggccaacatggtgaagccctgtatcaactaaaaatacaaaaacaattagctgggcgtggtgacatgtgcctgtagtcccagctactcaggaggctgaggcaggagaattgcttgaacctgggaggcggaggctgcagtgagctgagattgctccactgcactccagcctggccacagagtgagattccatctcaaaaaaaaaaaaaaaaaaaaaaa

SEQ ID NO: 1339 - DNA, 1053 bp, Homo sapiens
  misc_feature (1025)..(1025): n equals a,t,g, or c
ctaggagcaccgagcagcttggctaaaagtaagggtgtcgtgctgatggccctgtgcgcactgacccgcgctctgckctctctgaacctggcgcccccgaccgtcgccgcccctgccccgagtctgttccccgccgcccagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggccgaatccgggtgcatggtattggcgggggccacaagcaacgttatcgaatgattgactttctgcgtttccggcctgaggagaccaagtcaggaccctttgaggagaaggttatccaagtccgctatgatccctgtaggtcagcagacatagctctggttgctgggggcagccggaaacgctggatcatcgccacagaaaacatgcaggctggagatacaatcttgaactctaaccacataggccgaatggcagttgctgctcgggaaggggatgcgcatcctcttggggctctgcctgtggggaccctcatcaacaacgtggaaagtgagccaggccggggtgcccaatatatccgagctgcagggacgtgtggtgtgctactgcggaaggtgaatggcacagccattatccagctgccctctaagaggcagatgcaggtgctggaaacgtgcgtagcaacagtaggccgagtatccaacgttgatcataacaaacgggtcattggcaaggcaggtcgcaaccgctggctgggcaagaggcctaacagtgggcggtggcaccgcaaggggggctgggctggccgaaagattcggccactaccccccatgaagagttacgtgaagctgccttctgcttctgcccaaagctgatatccctgtactctaataaaatgccccccccccccgttaaaaaaaaaaaaaaaaaaactcgngggggggcccggtaaccaattcggccta

SEQ ID NO: 1340 - DNA, 1936 bp, Homo sapiens
agccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtgtgggagagatagtgagggcctgtcaaagaaggcaggtagcagtcagcatgacagctgcaagaatgacctctgtctgttgaagccttggtatctgagaggtcaggaaggggacctctttgagggtaataacataattggaaccatgccactcttgagccacaatacctgtcaccagcctgttgttttaagagagaaaaaaaatcaaggatatctgattggagcaaaccacttctttagtcatctgtcttacctccctgggacagctgttacctttgcagtgttgccgaatcacagcagttacctttgcaatgttgccgaatcacagcagttctgttggagaaacgcttggtttccggatccagagccacagaaagaaatgtaggtgtgaagtattaggctgctgtcagggagaggatggcagatggaggcatcaagcacaaggaaaatgcacaacctgtgccctgttatacacacgttcatgtgcacccaagaacctatgactttcttccagttccttctaccaggtccccatcctgctgccagctctcaacatagcaggccataggacccagagaagaatcccagtgttgctcaaagtctaaccatcataaagacactgcctgtcttctaggaatgaccaggcacccagctcccactggactccaattttttttcctgccttatttagaattctttggcgggaagggtatgatgggttcccagagacaagaagcccaaccttctggcctgggctgtgctgatagtgctgagggagataggaatttgctgctaagatttttctttggggtggagtttcctctgtgaggggcttgcagctatccttcctgtgtatacaaatacagtattttccatggttctgcctgcaaaaaaaaaaagaaaacgaacatcatcactgatacgcaagcaacatcgagcatagcagacggatgatcagcaaaaaaagcggggcgggggcgcgataacaacacgcggaggggcaagatatcatcagcgccgttgttttgaaagagggtctccaagggggcgattaaaaacacacgagggggacgataaacaacggtgcgcgggaaaaccagcggttgagataggggagaaaaccctttgggggggatagggaccacaatccacaatcgcccggcaataaatatggtgtgtgaacacgtatgg

SEQ ID NO: 1341 - DNA, 2113 bp, Homo sapiens
ggggaatatggatggctttcttctttgccctctttgttattttctttgttattgttgttcagatggagtctcactccggcctgggcaagaagagcaaaattctgtctggggggcagggggaagaggtatattttttggattaaaatggaatgctttcctcaaactgttaaaattaggtagtgttacaagtttaaagaataggtttagccagtgtgattattgcagtgtaataaaaaggatcccaggtggcacacatgctagtgtggtgcccagatgctcaactgaagtgaaggataacatgcgtttcaacattttctatatactaggcagtttttcttaagtcttggtttattgtgatataatacagtaaaatttactctttatacgtatgattccattaatattaacaaatttaaacagtcttacagctaaatacaatcaagatacagaacatttccatcactacaggaagttgttttttgctaatttaactaaacttcttaccatgctcaaccccccacccccaccctgagaaccactgctttgtttttctgatcatatagtttggccttttcaaawatgtcatacagttggaatcatatagtatgcatgaatcatgtagctgaagttttcatttcacttaggtaaacacctaggaataggagtgctgggttatactctaagtgttaaacttcataagaagctgctaaactgttttccaaagcatctgtaccattttcctttcccaccagcaataaagcattcattagtctacgtactcaccagtgctagtgtggtcagaatgtatagttttaattatacacattataatagatgtagagtggtatctcatcgtgattttgccttttcctaatgaatatctttccttacatatttgtcattagtgtgtcttctttagtaaatggtcctattgttttgcccatttttaaaagttgagttttcatattgktcaatttcgagagttcttcatatattctggacacaagtcctttgtcagacatgtgatttgcaaatattttcccccagagtttttcctgtcttgtcagtcccttaatagtgtttttaggaaggagaacagctgcttttaattttgataaagcttgcaattgtttttcttttatggatcatgcttttggtgtagtatctgagaactctttcttaaaccagtcacacatgtcttctgttttctttgaagctttacaggttgaggtacattttggtccatgatcacttttgagctactttttatatataggtagtataagatatggtttgaggtttttgtttggggttttttttcttcctgcatatgaatgttcagttgttccagcaccatttgttgaaaaaacactatcctttctctagtaatttgcttttttacttttgtcagttgactatttgtgggtctgtttttaaactccattttatattatgtctacattatgaactttatagttagtcttgaaattmggtaatgtgggtcttctcacttgtgcttttcaaaattgttttggctcttctaattctttcactttttccatataaattttagaaamagcttattgatttctaccactttcccccaaaaagccacttgggaatttgactaagtttacatcgaatctaataaatgattttggagagaagtggtatcttagcaatacagtcttttctgataacacttcctgttttagttctttttctcatttaataattttccaacattaaaaccttggacaaatttagatgtgtatctgaataattccagttttgttgccatttaaaatggtacataatccttattttatagatgagaaaattaagtaacttgcccaagtcacacagttactaaatgacaaagctagattgaaatctatgagcttataaactaatgtcctgttttgagctacagtactagttttattaaattgttgtggttaaactgaggtgggaggatagtttgagcacggaagattgaggctgcagtgatctttgatcctgccattgtactccagcctggcaacagagtgagaccctgtctccggaaaaaaaaaaaaaacaccatggaagcaagcaaaaaaaaaaaaaaaag

SEQ ID NO: 1342 - DNA, 1536 bp, Homo sapiens
ccacgcgtccggctggcgcacgccccgggaccccgagaggccgccgcggcacatccagacctccgccgctcccgcgccctctcaaccatcctgggattcccgggcccacccgacccagcggcgcgaccctggccctccgggaccctccgctgactccaccgcgcacttcccgggacccccacacacatcccagccctccggccgatccctccctactcggtgccgggtgccccccgccctctccaggcccggatctcctcccccaggtccccggggcggccccagccaggcccccttcgaaccccgccggcggcccgggctggggcgcaccatgcggctgcggctccggcttctggcgctgctgcttctgctgctggcaccgcccgcgcgcgccccgaagccctcggcgcaggacgtgagcctgggcgtggactggctgactcgctatggttacctgccgccaccccaccctgcccaggcccagctgcagagccctgagaagttgcgcgatgccatcaaagtcatgcagaggttcgcggggctgccggagaccggccgcatggacccagggacagtggccaccatgcgtaagccccgctgctccctgcctgacgtgctgggggtggcggggctggtcaggcggcgtcgtcggtacgctctgagcggcagcgtgtggaagaagcgaaccctgacatggagggtacgttccttcccccagagctcccagctgagccaggagaccgtgcgggtcctcatgagctatgccctgatggcctggggcatggagtcaggcctcacatttcatgaggtggattccccccagggccaggagcccgacatcctcatcgactttgcccgcgccttccaccaggacagctaccccttcgacgggttggggggcaccctagcccatgccttcttccctggggagcaccccatctccggggacactcactttgacgatgaggagacctggacttttgggtcaaaagacggcgaggggaccgacctgtttgccgtggctgtccatgagtttggccacgccctgggcctgggccactcctcagcccccaactccattatgaggcccttctaccagggtccggtgggcgaccctgacaagtaccgcctgtctcaggatgaccgcgatggcctgcagcaactctatgggaaggcgccccaaaccccatatgacaagcccacaaggaaacccctggctcctccgccccagcccccggcctcgcccacacacagcccatccttccccatccctgatcgatgtgagggcaattttgacgccatcgccaacatccgaggggaaactttcttcttcaaaggcccctggttctggcgcctccagccctccggacagctggtgtccccgcgacccgcacggctgcaccgcttctgggaggggctgcccgcccaggtgagggtggtgcaggccgcctatgctcggcaccgagacggccgaatcctcctctttagcgggccccagttctgggtgttccaggaccggcagctggagggcggggc

SEQ ID NO: 1343 - DNA, 4062 bp, Homo sapiens
  misc_feature (2315)..(2315): n equals a,t,g, or c
  misc_feature (2419)..(2419): n equals a,t,g, or c
ggaattcccgggtcgacccacgcgtccgcgaaactgagggaggaggcggcggctctggcagcggcggcgacagtgtcggcctgaccccccctccgctccccggcagctcgctctctcccctcagcttaacgatgaagaggagaactgacccagaatgcactgcccccatcaagaaacagaaaaaaagagttgcagagcttgccctgagcctcagctccacgtccgatgatgaacctccctcctctgtcagtcatggagcaaaagcatctactacaagccttagtgggtctgatagtgagaccgaggggaaacaacacagctctgactcttttgacgatgcattcaaagcagactctcttgtggaaggaacttcttctcgctattccatgtataatagcgtctcccagaagcttatggccaagatgggcttcagggaaggtgaaggattgggtaaatacagccagggtcggaaggacatcgttgaggcttccagtcagaaaggtcgaagaggcttgggtctgacactccggggctttgaccaggagctgaacgtggactggcgagatgagccagagcccagtgcttgtgagcaggtgtcatggtttccagaatgtaccactgaaattcctgacactcaggaaatgagcgattggatggtggtgggaaagagaaagatgattattgaagatgaaacagagttttgtggggaagagctgcttcacagtgtgttgcagtgtaagagcgtgtttgatgtcttggatggggaagagatgcggcgagctcggactcgggccaatccctatgagatgatccgaggagtcttctttctaaacagggcagcaatgaagatggctaacatggattttgtatttgatcgcatgttcacaaatccgcgggactcttatgggaagccactggtgaaggaccgggaagctgagcttctgtactttgctgatgtctgcgcaggcccaggtggcttctcagagtatgtgctgtggaggaagaagtggcatgcaaagggctttggaatgactttgaagggccctaatgacttcaagctggaggacttctactctgcttccagtgaactcttcgaaccctactatggtgagggtgggattgatggagatggagatatcacccgcccagagaacatctctgcttttcggaattttgtcctggataacacagatcgcaagggtgtccattttctgatggctgatgggggtttctcggtggaggggcaggagaacctgcaggagatcctcagcaagcagctgcttctgtgtcagttcctcatggcgctgtccattgtccggacaggaggccacttcatctgtaaaacctttgacctgttcacaccgtttagtgtggggcttgtctacctgctgtactgctgctttgaacgagtttgtctcttcaagcctattaccagccgtcctgccaactcagagaggtatgtggtgtgcaagggcctgaaggtgggcatagatgatgttcgggattacctcttcgcagtgaatattaaactcaatcagctgcggaacacggattccgacgtcaacttggtggtccccctggaggtgatcaagggagaccatgaatttactgactacatgatacggtccaatgagagccactgtagtctgcagatcaaagctctggcgaaaatccatgcctttgttcaagacacgacactgagtgagcctcgacaggcagagatacggaaggagtgcctccgactctgggggatcccagaccaggctcgtgtggctccttcttcctccgaccctaaatcgaagttctttgagctaatccagggcactgagattgacatcttcagctacaagcccacactgctcacctctaaaaccctggagaagatccgccctgtgtttgactaccgctgcatggtatctggcagtgagcagaagttcctcatcggcctggggaaatcccagatctacacatgggatggccgccagtcagaccgctggatcaagctagacctgaagacagagctgccccgggacactctgctatctgtggaaattgtgcatgagctgaaaggggaggggaaggcccagaggaagatcagtgccatccacatcctcgatgtccttgtgctgaatggcaccgacgttcgggagcagcactttaaccagcgaattcagcttgccgagaaatttgtgaaagccgtttccaagcctagtcggcccgacatgaatcccatcagggtgaaggaggtgtacagactggaagagatggagaagatttttgtcaggttggagatgaagatcatcaagggctccagnggcaccccaaagctcagctacacagggcgtgatgaccggcactttgtacccatgggcctctacatcgtcaggacagtgaatgagccctggactatgggattcancaaaagcttcaagaagaagttcttctacaacaagaaaaccaaggactctacttttgacctccctgcagactccattgccccatttcacatttgctactatggccggctcttctgggagtggggggatggcattcgtgtgcatgactcccagaagccccaggaccaggacaagctgtccaaggaggacgtcctctccttcatccagatgcacagggcctaagagcctcagaatgtgccacccctgcagaatgccctgtcattcctgagatggggccacctggggcccacagtggtggcttcttccccctcttgaaaagggactggggagcattgcacctggcatgaggagtgggtggcctcctctccatcccctgaagagctcaggcagggccctgcagagaacactcatgttccttctgggacacctgcctgggaactttcccctgccaggactcagcctgaaggaagctgctcctgaggcaggtatgaggtcagtgcctagggcacgtgggactgatggaggacatatcagagtggcagagctgtgggctctgctgttctctcctgcatcctgtagactcacttttctgagttccatgcactgccctgagggtagccatgcccttgctttgcccaactttttattgggccatccctgagtgggtggagacctgctgtcatgagctggccaggagaacctgctataaaaaaatcaaggttttgtttctttgaacttactctgttttgatgccaaattggagaccattttcttgtctccttcccccactcatcctggccttccctggagttcttcctagcccagagctctgacagtccagcagggtgggaaggagggagtttgggcaaactctcatccctgataccacattgagatcctgggagccctcttttcgtactgagtatggagttgtagagccatcctaggtgccatccccttttggtccaaacattgggcagcgctagatggcaggaagcagccttgaagacccgtctttcccccacagcagcaggggccccagcagtaacaaagggtacctccaggggtttgggtagcgctgccctctggcagtcatgcaccgctgtctgccatagccgctctagggtcttggcagaattctgagcttgaagtgcagctcccttactaccctttcccttcctttttcttccctaataggaggtacaatctgcttttgtttgtcgttaagtggtcactcccatttcctttatcttggccgacaacacagagaggagggggagctgggcagtagcttggggtgggggtgggcacctgtggttgtttttaatgggaaatacctctcagagatgttcatgcaggctccctagggccccatcccagtgccaggctggtttccatggagatagggcactgaggctcccgtgaggttggaatcgacttcaccatgggggtccttcagccagcatccagctccccacccccaggctggcagtagcactgctgagatgctgtatttccacccaattctgggtatatcagtgtgtcttgcagaatcttggatcattaaagataaacatatttttaaaaaaaaaaaaaaaaaaaaaaaaaaaagggcggccgctctagaggatccctcgaggggccc

SEQ ID NO: 1344 - DNA, 4893 bp, Homo sapiens
ccacgcgtccgtgagaagataatcctgagaggctgcatcctgagaaataccagctggtgttttggaatggttatttttgcaggtcctgacactaaactaatgcagaatagtggtaagacaaagtttaaaaggacaagcattgatagattgatgaatactctagtactatggatttttgggtttctgatatgcttgggaattattcttgcaataggaaattcaatctgggagagtcaaactggggaccaattcagaactttcctcttttggaatgaaggagagaagagctctgtgttctccggattcttaacattctggtcatatattattattctcaatacagttgtacccatttccttatatgtgagtgtggaagtaattcgtctaggacacagttattttataaactgggaccggaagatgtattattctcgaaaagcaatacctgcagtggctcgaacgaccacgctcaatgaggaactggggcagattgagtacattttctccgacaaaacgggtaccctcactcaaaacatcatgacctttaaaagatgttccattaatgggagaatctatggtgaagtacatgatgacctggatcagaagacagaaataactcaggaaaaagagcctgtggatttctcagtcaaatctcaagcggatagagaatttcagttctttgaccacaatctgatggaatccattaaaatgggtgatcccaaagttcatgaattccttaggttacttgctctctgccacactgtaatgtcagaagagaatagcgcaggagagctgatttaccaagttcagtcacctgatgaaggggctctagtgactgccgctagaaattttgggttcatttttaaatcccggaccccagagaccataacaatagaagaattgggaacactagttacttatcaattacttgcctttttggatttcaacaacaccagaaaaaggatgtctgtcatagttcgaaacccagaaggacagataaagctttattccaaaggagcagatactattctgtttgagaaacttcatccttccaatgaagtccttttgtctttgacgtcagaccacctcagtgaatttgcaggggaaggccttcggaccttggccatcgcatacagagacctggatgacaagtactttaaagagtggcataagatgcttgaagatgcgaatgttgccacagaagagagggatgaacgaatagctgggctatatgaagaaattgaaagagatttgatgctactaggtgccactgctgtagaagataagttacaggagggtgttattgaaacagttacaagtttatcactagccaatattaagatctgggtcctaacaggagacaaacaagaaactgccatcaacatcggttatgcctgcaacatgctgactgacgacatgaatgatgtgtttgtgatagcagggaataatgctgtggaagtgagagaagaactcaggaaagcaaaacaaaatttgtttggacaaaacagaaatttttccaatggccatgtagtttgtgaaaaaaagcagcagctggagttggattctattgtagaagaaaccataacaggagattatgccttaatcataaatggccacagtttggctcatgccctagaaagtgatgtcaagaatgatctcctagaacttgcttgcatgtgtaagactgtaatttgctgcagggtcactccactccagaaagcccaagtggtagagctggtgaagaagtacagaaatgctgttactttggccattggtgatggagccaatgatgtcagcatgattaaaagtgctcacattggtgttggcatcagcggccaggaaggattgcaagcagtcttagccagcgactattcatttgcacagtttagatatctccaaaggcttctccttgttcatggaaggtggtcttatttccgaatgtgcaaattcttatgctatttcttctataagaattttgcatttacacttgtgcatttctggtttggtttcttctgtggtttctcagcccagactgtttatgaccagtggttcatcaccctttttaacattgtttacacatcactgcctgttttagccatggggatttttgaccaggatgtgagtgaccagaacagcgtggactgtccccagctctacaaaccaggacagctgaatctgctttttaacaagcgtaaatttttcatttgcgtgatgcatggaatctacacctcattagtccttttcttcatcccctatggggccttttacaacgtggctggagaagatgggcaacatattgctgactaccagtcctttgcagttaccatggccacatctttggtcattgtggtcagtgtgcagatagccttggataccagttactggactttcattaatcacgtcttcatctgggggagcattgccatttatttctccattttatttacaatgcacagtaatggcatctttggcatcttcccaaaccagtttccatttgttggtaatgcacgacattccctgacccagaagtgcatctggcttgtaattctcttaacaacagtggcttcagttatgccagtggtggcattcagatttttgaaggtggatttatacccaaccctgagtgatcagatccgccggtggcagaaggctcaaaagaaggcaaggcctccaagtagccgaaggcctcggacccgcaggtcaagctcaagaaggtctggatatgcttttgctcaccaagaaggctatggagagcttatcacatctggaaaaaatatgcgagctaaaaatccacccccaacatcagggctggaaaagacacattataatagcactagctggattgaaaatttatgtaagaaaaccacagacaccgtgagcagctttagccaggataaaacagtgaaactgtgagtcaatatgaatttaaaccacgtagttatcttttcacttcaggtggagctgaaattctgctggctccagagtttgagatttgaggcaagaggtggggcaggcagattgcctcacttaacttaaatctgcggcagacaactgccagtgcccatcaaacaggagtgtgcgctatggaaaaccaggccagagggtcactgtctggtttgtgatttggtggacaaaacactcgctgttacaagtacagattttttttttttttaaatcaacctagataccaattgacctgaactttagaatcttatttatggagaaaaacttgtaaagctgcatattcactgaatggatcctcaggcggataaaagggtgcattttaaaggtatatatccaagctgaaaagcatgcctattgacagataaacatgtatctgtaagatcagcctttcccaaggtatacttttaaaatttaaagcgtgtactgtgttgctttcagactgagttgcatgtcactctttagtcttgatatctacctgtctgttcagccaggacaacaaatggcttccaagcctgaagaatacaaaagtgtgcttgtgtttctcatttttataccagtctagggacaaaggagactgaacatctttgcagcaggataggctggtaatttgatcaaatttattcaaaaagctctcagtctgtgtcatgtaaggacatgcttatgaaatgtgagagaggctcgccactaagtattctaaatacttttcaatggcttttctaacaacctcagtagtaatttgctgagcatcatccagaccattaatagaatcagcaaagcactggaatttcacactttaatgataatattccacatagtctatgggcaaatattttcaacatttccaatttttaaagcttcagaattgaagccaaacaaattaataaataattgttttaattactatttaaaaactcaggtttagattgtttaaaattagttgcttttgatactcagctgtcatgtttataattcaaacatgtagtaaacatatgtaggtaaggttgtttttttggagatgttgcagctcaaatttcagtccacatatgaatcatcagtgtattttccataaagtgattcgggcatatttgtgtgaaaacctcagttctgtcacttcttacctctataaacttggacgataatgtgccttctctgagactcagtttcttcctctgtaaaatgaggacatactacctacctcacgtggttggttgatgattgtctgtcaaagcacaaactctgaaattattaaaaacataattatttcataaacagatgagttaagttccagttaactcaacatcagtataacagagcaattggaagagaatatgaaaaaactggaatctaaatagtcagtgaggaaggctttgataaaatgaaattgccagaaagatataaaactggttagggtcctacagggaaataaaattataaccgtggaggtacatttctctaccagaaagcaaaaataaagcatcatgtcttaatggttttctacaaatcaacttctaattctacagagtccttaatctggtccctattaaattcttggtcagacaaagttacatttcccaagagagtcaggtgacacttgagtgagtttgatggataatgagctaatgtgatatctataggtcacaattttttaaaaccaaaattttcaagtctgggataatctttcctaaatgggatcaaatgaaataatatgtgtaaaagagtcaaatgcagtcctttaccatagtaactgcctatggacgttgtctttcccttacatgcctgcctacacttaaccagatgttggttttcaatgtctaatttgtcattagtttcaccacatttgctcactttttgtaacatttttgcaagatttgaaaactttcagtaaatgttttggcactattggtaaaaaaaaaaaaaaaaaaaaaaaaa

SEQ ID NO: 1345 - DNA, 4442 bp, Homo sapiens
ccacgcgtccgaggaagagctcggcatcgcccctcttcctccaggtcccccttccccgcaacttcccacgagtgccaggtgccgcgagcgccgagttccgcgcattggaaagaagcgaccgcggcggctggaaccctgattgctgtccttcaacgtgttcattatgaagttattagtaatacttttgttttctggacttataactggttttagaagtgactcttcctctagtttgccacctaagttactactagtatcctttgatggcttcagagctgattatctgaagaactatgaatttcctcatctccagaattttatcaaagaaggtgttttggtagagcatgttaaaaatgtttttatcacaaaaacatttccaaaccactacagtattgtgacaggcttgtatgaagaaagccatggcattgtggctaattccatgtatgatgcagtcacaaagaaacacttttctgactctaatgacaaggatcctttttggtggaatgaggcagtacctatttgggtgaccaatcagcttcaggaaaacagatcaagtgctgctgctatgtggcctggtactgatgtacccattcacgataccatctcttcctattttatgaattacaactcctcagtgtcatttgaggaaagactaaataatattactatgtggctaaacaattcgaacccaccagtcacctttgcaacactatattgggaagaaccagatgcaagtggccacaaatacggacctgaagataaagaaaacatgagcagagtgttgaaaaaaatagatgatcttatcggtgacttagtccaaagactcaagatgttagggctatgggaaaatcttaatgtgatcattacaagtgatcatgggatgacccagtgttctcaggacagactgataaacctggattcctgcatcgatcattcatactacactcttatagatttgagcccagttgctgcaatacttcccaaaataaatagaacagaggtttataacaaactgaaaaactgtagccctcatatgaatgtttatctcaaagaagacattcctaacagattttattaccaacataatgatcgaattcagcccattattttggttgccgatgaaggctggacaattgtgctaaatgaatcatcacaaaaattaggtgaccatggttatgataattctttgcctagtatgcatccatttctagctgcccacggacctgcatttcacaaaggctacaagcatagcacaattaacattgtggatatttatccaatgatgtgccacatcctgggattaaaaccacatcccaataatgggacctttggtcatactaagtgcttgttagttgaccagtggtgcattaatctcccagaagccatcgcgattgttatcggttcactcttggtgttaaccatgctaacatgcctcataataatcatgcagaatagactttctgtacctcgtccattttctcgacttcagctacaagaagatgatgatgatcctttaattgggtgacatgtgctagggcttatacaaagtgtctttgattaatcacaaaactaagaatacatccaaagaatagtgttgtaactatgaaaaagaatactttgaaagacaaagaacttagactaagcatgttaaaattattactttgttttccttgtgttttgtttcggtgcatttgctaataagataacgctgaccatagtaaaattgttagtaaatcattaggtaacatcttgtggtaggaaatcattaggtaacatcaatcctaactagaaatactaaaaatggcttttgagaaaaatacttcctctgcttgtattttgcgatgaagatgtgatacatctttaaatgaaaatataccaaaatttagtaggcatgtttttctaataaatttatatatttgtaaagaaaacaacagaaatctttatgcaatttgtgaattttgtatattagggaggaaaagcttcctatatttttatatttacctttaattagtttgtatctcaagtaccctcttgaggtaggaaatgctctgtgatggtaaataaaattggagcagacagaaaagatatagcaaatgaagaaatattttaaggaaacctatttgaaaaaaaaagcaaagaccatttgataaaagcctgagttgtcaccattatgtcttaagctgttagtcttaaagattattgttaaaaaattcagaagaaaagagagacaagtgctcttctctctatctatgcttaatgcctttatgtaagttacttagttgtttgcgtgtgcctgtgcaagtgtgtttgtgtgtggttgtgtggacattatgtgatttactatataaggaggtcagagatggactgtggccaggcttccacattcctgaagcacacagatctcaggaaaggttatttttgcacttcatatttgtttactttctcctaactcacaagttaaaatcataacttaatttcattaacttttatcatttaactctctcatgtttgttgtaacctgaggtatccaaatgctacagaaaaatttatgacccaaatacaaatctcaatttgactgggacagaatgaggaatggagatttttgtatttatctttgggactttatgccttactttttaggctatagaatagttaagaaattttaaacaaaatttagtatcttttggtctttcacaccattcatatgttaagtggcagaatagccttagtgctacctccacttttttctccagtatttgcatcacagaaataatccctctgtttaacatgtttgttcagagccaagggtttattgtgaagaactgtcatcctgcctttgctagctggtaccttctagtaatcaaaattaatatgaagaaactaggttgtgacagactagattatatttagtaggggaaaaattgggctcaagaaccattcatcagtacgtgagacaagcagttaatagtatgatctttaaagttttgacaatataaaataaacttggtaactgttttacaaatataaaagtataataaatatgcagcccagttaaatattgattatctgtgatggtaaagaacaacagtggtgccagtcatcaaacatacagtgcgtcctattgagtcactgctaatttcttgagcctggtatttgctgcctatggtatttgtggttgttgagaggcattttcaaaccctgtataaataatccatgctgttggtcataagttagctgtattaagaacagtaaaataaataaaagccaatagtactaattttgctttaaaaaaatttctaatttttttcacataaaacaattatcctaaaggttaatagttgatcgaaacagaataatagaaaaattctactttaatttccattaaaaagcaaatagcattgacacatttaaagcttttcatttaaagtagtggatgttttgaagtatctaaaatagtagcagaatattttatacttggtccttgcaatggtgtgagttttaatgattgcattatcgtgattggtggttatgagtttcagaaatctatacttggcatccaactcatgagtggattttatataggatggaacaggaaggtatgtcctgtcagtatcttaaccctttcaacaagacatttacctatttgtctttccttacgttctcaaaatattaactcgaattgtaaattaagcaaaaatttaaaaagtatatgttgatgggacaagaagaatagtatttatttaataaaacatatattatattgaactatgtgttaattcatttgtatcttttaaaaaattatcactgttaaagccattgactcctttagtacactgagaaaaatcttatagtaaaactagcctttcacattaaggttttggtgtgtattttgttaaataactaacatgctgctctattttctgggtgtagaaagtatttggctctaggaaacatttacttgtttgtgaaaacaataccccaaggtaataggaaaagtttgagttaagtgtttttaattcagtcagtgaattcagaataagtacattcatgtataacatagggacagttctgctgctgttatttatatgcaattcttctggtaaatagcaatagaataaaacatatttcaatgtttgtgtataggttttatattattattccactaggaatggcataagaatttatagataaattcttgtaacattaaaggattaaaatgtttttacattgtttttgggtgtctccttcttgtgcccatatctgataagctttatggattattgcatttaattccttttatttggagggttttacttccttgttaacatataaagttataaatgaaggacaaggaggagatggaaaatgtgtatttattgttaattcttaaaatagtgtgtaaataaaataacatcagtgtgctttaaaaaaaaaaaaaaaaa

SEQ ID NO: 1346 - DNA, 1465 bp, Homo sapiens
ccacgcgtccgaagaaagaagcggggcgaataagcacggttgagctacagaaaatggtggctcgagtcttttattatctttgtgtcattgcactgcagtatgtggcgcctctggtaatgctgcttcacacaactctgcttttgaaaacactaggtaatcattcctggggtatttatccagaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcataatccaaatcaccctttaaattaaaatatctgtgcccttaaagggctgatgaaaaccagaagaaagcaaatacaatgggaaaaaaaaaacatatcagaatgtcttgtattaaatgtttcctctgtattctcagggtgaattaatgtagtaatatttaaaattacaaaatagattgttaactgttacactgtggcattggaattttaactctttgtatttactggtatgagagggctatctacaagggtaatatttctgattaccctggtttacagaaacctccagcagtctttgaaacatctcacatgactctagttattgattgcttttaatggttttatggtactgttgatagtcatagtggctgcctatagaacaatcttcaaactgagccatgctttaggggagggaaaggggctaaagtctcttctgttggtaatttattagttactcttgaaacagtaaaatccaacagaaaggaagagatagctactgtatattacagtaaagaaagctgcatagttattttaaatttaatggagatgaatatggttaaaatatataactactgctgcttgagaatagcaagagtattgttttaaaacatattccacccaacttgagagttcttttaaaatgattggccatatgaacatttgtaatcttgccattaggtttggacctgccatattttgttttattctgtgatcctaactagttccttttaataggctaaaatatttatcaatactgatcagactttaaagaaattactttgtaaacctgctgactacctgtatgtattgtatatatattatatattaaatatataatatattgagattataaaagatgaaaatattgaatccttataatattttaagttgcagaatgtatgttaaaaagtgacttgaatgagatgtatttgtatctagaaattttatttctttttggaatgagattaaaatacattttgaaagttcaaaaaaaaaaaaaaaaaaaaaaaaaaaaa

SEQ ID NO: 1347 - DNA, 837 bp, Homo sapiens
  misc_feature (717)..(717): n equals a,t,g, or c
cactatagaaggtacgcctgcaggtaccggtccggaattcccgggtcgacccacgcgtccgggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagtttcytgaggsctccccagccatgcttcctgtacagcctgcaraactgtgagtcaattaaacctcttttcttcataaattccccagtttccagtagttctttatagcagtgtgaaaacagactaatggacccttctggttgaaggaatgyagccattctgcttgtttrastatktcctttctattcatctctatttccygggaggtgtttatccaagtgcaataggagrtattggtgacygcasagtcccctcagtgttctgctagtaaatagttgaaggttgatcaktgatctycwgcrttttcagtctggcatggaaaagccccyrtgyaactggtaaagrtatcartaagcaccaggaggtatctaaatccaccaggagccataggcatcacgttgacgtccatttaccagtcttccctggcaagattcttctgaattgtgctgccttggccaaaagaggtatggnaggggctgggcrcagtggctyrygcctgtratcccagcaggagttcgagaccaggcaggagaatcactagcagagaatatgtctccccaacccctctcaaaaaaaaaaaagggcggccgc

SEQ ID NO: 1348 - DNA, 3354 bp, Homo sapiens
  misc_feature (1084)..(1084): n equals a,t,g, or c
  misc_feature (1463)..(1463): n equals a,t,g, or c
gggatgtgctgtgtcctgtctatgacctggacaacaacgtagccttcatcggcatgtaccagacgatgaccaagaaggcggccatcaccgtacagcgcaaagacttccccagcaacagcttttatgtggtggtggtggtgaagaccgaagaccaagcctgcgggggctccctgcctttctaccccttcgcagaagatgaaccggtcgatcaagggcaccgccagaaaaccctgtcagtgctggtgtctcaagcagtcacgtctgaggcatacgtcagtgggatgctcttttgcctgggtatatttctctccttttacctgctgaccgtcctcctggcctgctgggagaactggaggcagaagaagaagaccctgctggtggccattgaccgagcctgcccagaaagcggtcaccctcgagtcctggctgattcttttcctggcagttccccttatgagggttacaactatggctcctttgagaatgtttctggatctaccgatggtctggttgacagcgctggcactggggacctctcttacggttaccagggccgctcctttgaacctgtaggtactcggccccgagtggactccatgagctctgtggaggaggatgactacgacacattgaccgacatcgattccgacaagaatgtcattcgcaccaagcaatacctctatgtggctgacctggcacggaaggacaagcgtgttctgcggaaaaagtaccagatctacttctggaacattgccaccattgctgtcttctatgcccttcctgtggtgcagctggtgatcacctaccagacggtggtgaatgtcacagggaatcaggacatctgctactacaacttcctctgcgcccacccactgggcaatctcagtctgccttgtgttgccccttctagcgccttcaacaacatcctcagcaacctggggtacatcctgctggggctgcttttcctgctcatcatcctgcaacgggagatcaaccacaaccgggccctgctgcgcaatgacctctgtgccctggaatgtgggatccccaaacactttgggcttttctacgccatgggcacagncctgatgatggaggggctgctcagtgcttgctatcatgtgtgccccaactataccaatttccagtttgacacatcgttcatgtacatgatcgccggactctgcatgctgaagctctaccagaagcggcacccggacatcaacgscagcgsctacagtgcctacgcctgcctggccattgtcatcttcttctctgtgctgggcgtggtctttggcaaagggaacacggcgttctggatcgtcttctccatcattcacatcatcgccaccctgctcctcagcacgcagctctattacatgggccggtggaaactggactcggggatcttccgccgcatcctccacgtgctctacacagactgcatccggcagtgcagcggngccgctctacgtggaccgcatggtgctgctggtcatgggcaacgtcatcaactggtcgctggctgcctatgggcttatcatgcgccccaatgatttcgcttcctacttgttggccattggcatctgcaacctgctcctttacttcgccttctacatcatcatgaagctccggagtggggagaggatcaagctcatccccctgctctgcatcgtttgcacctccgtggtctggggcttcgcgctcttcttcttcttccagggactcagcacctggcagaaaacccctgcagagtcgagggagcacaaccgggactgcatcctcctcgacttctttgacgaccacgacatctggcacttcctctcctccatcgccatgttcgggtccttcctggtgttrctgacactggatgacgacctggatactgtgcagcgggacaagatctatgtcttctagcaggagctgggcccttcgcttcacctcaaggggccctgagctcctttgtgtcatagaccggtcactctgtcgtgctgtggggatgagtcccagcaccgctgcccagcactggatggcagcaggacagccaggtctagcttaggcttggcctgggacagccatggggtggcatggaaccttgcagctgccctctgccgaggagcaggcctgctcccctggaacccccagatgttggccaaattgctgctttcttctcagtgttggggccttccatgggcccctgtcctttggctctccatttgtccctttgcaagaggaaggatggaagggacaccctccccatttcatgccttgcattttgcccgtcctcctccccacaatgccccagcctgggacctaaggcctctttttcctcccatactcccactccagggcctagtctggggcctgaatctctgtcctgtatcagggccccagttctctttgggctgtccctggctgccatcactgcccattccagtcagccaggatggatgggggtatgagattttgggggttggccagctggtgccagacttttggtgctaaggcctgcaaggggcctggggcagtgcgtattctcttccctctgacctgtgctcagggctggctctttagcaatgcgctcagcccaatttgagaaccgccttctgattcaagaggctgaattcagaggtcacctcttcatcccatcagctcccagactgatgccagcaccaggactggagggagaagcgcctcaccccttcccttccttctttccaggcccttagtcttgccaaaccccagctggtggcctttcagtgccattgacactgcccaagaatgtccaggggcaaaggagggatgatacagagttcagcccgttctgcctccatagctgtgggcaccccagtgcytaccttagaaaggggcttcaggaagggatgtgctgtttccctctacgtgcccagtcctagcctcgctctaggacccagggctggcttctaagtttccgtccagtcttcaggcaagttctgtgttagtcatgcacacacatacctatgaaaccttggagtttacaaagaattgccccagctctgggcaccctggccaccctggtccttggatccccttcgtcccacctggtccaccccagatgctgaggatgggggagctcaggcggggcctctgctttggggatgggaatgtgtttttctcccaaacttgtttttatagctctgcttgaagggctgggagatgaggtgggtctggatcttttctcagagcgtctccatgctatggttgcatttccgttttctatgaatgaatttgcattcaataaacaaccagactcagaaaaaaaaaaaaaaaaaaaaaaaaaaaaaaaaaaaaaaaaaaaaaaaaaagggcggccgc

SEQ ID NO: 1349 - DNA, 1810 bp, Homo sapiens
aattcggcagagccatcttgctctaagtgaaagtgaaagaaaagtcggcagcagagggaacagggaagaaacctaaaggctgcaggctgccaggtgtgcttggagagcccccttcttccgccgggcctcgcaagcagcgtaggactgtggagaagggcggtgggcaaggagggaactcgagagcagcctccatgggcacacaggagggctggtgcctgctgctctgcctggctctatctggagcagcagaaaccaagccccacccagcagaggggcagtggcgggcagtggacgtggtcctagactgcttcctggcgaaggacggtgcgcaccgtggagctctcgccagcagtgaggacagggcaagggcctcccttgtgctgaagcaggtgccagtgctggacgatggctccctggaggacttcaccgatttccaagggggcacactggcccaagatgacccacctattatctttgaggcctcagtggacctggtccagattccccaggccgaggccttgctccatgctgactgcagtgggaaggaggtgacctgtgagatctcccgctactttctccagatgacagagaccactgttaagacagcagcttggttcatggccaacatgcaggtctctggagggggacctagcatctccttggtgatgaagactcccagggtcrccaagaatgaggcgctctggcacccgacgctgaacttgccactgagcccccaggggactgtgcgaactgcagtggagttccaggtgatgacacagacccaatccctgagcttcctgctggggtcctcagcctccttggactgtggcttctccatggcaccgggcttggacctcatcagtgtggagtggcgactgcagcacaagggcaggggtcagttggtgtacagctggaccgcaggcaggggcargctgtgcggaagggcgctaccctggagcctgcacaactgggcatggccagggatgcctccctcaccctgcccggcctcactatacaggacgaggggacctacatttgccagatcaccacctctctgtaccgagctcagcagatcatccagctcaacatccaagcttcccctaaagtacgactgagcttggcaaacgaagctctgctgcccaccctcatctgcgacattgctggctattaccctctggatgtggtggtgacgtggacccgagaggagctgggtggatccccagcccaagtctctggtgcctccttctccagcctcaggcaaagcgtggcaggcacctacagcatctcctcctctctcaccgcagaacctggctctgcaggtgccacttacacctgccaggtcacacacatctctctggaggagccccttggggccagcacccaggttgtcccaccagagcggagaacagccttgggagtcatctttgccagcagtctcttccttcttgcactgatgttcctggggcttcagagacggcaagcacctacaggacttgggctgcttcaggctgaacgctgggagaccacttcctgtgctgacacacagagctcccatctccatgaagaccgcacagcgcgtgtaagccagcccagctgacctaaagcgacatgagactactagaaagaaacgacacccttccccaagcccccacagctactccaacccaaacaacaaccaagccagtttaatggtaggaatttgtattttttgcctttgttcagaatacatgacattggtaaatatgccacaaaaaaaaaaaaaaaaaaaaaaaaaaaaaaaaaaaaaaaaaaaaaaaaaaagggcggccgc

SEQ ID NO: 1350 - DNA, 1181 bp, Homo sapiens
  misc_feature (903)..(903): n equals a,t,g, or c
gggtggggccccgggccgaggcgatggcgccctgggcgctcctcagccctggggtcctggtgcggaccgggcacaccgtgctgacctggggaatcacgctggtgctcttcctgcacgataccgagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatggtcaggcctccggttcttccagccctggggtctgtggttgcggtccagcgggctcctgttcgccaccttcctgctgctgtccctcttctcgttggtggccagcctgctcctcgtctcgcacctctacctggtggccagcaacaccaccacctgggaattcatctcctcacaccgcatcgcctatctccgccagcgccccagcaaccccttcgaccgaggcctgacccgcaacctggcccacttcttctgtggatggccctcagggtcctgggagaccctctgggctgaggaggaggaagagggcagcagcccagctgtttagggttgctggaggccgggctaccgtcttgtgcctgaaaaccacggggcctgtccccagctggggtgagcgctcaganggcctggggccctcactcctgcccacgcctcccagaccccagaacggagcttcaagtcagacagatccctgccttggtgggcagttctgccttccaaggaagaaggggaagaaaaggacctgtgggtggctcaggcccaagcagaccccgggctccaccccagccccgcccaggctgctgccagtgcacacttttacaaatttaatataaagcaagtccagtcttaaaaagacaaaaaaaaaaaaaaaaaaaaaaaaaaaaaaaaaaagggcggccgc

SEQ ID NO: 1351 - DNA, 2932 bp, Homo sapiens
ccacgcgtccgcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccgcttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggcaaaaaaaaaaaaaaaaaaaaaaaaaaaaaaaaaaaaaaaaaaaaaaaaaaaaa

SEQ ID NO: 1352 - DNA, 3542 bp, Homo sapiens
gcgtccggttaagttctatggccgctgcagggtctgtgaaggcggcgttgcaggtggccgaggtgctggaagccatcgtgagctgctgcgtggggcccgagggacggcaagttttgtgtacgaagcccactggcgaggtgcttctcagccggaatggaggccgcctcctggaggcgctacacttagagcatcccatagccaggatgatagtggactgtgtttccagtcatctcaaaaaaacaggagatggtgcaaaaacatttattatctttctttgccatttgcttagaggacttcatgcaatcacagacagagaaaaggatcctttgatgtgtgaaaacattcaaacccatggaaggcattggaaaaattgttctcggtggaaatttatttcccaggctctcctaacgtttcagacacaaatattagacggtattatggaccagtacctaagtagacactttttgtctatcttttcgtctgctaaagagagaacattgtgtaggagctctttagagtctgtctcttagaagcatacttttgtggaagagtgggaagaaataatcataaatttatttcacagttgatgtgtgactactttttcaagtgtatgacttgtaaaagtgggattggtgtatttgagttagtggatgaccattttgtagagttgaatgttggtgtcactggccttcctgtttcagattccaggatcatagctggtcttgtgcttcagaaagatttttctgtgtaccgcccagcagatggtgacatgcgaatggtgatagtaacagaaaccattcagcctcttttttccacttctggatcagagtttattctaaattcagaagcacagtttcagacatctcaattttggattatggaaaagacaaaagcaataatgaaacatctacatagtcagaatgtaaaattgctcatatctagtgtgaaacaaccagatttagttagttattatgcaggggtgaatggcatatcagtggttgagtgtttatcatcagaagaagtttctcttatccggaggatcattggtctttctccatttgtaccaccacaggccttttcgcagtgtgaaatacctaacactgctttggtgaaattttgtaaacctcttatccttagatccaaaagatatgttcatctaggcttgataagcacatgtgcatttataccacactctatagttctttgtggaccagtgcatggtctcattgaacaacatgaggatgctttacatggagcacttaaaatgcttcggcaattatttaaagaccttgatctaaattacatgacacaaaccaatgaccaaaatggcacttcaagtctttttatttataagaacagtggagaaagttatcaagcaccagatcctggtaatggctcaatacaaaggccttatcaggacacagttgcagagaacaaagatgcattggaaaaaactcaaacatatttaaaagtacattctaatttggtaattccagatgtagaattagaaacatatattccgtattcaacccccacactgacaccaacagatacattccaaacagttgaaacgctgacatgtttgtctttggaaagaaacaggctaactgattattatgaaccattactcaagaacaattccactgcttattcaacaaggggaaatagaatagaaatttcttacgaaaatttacaggtcacaaatattactagaaagggaagcatgttaccagtgagctgtaagttaccgaatatgggtacttcccagagttacctttcctcatctatgccagctggttgtgttttgccagtaggtggtaattttgagatcttgttacattactatcttctcaattatgccaaaaaatgccatcaatcagaagaaaccatggttagtatgataatagctaatgcacttttaggcattcccaaagtcctttataaatctaaaacaggaaagtacagctttccacatacatatataagagctgtccatgcactgcaaaccaatcaacccttggtaagcagtcagacaggtttggaatcagtaatgggtaaataccagctactaacttcagttcttcagtgtttgacaaaaatattaaccattgacatggtaatcactgttaagagacaccctcagaaagttcacaatcaagattcagaagatgaactataacatcagaagtttttaattaaccaaacttttcatctaactcaagccaagtaaagcagtcatgtgaccactggttctaaagtcagttcagtctacttaggaaaatagcgtaactttaaaagtctttagaagaagcacactaaggtcaccagaccagatacaaatattaaattactttatggaacaaatctagaggggaagccaagatttggctaagtgtgtctgttttttccctattttatgcctctgtgtctcagctctgtgttagcctatgtgtttaggggagggtttttctttatagctcctttttactctcctgtatctttttcactccagccctccttcatcgttacatgtttagttcatagaatcatttaatctctgatttgggtgggcttattctaattgtttttaatattgaatacattatttgcattaattttccctactcatactttgtaaagctgagtaaaaggctcaaattatttttttcaaaaagcataaaattaaattagcagtgagtaaaaggctcaaattttttttcaaaaagcataaaattaatttttacttttatgtggtcattggtttactgccacttcatttggaaaacttggatagattttcacctttgatatacctttgaatatatgttacctgaaatataactgtgcattgctaactctttcatttctgtagtaaaaggttaatactagaaaggatatgcaattaatactttgattttctcctgaccccaagagcttgtaaggatatgtcatgtatttactggtttttcttgtatctggtgcatagccagagttccacagtaacaaataatttgacaatttttatttctaatgtttatttctgttttatttttaatttttatttctaatttatttcatttacaaatgttcatattttaaaaacttgtcaatgtaaataatatgatgcatcttatcatggacaaggacagtgttttctacctttatcagttctctgtaatacccaaaacagtgctgtatttactccaagtattcagaagtgcttgttgaataaaacagtgttatctttaattcattcctttaaatacatgtttccagtttacttattcaacagattcttacttgggattgactgaagaaaaaaaactttaattatagttgaataagtgttgactaatgtattttaaaaactataatatcaaaattttttatattaaatgtaattctgattttttaaacatttatgctatatgatgcattattttgtttctgtgaatatggagagaataaattagctcttttgctgaaaaaaaaaaaaaaaaaaaaaaaaaaaaaaaaaaaaaaaaaaaaaaaaaaaaaaaaaa

SEQ ID NO: 1353 - DNA, 1290 bp, Homo sapiens
ccacgcgtccgggcctggcgatgctgtctgtgggcatcgggatcgactacacccacatcgaagtgctcatcgatggaaaggggtgtaagccccccgagtacaggaattaccagatcgtcttcatcgtcttcggcgttctcatgaccatggccttgatcgttgccactcagttccggttccgctacaaccatttcaaaaacgatgattctaaagggaaagaggtggagatcccgcaggtggaaaggaacaactctacagagtcctctgaggagacaccaaccaccacaagccactcgcaggccttcaacttttgggacttaatcaagctgctctgcagcgtgcagtatggctcagtgctgtttgtggcttggttcatgggttttggatatggcttcgtgttcacctttctctactggcatttggaagacctcaatggaactacaaccctctttggggtctgttcagtcctgagtcatgtgtctgagctgacagcatatttttttagtcacaagcttattgaattgatcggccacatcagggttctgtacattggcctggcctgcaatacggctcgctatattatatttcctacctggagaatgcctggactgttctccccatggaagttcttcaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgcttctgagatacagcctttacaggggaccaatgagaatagggaaaattctcctgctggtagagcccagcctgtcccatgtgagactccatctaaaaaaaaaaaaaaaaaaaaaaaaaaaaaaaaaaaaaaaaaaaa

SEQ ID NO: 1354 - DNA, 1082 bp, Homo sapiens
  misc_feature (211)..(211): n equals a,t,g, or c
  misc_feature (1027)..(1027): n equals a,t,g, or c
  misc_feature (1041)..(1042): n equals a,t,g, or c
  misc_feature (1079)..(1079): n equals a,t,g, or c
gtttccttggggacgtggcgccgccgccggccgggccctccttccggctgggcaaggggccgcggggagcagctcgggactgaaccgagaggtgccgaaggaaccggcgggccgcttgatcccgctgcagacgtaggagatgcctgggacaaggaggccaccttctcagggcaaaagaaaaagaaggtgacaggcgttgagaccaccgaanggaacccatggctaggatcagtttttcctacctctgcccagcctcctggtacttcactgtgcccacagtgagtccatttctccgtcagcgggtggcattcctgggactcttcttcatatcctgtctccttttacttatgttaatcatagactttcgacattggagtgcttcattaccacgagataggcaatacgaaaggtatttggctcgagtaggggagcttgaagctactgacactgaagacccaaatctgaattatggacttgktgttgactgtggcagcagtggttcccggatttttgkttatttctggccaagacataatgggaacccccatgacttgctggacatcaaacagatgagagaccgcaacagccaaccagtggttaaaaaaatcaagccaggaatctctgcaatggcagacactccagaacatgccagtgattaccttcgtcctctgctgagctttgctgctgctcatgtgcctgtgaagaagcacaaggagacccctctttacatcctctgcacagcaggcatgaggcttctccctgagaggaagcagttggctatcttggctgacctagtgaaagatttaccactggagtttgacttcctcttttcacagtctcaagcagaagtgatctctgggaagcaggaaggggtttatgcatggattggaatcaactttgttttgsgaagattcgaccacgaggatgaatcagatgctgaggctacccaggaattggcagcaggacggagaaggacagtagggatactggatatgggaggagccyctcyccaaattgcttatgaagntcctacctttcccnnaaaaaaaaccccccccctttttccccttttggggggnata

SEQ ID NO: 1355 - DNA, 1927 bp, Homo sapiens
ccacgcgtccggtggtcacggtcttactgtttcaaggtttttaaataagaaaaccaaccctgccttcgcccatgcccgcccctgcccgcagttgccaaagagccgccttgtcgctgtgggcgtcagggcttggctggctcagtgcacaacccacagtggccttcagaggctcctcctgggactgggaaccgccgcagggccaggcggacggcgtgaggtttgtgttggggctggttctgcccatgctagggggtgggggagctcccaggacagaccagccttgtttctcatgtaatgcagtgacgctgtcattaaacacgtggattcatgtgtggccgggactggctggctctaggtccccggctcgggtggggtcacacggtcctgccctagagcccccatctggccctggagctgcagaagcagcttctgaggggcttcccaggcctgcatttcacagatggggagctcagccctcgaaggccgcagagacgcctcccaggcccgtctgccagggcgccggccacaatcctgcagggccaaggactggactccaggcaagtccctgcgctccagctggacggccctgttccagggaggaggtgctcggttgacaccatcagggagggagggtgggcactgctgggctgagttcacccccagggctggccagatggggccaggagggacagagcaaggggggtgaaggccgtggtgggagggtcccatgatgatgggccagggctcgtgtagaaatgggggaattggttccccatggcccaggacagctgagaggaggtggaggggccccaggggagtgtacgtcaggctttgcggggcacgggggccactcagcagcgctggggcaggtgcctctgctgtcagctccacccgacaggcagacgaaggccagtggggccatcgcttcctggggcgaccctggcagtggttgggagacgcccagatggagggggaggctgaccaagggccccgcagggcgggctgcaacttttctgttgatcctggaatgtagctggtgcagtgagagggaaagagaattgaaaaactcaggctgccataggttctgcgatgagaggtgcaggaggcaggagcctggcccagggggtgctggtgcctccccggggtctgggcggagagaacaggaggaatggctgggaagtggctgagggagccaggaggccggggggccgggggctgcaggggaggctgtgggggtcctggcagccaggaggccccaggtggttttgaggctcgctcttgcgcggtgcctgagaagagggtgaaggagctggggcaggccccatcctgggcattggagatgatgaaaccgagcagacctggcccatgtggagctggcatgggggacacagcccagagacagagaagcttatgaggaagtgaggaggtggcgtcacaagggtggggagggggccttggggaagggcggccttggatcagaggctcaccacaagcctggcatttcagccagggctggagaaggcagggacgcctgggtgagaggcaaagggcacagccatgcaaaggccctggggcaggacggcacctggtatgcgggaggaacagagtgaggagaggagggcagggcgtgcagggccttgtgggcctcagggaggacttgggcacctaccccgagggagtggagctcctgggtgcgtgtccagatgggaaaggcagggtcgtatctgtggggacctgacaagggcaggggaagcggagaccagggtgcaggctccgcccccacccaaggccgggcccagccagaggaggggcagggcagggcaggaggtttctggatgtttgttgggtttggtttggttttgttttgttttgtttattgtggtaaaatacaaaatctaccgtcttaaaaaaaaaaaaaaaaaaaaaa

SEQ ID NO: 1356 - DNA, 578 bp, Homo sapiens
  misc_feature (576)..(576): n equals a,t,g, or c
gggacatctgccggctggagcgggcagtgtgccgcgatgagccctctgccctggcccgggcccttacctggaggcaggcaagggcacaggctggagccatgctgctcttcgggctgtgctgggggccctacgtggccacactgctcctctcagtcctggcctatgakcagcgcccgccactgsggcctgggacactgttgtccctcctctccctaggaagtgccagtgcagcggcagtgcccgtagccatggggctgggcgatcagcgctacacagccccctggagggcagccgcccaaaggtgcctgcaggggctgtggggaagagcctcccgggacagtcccggccccagcattgcctaccacccaagcagccaaagcagtgtcgacctggacttgaactaaaggaagggcctctgctgactcctaccagagcatccgtccagctcagccatccagcctgtctctactgggccccacttctctggatcagagaccctgcctctgtttgaccccgcactgactgaataaagctcctctggccgtttaaaaaaaaaaaaaaaaaaaaaaagggggncc

SEQ ID NO: 1357 - DNA, 2075 bp, Homo sapiens
ccacgcgtccgtactgccctttttcaacctcagatgtgactttcattataggaagttctcaggcattttctcttggaataatacctcttctctcttctctttatgtccttgtgccgcattctgggttattcctttagctctaggttaagttcactaattcttcctttagctgtatttcattattgtttaagctgtccattgcattttaaactttctttcaaatatcttcccttcccttcctttcccttctcttccctgccctgccctgccctgccctgccctgccctcccgtcccctcccctcccctgccctcccctcccctcccctccccttcccttgccttccctctctttttttagataaagcctgggcaacatagcgagaccccatctctacaaaaaaatttttaattagttgggcatggtgttaagtgcctgtagtcccagttattcaggagtctgatgtgggaggttggcttgagcttcagaggcaatggttgcaatgagccaaggtcacaccactgcactccatcctgggcaacagagccagaccctgtctcaaaaacaaaacaaaacaaaagaacataccaaaagcactacccataaagaaccaattgataaattggactttatcaaaatttaaaacttctgctgttcaaaaacattattaaaagaatgaaaagacaagccattaactaggagaatatactttcaaatcacacatttaataaaagacttatatccagaacatatgaagaactttctaaagttaataagaaaaaaaaaacccaataaaaataggggaaatattttactagaaacttcaaaaaagacatacagtaggcaaatgaaaagatcattagtcattagggaaatgcaaattaaaaccacaatgagatagcaatacatacctactagaaagcctaaaattaaaagaactttttatattatgtgttgacgagaatgtagagcaactagaactgcaaatgggagtataaatgatacaacaactttggaacatatttcgatagtttctttagaaaacatacattaacctgccacatgattcagttatcccatgcctaggtatttactcaaaagaaatgagggtatattctatgcaaaggttgtaaaataatgttcataacagttttacatgtcaaagccaaaaacttgtaattacccaaatagccatcaacaagtgaatagataagtaaactgtgatatatccatacaatggaatactattcaacaataaaaagaatgcagctacatgaatgaatctcaattatgctagtgaaagaagacatttaaaatcaatacacactatatgattctgtttatttaaaattctataaatgcaagataagatacagtaaataaaagattcgtggttgcctggggattgggggagggagcaaagagaatagaaatgtgattacaaaggtgtgatataataagaaatatatacagatgcttctcaatttatgatagcagggttacctcctaataaacctatcataaatttaaaataccatgtcaaaaatgtatttaagacacctaatctgctgaacatctcattgcttagtgtagcctaccttaaatgtgctcagaacacattagcctacagttggacaaaatcatctaacacaatccctattttataataaagtgttgaatatctcatgtaatttattgaatactaaagtgaaaaacagtataagtattgaagtagtttgtggaaataagtaattcaaaatctaagctgggctgggtgtggtagctcacgcctgtaatcccaacactttgggaggctgaagcgggtggattgcttgaggtcaggagttcaagaccagcctggccaacatggtgaaaccctgtctctactaaaattacaaaaattagccaggcatggtggcacatgcctgtaaacccagctatgtcaggaggttgaggcacaagaattgcttgaaccaaggagacagaggttgcaatgagccgagattgcgccactgcactccagcctgggtgacacagagaggctctgactcaaaaaaaaaaaaaaaaaaaaaaaaa

SEQ ID NO: 1358 - DNA, 2525 bp, Homo sapiens
  misc_feature (5)..(5): n equals a,t,g, or c
  misc_feature (10)..(10): n equals a,t,g, or c
  misc_feature (1354)..(1354): n equals a,t,g, or c
tgacnctatngtaaggtacgcctgcaggtaccggtccggaattcccgggtcgacccacgcgtccggtctgccaacaaggtcgttcatgaaagtgtttttctctttaaggtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaaggtaagttaagacttggtatatgcatggagcacttccatctaatcacacatctctctcttgcctttggttctgttatatataacatggaaataataatgccttttgcttcatgtgagtgataaagcatatttaaatttgattatttaaccttgcattcctcaacaagaaaaaatgtttgataatggatgaaatgtgagtcaatcagatacaaaaatcaaaccctttggtgaagaaccagtcgtaacatttgactgttaattcaatcaacaggtgtttctggacctatagcaaaatgtgtaattgcgccttattttgaagtagaaggatatatttgtttggtcacttggcatttgtgaggtacttactattgtaattattgtatcaatggtaaggtgtcagcattatattgtgcggtcatattgtatcaacagtataaattataagctttgataagtatgtatttaagaaatctttttttatgtagggatttaagcaaacactttaattccaccaaactgtattgagtacttcttactagttattgagtgaaggggtgggttgcccctccacatctgtgggtgtttctcgttaggtggaacgagagacttggaaaagaaagggacatagacaaagtatagagaaagaaaaaagggggcccaggggaccggcgctcagcacacggaggatctctgccagcctctgagttccmttagtatttattgatcattattgggtgtttctcggagagtgggatgtggcaggatcataggatagtagtggagagagggtcaacaggtaaacacgtgaacaaaggtctttgcatcataracaakgtaaagrattaagtgctktgcttttagatatgcatacacataaacatctcaatgctttacaaagcagtattgctgcccgcakgtcccacctccagccctaaggcggttttyccctatctcagtagatggagcatacaatcgggttttataccgagacattccattgcccagggacrggcaggagacagatgccttcctcttgtctcaactgcaagaggcrttccttcctcttttactaatcctcctcagcacagaccctttacngggtgtcgggctgggggacggtcaggtctttcccttcccacgaggccatatttcagactatcacatggggagaaaccttggacaatacctggctttcctaggcagaggtcsctgcggcyttccrcagtgttttgtgtccctgsgtacttgagattagggagtggtgatgactcttaasgagcatgctgccttcaagcatctgtttaacaaagcacatcttgcaccgcccttaatccatttaaccctgagtkgacacagcacatgtttcagagagcacrgggttgggggtaaggttacagattgcagaacaaaatggagtctcctatgtctacttctttctamacagacacagtaacaatctgatctctcttttccccacaattgaggacacatacaatcatgatatgacctttaatggtctactacttggagagtcagatgtgtacccaagtctctactgcagttaacatttacctgccaggcactaggctaagtattagcagcaggttcaaagtgcataagatatagaccttgtcctcaagacttagtttattaggagagacatgaatgtaaacacatcatgaaaatccattataataactgcaataattgatatatcctgaagatgcagagattgtctagaggataaagttatatattctgtttggtaggggatgatgtggagttcaaatggatcagagaacacttcgctgattagaagtcagttgatccactagaagtcaaggtgaacaaggggattcaaaacagaggcaacagcctgtaaaagggaacagaggcataaaaaagcaggatatgttgtgagaacatgtagtttgaaattaccaagcaaaaagtttaaggactcgtagccaggcacagtggctcatgctgtaatcccagcactttaggaggccaaggccggcggatcacttgaggtcaggaatttgagaccaggctggccaacatggtgaaacccatctctactagaaatacaaaaaattagctgggtttgttggcgtgtgcctgtaatcccagctatgagggagactgaagcaggagaatgaacccgggaggcagagattgcagtgagccgagatcatgccactgcactccagcctgggcaacagagcaaaactgtctcaagaaaaaaaaaaaaaaaaagggcggccgc

SEQ ID NO: 1359 - DNA, 2511 bp, Homo sapiens
ccacgcgtccgcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaattataacctcagggatggtgataagcacatttgtgtctgctcccatcatgtacgtttctgcctggttactgacctttcccactatggaccctaagccattggcatatgccatccagaatgttagttttgatataagtattgtcagcctgatctccttgatctggtctctggctattcttcttttgagtaagaaatataaacagcttcctcatatgcttacaactaatttactcattgctcagtctattgtctgtgctggaatgatgatatggaattttgttaaagaaaaaaattttgttggacaaattttggtgtttgttctattgtacagctccctctatagcacctacctgtggacaggccttctagcaatttctttgtttcttttgaaaaagcgagagagggtacaaattcctgttggaataatcataatatctggctggggatgatcaccacagcagtcaccctgttctgcagcatcctgatagctggcatatccctcatgtgcatgaaccagactgcccaagcaggaagctatgaaggtttcgatcagtctcagagccacaaagtggtggagcctggaaatactgcttttgaggagagtccagcaccagtaaatgaaccagaactttttacaagctctattccagaaacaagttgctgctcctgctccatgggaaatggtgaattacactgcccatcaatagagccaatagcaaacacaagcaccagtgagcctgtgattccttcgtttgagaaaaacaatcattgtgtgagtcgctgtaactcccagagctgcatattagcccaggaagaagaacggtatctacagagtggagaccagcaactgacccgacatgtgttgctgtgtttacttctcatcattggcctgttcgctaatctttccagttgtttatggtggctattcaaccaagagcctggaagactttatgttgagttacagtttttctgtgccgtgtttaactttggtcagggatttttttcctttggaatctttggattagataaacatttaatcatcctgcctttcaaaagaagacttgaattcctatggaacaataaagacacagcagaaaacagggattctcctgtttcagaggaaataaaaatgacctgtcaacaatttatccattatcaccgtgacctctgtatccgaaacattgtcaaagaaagaagttccagttccaagatggggaaatccttcgccaacttcatgtgcaagaaagactttcatcctgcctcccaatccaatatcaaaaaagtatggatggcagaacagaaaatatcatatgataagaagaaacaagaagaattgatgcagcaatatcttaaagaacaagaatcatatgataatagattgcttatgggagatgaacgtgtaaagaatggccttaatttcatgtatgaagccccaccaggagctaaaaaagaaaacaaagagaaagaagaaacagaaggagagaccgaatacaaatttgaatggcagaaaggagccccacgagaaaaatatgccaaagatgacatgaacatcagagatcagccctttggtattcaggttcgaaatgtgaggtgcattaaatgtcacaaatggggtcatgtcaacacagatcgagaatgtcctttgtttggtctttctggaatcaatgcaagttcggttcccactgatggctcagggccatcgatgcacccctcggagctaatagcggagatgagaaacagtgggtttgcactgaaacgaaatgtactggggagaaacttgaccgcaaatgatccatcacaggagtatgttgcaagtgagggtgaagaagatccagaagttgaatttttaaagtcactaacaaccaaacaaaaacagaaacttctcaggaaattagatcgactggagaagaaaaaaaagaaaaaagatagaaaaaagaaaaagtttcagaagagcagaagtaaacacaaaaaacataagtcctcttcttcctcatcttcctcctcctcctcctcttcctctactgagacttcagaaagcagtagtgagagtgagagtaacaataaaaaaaaaaaaaaaaaaaaaaaaaaaaaaaaaaaaaaaa

SEQ ID NO: 1360 - DNA, 2193 bp, Homo sapiens
ccacgcgtccggttccttaaaggggaagcgagccgggctacggggcgagcgcggggtgcggtggtcggcggggaggcccccgcgctttaaaataatgcccgcggcgcccgcgcgaccatgcaatggcgagcgctcgtcctggggctggtgctcctccggcttggcctccatggagtattgtggctcgtcttcgggctggggcccagcatgggcttctaccagcgctttccgctcagcttcggcttccagcgtctgaggagccccgacggccccgcgtcgcccacctcggggcccgtgggccggcctgggggggtatccgggccgtcgtggctgcagccgccggggaccggggcagcgcagagcccgcgcaaggctccgcggcgtcctgggccggggatgtgcggcccagccaactggggctacgtgctgggcggccggggccgcggcccggacgagtacgagaagcgctacagcggcgccttccctccgcagctgcgtgcccagatgcgcgacctggcacggggcatgttcgtctttggctacgacaactacatggctcacgccttcccccaggacgagctcaaccccatccactgccgcggccgtgggcccgaccgcggggacccttcaaatctgaacatcaatgatgtactagggaactactcattgactcttgttgatgcattggatacacttgcaataatgggaaattcatccgagttccagaaagcagtcaagttagtgatcaacacagtttcatttgacaaagattccaccgtccaagtctttgaggccacgataagggtcctgggaagcctcctttctgctcacagaataataactgactccaagcagccctttggtgacatgacaattaaggactatgataatgagttgttatacatggcccatgacctggcggtgcggctcctccctgcttttgaaaacaccaagacagggattccatatcctcgggtgaatctaaagacaggagttcctcctgacaccaataatgagacatgcacagcgggagccggttccctcctggtggaatttgggattctgagtcgactcctgggggactccacatttgagtgggtggccagacgagcagtgaaagccctttggaacctccggagcaatgatacaggattactaggtgtggcacctttcctcgccattgggactgcacactgcttggtccccttttcctttcatcttctctgggctctgccccctttttactcttcaactcaattgacaactcagcaagaattgtgtcagctctatctaatttctttatgtgaccctttgcagagaggctgcatggtctgatggaaaagcattaagcttttgtgtttgagggctcccttctgattcggatcccctggcatattccacttgaaaattattgttaatggaaatgccgtaaaaagaactgcctctgaggcagattttattgcttcaatgtaaggttctaaatataggaatttagagttactgatggagcagctttttccttttaaaaaatctgggcctgtggtagtagattgaaagtccagattaaacctgtgtgaggtggggttttttccctttagaatgtttggtgaagatgttacttaaaaattattatggaaaatttcataatatagtagagagaaagtatgatgaataatgacccctatgtactcatcatttgtcttcactaattatcagtattttgctaactcaaggtgttattttatttatttatttattttgagttagggtctcactgtgtcacctaggctggagttcagtggtgtgatcttggctcactgcggcctccacttgccgggttcagtgatcctcccacctcagcctcccaagtagctgagacgaccggcttgtgccaccatgtccagctaattttgtttattttatgtagagacagggtctcactatgttgcctgactagtctcaaactcctgagcgcaagcaattctcccaccttggcctcacaaagtactggaattacaggtgtaagccactgtgcccagcctaggtgttattttaactcatgtaactgtcttaagttctgaaatttatgtatacatttgttgtatttaacaacagcaatagaaataaagaagtcactcaaaaaaaaaaaaaaaaaaaaaaaaaaaaaaaaaaaaaaaaaaaaaaaaaaaaaaa

SEQ ID NO: 1361 - DNA, 1921 bp, Homo sapiens
  misc_feature (68)..(68): n equals a,t,g, or c
  misc_feature (1021)..(1021): n equals a,t,g, or c
  misc_feature (1772)..(1772): n equals a,t,g, or c
  misc_feature (1854)..(1854): n equals a,t,g, or c
ccactataraaggyacgcctgcaggtaccggtccggaattcccgggtcgacccacgcgtccgctttgntagtttacctgttctgatgatgtgtgtggtcctcaccacactgccctgcctcaccttttccatagcagtgactgaggttcaaaagagcattaatgggtccgctgatgtcttacctgatatgttacctgacctgcccgtatctctggttctgttatccctgatcatggttgatattattgaaaaactcaggatatatcctcttagagggagtcaaaagagtagtgaaaatggacacatccattcaacctctttgcaacacataaaaactgtgacggagcaagtgaggcaaagtccagaaaacgctgcatctccccaggcaaccaacagcacccaggtgtcgcagccatcaggagccatgacacggagccaggagtctgtgttcatgggaccccaggagccctcctgtgactccggaatcctgagaatgatgtcccggcgagatgtccgggcagagttattcttatggagctttctcctgtggtctgacacgatagaaatggtgcgtgtggctggtcaccccaacgtgtacaagtcaagctggctatacccagtctacatattcagttttatttctctccttcgaattacattcactccccaaaaccctcttctcaattccctgagcgtcctgctgcaagatttaccattcgtttttgttagacttggtttaatcattgccctggggactatcacacccgtactgggcctgtgtaaaaatatcctcgtgactctctcttacatttacttcaattacctaaccagaatcaggattttttctgcctttgaaatgtctccattttaaaaaggaaatgggatctagtaaggcctctttgtgatacctgtgtgcacatttgtaatccttctttttttcttggggcgtaggtgtttgcactataaaggaaatgactagattgtagagaataagccatttttactaactctagcatatcagntttttttttacatatacaaatggtgctaaatttaagtaaagtaatattcttataagttggctctcaggtatttctagaaaatgttagcagctaattttagttagttatgtatactgaggtccccaacccctggaccatggtcccagtactggtccgtgatctgttagcaagcagaccgcacagcacgtggtgaacctcaaactgagcgttcccgcctgcattccgcctcctgtcagatcagcagcagcattagatcctcataggagcccaaaccctattgtgaactgcgtatgcaagggatctagctttcgctctttaagaaaatctaatacctgatgatctgaggtgggacagtttcatcccagaacccaaccccacccccaaccctggctgtggaaaaattgtcttccacaaaactagtccctggtgccaaaaaggttggggaccactgatgtataccacgctttttctaagaatactcttcaacggagccctttaaaaaactaagaaccttttccatcaagttagcccaagaataagatttttatcttttatatagatagcattatatgaattgattgattaaatttagttttaaaaaacacacttgaaattattgaataatttttaggttatactttttttttttttttgagacgatgtctcgctcttgtcccctaggctggagtgcgatggcgcgktctcagctcactgcagcctggatctcccaggaggattgcttgagcccggnaggtcaaggctacagtgagctatgatcatgccactgcactycagactgggcaacagagtgacacccatctaaaaaaaataanagagaattgacgttggggtawtctacgttcaccaaatacctctcccttggcaccctgctycctttcc

SEQ ID NO: 1362 - DNA, 1772 bp, Homo sapiens
  misc_feature (1480)..(1480): n equals a,t,g, or c
tcgacccacgcgtccgggagagaacgccggtggcggggctggtagcccggcagccgcagtggggccacgagcgctggctgagggaccgagccggagagccccggagcccccgtaacccgcgcggggagcgcccaggatgccgcgcggggactcggagcaggtgcgctactgcgcgcgcttctcctacctctggctcaagttttcacttatcatctattccaccgtgttctggctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcwggaacacracagaagttgtcaacaccatgtgtggctacaaaactatcgacaaggagcgtttcagtgtgcakgatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacctctcagtcaacatcgtggggctggacagggctgcggccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacrggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatngccaggttggcctcttctcagcctcccaggtgccttgagccctcttgcaagggcggctgcttccttgagcctagtttttttacgtgatttttgtaacattcatttttttgtacagataacaggagtttctgactaatcaaagctggtatttccccgcatgtcttattcttgcccttcccccaaccagtttgttaatcaaacaataaaaacatgttttkttttktttttttaaaaaaaaaaaaaaaaaaaaaaaaaaaaaaaaaaaaaaaaaaaaaaaaaaaagggcggccgc

SEQ ID NO: 1363 - DNA, 527 bp, Homo sapiens
  misc_feature (284)..(284): n equals a,t,g, or c
  misc_feature (292)..(292): n equals a,t,g, or c
  misc_feature (422)..(422): n equals a,t,g, or c
  misc_feature (514)..(514): n equals a,t,g, or c
  misc_feature (527)..(527): n equals a,t,g, or c
gggaggttgcggtgagccgagatcacgccattgcactccagcctgggcgacagagtgaaactccgtctcaaaaaaaaaaaaaaaaaaaaaattggccgtatgtgcgtgggtctgttcctgagctctgtttttttccatatatgtgttcatccttttgctaatgccacactgtcttgtctactagaaattggtaagttgtgtgaatccttcaactttgttcttttccaaattgttttggctattctggttcctttaactttcatataaatctttgaattagcttntagataanagcaaaatgtcctgccaagattttgtrtctaaacttataaatcagtttgaggagaattagcatcataacaatattgartagtttwatctgtgaacatagtgkaatgcactatttaggtcttgatattttnatgggtgttttgtatttttcagtataaagaccatgtgcatcatcttgtgtttagatttataccaaagcatttttgcaggtgttggaattatnactgtttaaaaan

SEQ ID NO: 1364 - DNA, 1917 bp, Homo sapiens
acgcgtccgcattcttttacatgtagacatccagttttcccaagtgtttgttgaagagactatccttgcctcattgtgtgttcctggtacccttgttgaaaattagttgaacatatttgcatgggtttatttctgagctctctattttgttccattggttatatgtctgtctttctgccagtaccgtactgttttaattactgtagctttgtaatatactttgaaatcaggaaatatgaagcctccacctttgttcttctttctcaagattgttttagctatttggggtcctttgtggttccatatgaattttaggtttgttttttctatttccatgaaaaatgccattgggattttgatagggattgcattgaatctgtagattgctttatgtattatggctattgtaatgatgttgaagtcttccaattcatgaacatgggatgtctttttatttatttgtgtctcttaaaatttatttcatcagtgttttatagtttttcatttgcaaatctttcatttccttggtcaatgttattcctaagtattttattctttttgatcttatagtaaatgagattgttttcttaatttgcttttcaaatagtttgatgttattgtatacagacacagctgattttgtatgttgatttttatatcctacaacaaatttttctgaatttgtttagtatgtctaataaatttttgatgcactctttagggttttctacatataaggtcatgtcatctgtgaacagaaataattttacttttccctttctaatttggatgccctttatttctttttattgccgaattgctctgactgtgacttccagtactatattgaatagaggtggtaagaataggcattttggctttgtttctgatcttaaggaaagacttccagtttttcactattaagtctaatgttaactgtgagtttttcatatatggccttcattattttgagatagtctcaccctgtttgtagtttgttgagattttttattatgaaaaagtgttgaattttgtcaaatgcctttctgcatctattaagagatcttgaagaaagtgaagagtaaagagttactgaaatttcttgcttagaagattagataaatggtgatgctactaattaagggaaagtagaaatttttgaagaagataaatagataagtcttagacataatgtgttttatttcttcaaacattctggttaaaatatcaaagtaacagttgttgcaaatggaaaaaatatgcagctctgaggagacattggaagcatcgataatacttagaaaaaccttacctaatgctgccccaagcactttactcttgtaaattcatctaattatcactgtaacaccacaaagtagctattagttgttatcttattttatagatgagaaagctgaggcacagagaggccatgtcactcgcctgaggttccacggcttttaagtggcagaacattgatttgagtcaatgcattctgaactctgtgttcatgttctcaactatttatactattctgcttcagaaataaagactcccatttactaagcattttaacatgctagacattgtattgaacattatttgtatcatatcaattatctaatcctcaatacagctcttttatttcacagaataggaaattgaagcaaagagaggaaaagttgcatgaacgattttacacagctgttaggtcgttgaactggattctgaacctagcattctggctggagagcccaagcttttatcagttgtgtatagcagtgagagtagattccccatggaaaggtaagagctgaatacagagtccagagggaacaccaatatgaagaaggagttgtgaagcggcctgaaaagaaatgacaaagataggaagagagttacaaaaaaaaaaaaaaa

SEQ ID NO: 1365 - DNA, 2339 bp, Homo sapiens
cccacgcgtccggggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaagggctcttcgagcccgcgccctggccgcggctgccgccgacccggaaggtcccgaggggccctgcatcctggcctggcgcctcgcggaactggcccagcagcgcgcgcgaaactttctattacggtcgcgcgctttagctactcagaggcggagcgcgagagtaacagggctgacgcgccttcctacgtgcgctaggctgggactggggacccgacggcggcgacagcggcgaggggagcgctggagaaggcgagcgggcagcgccggaagccggagatgcagcggccggaagcggcgcggagtttgccggaggggacggtgccgccagaggtggaggagccgcgcccctctgtcacctggagcaactgtggcgctgctcctccccgctggcccagagtttctgtggctctggatcgggctggccaaggccggcctgcgcactgcctttgtgcccaccgccctgcgccggggccccctgctgcactgcctccgcagctgcggcgcgcgcgcgctggtgctggcgccagagtttctggagtccctggagccggacctgcccgccctgagagccatggggctccacctgtgggctgcaggcccaggaacccaccctgctggaattagcgatttgctggctgaagtgtccgctgaagtggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtgccaccatcaactacacaggacagcggggcgctgtggggcgtgcttcctggctttacaagcatatcttccccttctccttgattcgctatgatgtcaccacaggagagccaattcgggacccaggggcactgtatggccacatctccagggagcagggctgctggtggccccggtaagccagcagtccccattcctgggctatgctggcgggccagagctggcccaggggaagttgctaaaggatgtcttccggcctggggatgttttcttcaacactgggacctgctggtctgcatgaccaaggttttctccgcttccatgatcgtactggagacaccttcaggtggaagggggagaatgtggccacaaccgaggtggcagaggtcttcgaggccctagattttcttcaggaggtgaacgtctatggagtcatgtgccagggcatgaaggcagggctggaatggcagccctagttctgcgtcccccccacgctttggaccttatgcagctctacacccacgtgtctgagaacttgccaccttatgcccggccccgattcctcaggctccggagtctttggccccacagagaccttcaaacagcagaaaagttcggatggcaaatgagggcttcgaccccagcaccctgtctgacccactgtacgttctggaccaggctgtaggtgcctacctgcccctcacaactgcccggtacagtgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgactacaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1366 - DNA, 1579 bp, Homo sapiens
tcgacccacgcgtccgggaggacccgggagccggcggcccggagctgggagcgcggggaaggcggttggggttctgacagctgcgcgcgatcctgctctctctcagccgcctgtggacatgcgcaaagggccctctcctgagtccagatgatgctcataccaatggcttcagtgatggcggtgactgaaccgaaatgggtctcggtctggagccgcttcctctgggtgacgctgctgagcatggtgctggggtccctgctggccctgctgctgccgctgggggctgtggaggagcagtgcttggctgtgctcaaaggcctctacctgctcaggagcaaaccggacagggcgcagcatgccgccaccaagtgcaccagcccgtccacggagctcagcatcacctccaggggcgcgacgctgctggtggccaagaccaaggcctctccagcgggtaagttggaagccagagctgccctgaaccaggccctggagatgaagcgccagggcaagcgggaaaaagcccaaaagctcttcatgcacgccctcaagatggacccggacttcgtggacgcgctcaccgagtttggcatcttctcggaagaagacaaggacatcatccaggcggactacttgtacaccagagcattgaccatctcaccctaccatgagaaagcactggtcaaccgcgatcggacactgcctcttgtggaagagatcgaccagaggtatttcagcatcatcgacagcaaagtgaagaaggtcatgtccatccccaaggggaactcagctctgcgcagggtcatggaggagacctactaccatcacatctaccacacagtggccatcgagggcaacaccctcaccctctcggaaatcaggcacatcctggagacccgctacgccgtgcccgggaagagcctggaggagcagaacgaggtcataggcatgcatgcagccatgaagtacatcaacacgactctggtttcgcgcatcggctccgtcaccatcagcgacgtgctggagatccacaggcgggtgctgggctacgtggaccccgtggaagccggcaggtttcggacaacacaggtcctggtcggacaccacatccctccccatccgcaggatgtggaaaagcagatgcaggagtttgtacagtggctcaactccgaggaagccatgaacctgcacccagtggagtttgcagccttagcccattataaactcgtttacatccaccctttcattgatggcaacgggaggacctcccgtctgctcatgaacctcatcctcatgcaggcgggctacccgcccatcaccatccgcaaggagcagcggtccgactactaccacgtgttggaagctgccaacgagggcgacgtgaggcctttcattcgcttcatcgccaagtgtactgagaccaccctggacaccctgctttttgccacaactgagtactcggtggcactgccagaagcccaacccaaccactctgggttcaaggagacgcttcctgtgaagccctaaccctagaaatcctcagtgacaaaggctgtcctgaggtaggaaaaaaaaaaaaaaa

SEQ ID NO: 1367 - DNA, 2278 bp, Homo sapiens
gtcagtatttctgtcaacaaaattcatgaggctctttgtacgcacagacttcaggcctttctctcaacaatcgccaaagctggagcatcacatggaggaacactggggtttgaaaaacaggaatgttccagaatcttctcagagtattacattttccaacatgtccatcccatatttgtaccaacaaacagagctggtcccactgccctcatcctttgtctaccatgttaggctgaggaagttgcatgcagagcagaggtgaagactaagagaagaagatacaagaaacctgctgagtaggggagagggaaatggtacctytgccagttatgctggaaaagctaaatgaaacccaaatcttgatggaggtgttagggttttcagtctttcaagagaagctcaggacacaggctttttggcttaaggaccccaaatttcctgggcaccacaaaagtagtaacggcagtcctccaggtgaatcagtgtcaagagctagactgtaatcacttgccttttgttgcattacaagccactcttgaaacacttagtggattgaaacaacaacttcttatttctcaatgattctttggcttgactgggcactctttctgctggtcttccctgggcagttcttctgctggttctgcctgggctcactcatgaggctacaggtagctgctgggtcagccagtgtctggggctcagctgggatgacctggcctctctctgcctgtggtcctttatccagcatgatggtctcagggttccaagcaagtaagccccaatgcacaagtatttatccagcctttgcctgcatcgcgcttgctcatgtctcattggctaaaacggatcacgtggccaagctcagagtcagtgtgggaagagtctatacaagcgcttggatactgaaaggcatgattcattgggggccattgttataatctaccacacattctagactttgctttgctttakatccgaattctagcaactcgatgtgataaccctgggcacatcatgttgctcgaacactgtaattggctattgatgtccctggaatgtctgagatgtatggggtggaccaaacactgcctctctctgggaaccccggactttgggttgagaatgcctagtgtttaggtggcattgactctaaaaccatgtggcattcagaattcagcactgggcaatggcgcatatgctgatttaattttattagcctattagctgcatagacacaacagtgatttatgtgattttataatattatgttgaaccttcaataattgggattaaagtctggattgatgttgtaacagaaacaggagtagaaaaataatcatcagccagatggaagaaattattagttcacaaatgcagtgtgctcagtaataaaatctttcaaaatgtggatgacataggtgcaatagaatataaagaggccttcagtggaaagcttgggaagctctgcagagatgcagtggaccttgaaggttaagaatatggagtcagacaaaactaaattttaatctctattttgtgaccttgggcaagtaacttaacctcttttggactcagattcctcatctgtaaagtggagagaatgatgcagggaagggaggggagtgggtcaccgtgcagattcatggaaataaaggatagacagtggacacggtcagtttggctgttactatcatctgccagtagcctcagttacaataagccagaggcaagattaacatctcttcctttttctttctaattcttctgctccccacattgccataactactcccattttctctatctctgtttactcaatggcggccttctatcagtcagtcacataaaagtattcttattgcagtcatttacactttagtatgaatgagtcagcacttttttgcagcaattttcattggaagccagtgggaagtgaaaggctttggccacccctcataatatatgacttaaagcctgcttgcaatagagagcccttgcagagtctctaaaagaaaaggacctgccccctgaagaacttctgagaccatagacctcatggtgcccagcttttcctggttgccatgtgtcatctctaaagacagccatgaatatctgttttggttgacttgagccatttgaatgtctaaaacccatcttaataacaaaagctctttggagggaccctaattaacttctttaaattgctttctctaaacttttggaattaatacaatctgttcccttgttattaaaaaaaaaaaaaaagggcggccgc

SEQ ID NO: 1368 - DNA, 2808 bp, Homo sapiens
tcgacccacgcgtccgagcgtgcccaccagccatggcggggccccggggcctcctcccactctgcctcctggccttctgcctggcaggcttcagcttcgtcagggggcaggtgctgttcaaaggctgtgatgtgaaaaccacgtttgtcactcatgtaccctgcacctcgtgcgcggccatcaagaagcagacgtgtccctcaggctggctgcgggagctcccggatcagataacccaggactgccggtgcgggccacccctgtccttgcctgtgtccaggagcatcctgtggggtggcagggactcggggagcctgacaggcccacaaaatgaggagaagcactcacttatccatgcccctgtggccccacctgggtggtggagataggcggggaggaaggggtaaaggcgaggggcaggaggggtttatggggcacctgctatgtgctaggccctgtgctcagctctgggccaggcagagcagggaggtgggtgggagccccggaagccaatgtggggaggctgggtgggggctgtgcaagggagccttttccatcaccctgcccaccctctgcccccagctacgaatacagctggggggctctatggtgtccatgagcggctgcagacggaagtgccggaagcaagtggtgcagaaggcctgctgccctggctactggggttcccggtgccatgaatgccctgggggcgctgagaccccatgcaatggccacgggacctgcttggatggcatggacaggaatgggacctgtgtgtgccaggaaaacttccgcggctcagcctgccaggagtgccaagaccccaaccggttcgggcctgactgccaatcggtgtgcagctgtgtgcacggagtgtgcaaccatgggccacgtggggatggaagctgcctgtgctttgctggatacactggcccccactgtgatcaagagctgcccgtctgccaggagctgcgctgtccccagaacacccagtgctccgcagaggctcccagctgcaggtgcctgcccggctacacacagcagggcagtgaatgccgagcccccaacccctgctggccatcaccctgctcactgctggcccagtgctcggtgagccccaaggggcaggctcagtgtcactgccctgagaactaccatggcgatgggatggtgtgtctgcccaaggacccatgcactgacaaccttggtggctgccccagcaactctactttgtgtgtgtaccagaagccgggccaggccttctgcacctgccggccaggcctggtcagcatcaacagcaacgcttctgcgggctgcttcgccttctgctcccccttctcctgcgaccggtctgccacttgccaggtgaccgctgatgggaagaccagctgtgtgtgcagggaagcgaggtgggggatgggcgtgcctgctacggacacctgctccacgaggtgcagaaggccacgcagacaggccgggtgttcctgcagctgagggtcgccgtggccatgatggaccagggctgccgggaaatccttaccacagcgggccctttcaccgtgctggtgccatccgtctcctccttctcctccaggaccatgaatgcatcccttgcccagcagctctgtagacagcacatcatcgcagggcagcacatcctggaggacacaaggacccaacaaacacgaaggtggtggacgctggccgggcaggagatcaccgtcacctttaaccaattcacgaaatactcctacaagtacaaagaccagccccagcagacgttcaacatctacaaggccaacaacatagcagctaatggcgtcttccacgtggtcactggcctgcggtggcaggccccctctgggacccctggggatcccaagagaactatcggacagatcctcgcctctaccgaggccttcagccgctttgaaaccatcctggagaactgtgggctgccctccatcctggacggacctgggcccttcacagtctttgccccaagcaatgaggctgtggacagcttgcgtgacggccgcctgatctacctcttcacagcgggtctctctaaactgcaggagttggtgcggtaccacatctacaaccacggccagctgaccgttgagaagctcatctccaagggtcggatcctcaccatggcgaaccaggtcctggctgtgaacatttctgaggaggggcgcatcctgctgggacccgagggggtcccgctgcagagggtagacgtgatggccgccaatggtgtgatccacatgctggacggcatcctgctgcccccgaccatcctgcccatcctgcccaagcactgcagcgaggagcagcacaagattgtggcgggctcctgtgtggactgccaagccctgaacaccagcacgtgtccccccaacagtgtgaagctggacatcttccccaaggagtgtgtctacatccatgacccaacggggctcaatgtgctaaagaagggctgtgccagctactgcaaccaaaccatcatggaacaaggctgctgcaaaggttttttcgggcctgactgcacgcagtgtcctgggggcttctccaacccctgctatggcaaaggcaatgtgagtcccatcctctcctggggtgaggtatggggaacacaaggactccttcaccggttggccagtgactggctgtgtgtctgggccaagcctgccactctggccttgggattctcatatctatgcagtggaaagttggatcaaattatttctcatattttaattaaaaataattagagagaaaaaaaaaaaaaaaaaaaaaaaaaaa

SEQ ID NO: 1369 - DNA, 1150 bp, Homo sapiens
gcggatcaggagaaaataaggaatgtcaaaggaaaagtaattctgtcaatgctggttgtctcaactgtgatcattgtgttttgggaatttatcaacagcacagaaggctctttcttgtggatatatcactcaaaaaacccagaagttgatgacagcagtgctcagaagggctggtggtttctgagctggtttaacaatgggatccacaattatcaacaaggggaagaagacatagacaaagaaaaaggaagagaggagaccaaaggaaggaaaatgacacaacagagcttcggctatgggactggtttaatccaaacttgaaggaatccgaataactaaactggactctggttttctgactcagtccttctagaagacctggactgagagatcatgcggttaaggagtgtgtaacaggcggaccacctgttgggactgcgagattctcaaggggaaggactgggtctcatttctcccatctcagcgcttagcaggatgacctggtatagagcagggaactgggaaatgtgggtcaggggatcagacactccagttgggtcttttatataaattaaatggcaaaaggctccatacccttctccttctttcctaccctccactttatctgcaaaatgggaatgatgataacacccacttcatagaatggtcatgaagatcaaatgagagaataaaagtcaagcacttagcctctggtgcacaattagtattaaataagtatacctattcctccttttccttttttaaaaataatattaccaaatgtccagcttatacacatttacaagacttagctagtgggctatgttagagctactaaaagatctttgacaagctaaaactaagatgcaatgaatgaggtgtaacgaacaagagagttttaagttcagaaatggttacagaagtataagacagctgtgtgggtgttttttgatttttggtttctggtttacaatctcgtcattcaacaaagatgggagttttatagaactaaaagcaccatgtaagctactaaaaacaacaacaaaaaaggctcatcatttctcagtctgaattgacaaaaatgccaatgcaaataaaaatgattactttttattttaaaaaaaaaaaaaaaaaaaaaaaaaaaaaaaaa

SEQ ID NO: 1370 - DNA, 1643 bp, Homo sapiens
cccacgcgtccgggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcgcctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaatgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatcccgaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtgggcaagctgcgacgtggggccaagcctgagggcaaggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctcttttttaaaaaaaaaaaaaaa

SEQ ID NO: 1371 - DNA, 1736 bp, Homo sapiens
cggtccggaattcccgggtcgacccacgcgtccggtcagtttctctggaatgccaaaataagggaattttgttgtggctgtcctatgaaaatgaagctctgtcacagagaagtgtgtgagccaaatccaaatactgagtttattttactgtccaaatagaatattttcaccccagtgaagcaattgtaagcatctcatccaaagcatattcactatccttgagtattcttggttgcttattgaatgaataagtgaatgaggtggatttggctgacactaacctttgggattacctcacagcttgccagtggcaagcttagtaagtactgggccatagtgtttgaggataggtctctagagtcatatgtctctaagttcaaatgctagcctcctgtattagtctgttttcatgctgttgatgaagccataccccagactgggtaatttacaaaataaagggttttaattggacttacagttccacttcactggggaagcctcacaatcatggtggaaggcaagaaggagcaagtcacatcttacgtggatggcagcagacagaaagtatgagagccaagcaaaatggatttccccttatgaaaccatcagatcttgtgagacttattcactaccatgagaacagtatgtggaaaactgcccccatgattcaactaatctcccactgggtcccttccacccacaacatgtggggattcaagatgagatgtgggtggggacacagccaaaccatatcacctcctttcctagttgcttggtttggaagagttatgtaatctttttgagcttcaatttcctcatctataaaatagggaagatgctagttactctcttatagggtagttatgatttattttatgtgaaatgtttagaatggtccatgccatgatgtactgcagttggtttgtactggctcacaatgaccaatagtacaccttttttctgattctgccaatcttcccatcctcacatccagtgacatcatattggtagtttgaaattaattggccatggtgagaatatttacactacagatatttgcaaatcctatcaccaggggctagctttgccagcacaccgttggttagatgacatccgtaagttctgtataaatcttaacattattattactcagtaggtactcctgctcccttatggttttgagaaggccttccttctagttaaataaatcattttgaattaaaataacactgatgggactcttagcaatgttttacctcttgggaatcactgcctacatttgtggtctataaatctgaatccttaattcactcggattgatttttggctccgtgaagcaggagcttttctcactgctgtagcccccacacatggcacaggcctgggacagagtaagcactcataagtatttgttaagtgaaaaaataaatgaatgaaagtatcccaaacacttgcattttcaaaaggttttgacatccacttccttttcttctcaaagtacgctttgagatggataggtcctattttacctctattgcatcgatgaagaaactgcaatgcaaagaagtgtctaattagtcatttgcttcctttcatcaaatatgtccattacaccagtgtttctcaaaatgtgttccatagatcataaatcctgaaggatgttaatagttattatgtgccaggggacccgtggatatataagtttggaaaatagtgaagtaaaaaaaaaaaaaaaa

SEQ ID NO: 1372 - DNA, 2325 bp, Homo sapiens
ccgggtcgacccacgcgtccggtggcagagccgccagcgaggctggggatgggggcgccgctgctctctcccggctggggagccggggctgccggccggcgctggtggatgctgctggcgcccctgctgccggcgctgctgctggtgcggcccgcgggggccctggtggaggggctctactgcggcacgcgggactgctacgaggtgctgggcgtgagccgctcggcgggcaaggcggagatcgcgcgggcctaccgccagctggcccggcgctaccaccctgaccgctaccggccccagcccggagacgagggccccgggcggacgccgcagagcgccgaggaggctttcctgctggtggcaaccgcctacgagacactcaaggatgaagaaacacgaaaagattatgattacatgctggatcatccagaagagtactacagccattactaccactactatagcaggcgcttggcccctaaggtggatgttagagtagtgattttggtcagcgtgtgtgctatttcggtgtttcagtttttcagctggtggaatagctacaataaggcaatcagctacctagccacagtgcccaagtaccgtatccaagctacagagattgccaagcagcagggactgctcaaaaaagccaaagaaaaaggcaaaaacaaaaagtccaaagaagaaattcgtgacgaggaggagaacatcataaagaacattataaaaagtaaaatagatataaaggggggctatcagaaaccccaaatctgtgatcttctcctgtttcaaattatcttagctccttttcacctatgctcatatatagtttggtattgtcggtggatctataattttaacatcaaaggcaaagaatatggagaggaagagagattatacattatacgtaaatctatgaagatgtcaaagtctcaatttgatagtctagaagatcatcagaaagaaacttttcttaaacgagagctctggatcaaggagaattatgaggtctacaagcaagaacaagaggaagaattaaagaaaaagttggcaaatgaccccagatggaagagatacaggagatggatgaagaatgaagggcctgggcggttaacatttgtggatgactgaagattgatggaatgctactatgccaaaccttaattgtgatattattttcataactgaattattttagaaatgtatcaattgactgctgctcagcagtaactaaaattcctcaagtatttgattaaacagaataatgtcaaaatttaaaccttcccttaaaactttatacataagacatttatgattgttcaatttttataatctatttgtggattttgttaaaagatttcacatgaagatttattagttgccatttaaaatttttatatgtttagttaaaagatttgacatgaaaatttattagataccatttaaaaattttatgtgttatgtgtttattctttgagaatgttaccttactgtttgtaatagtgctacatttttctgctttcatggcctctgtattttcacaaaacaccaaaaacagcatttaattatattatcatgagtgtgtttctggacacaaacttctgcagtagaatgacctaacatgtcgttttcattgcagtcattataggattgaaatacgttcaaaataacctctctaggaaagtcttctgctagaatttctcccctctattcattataatattctttgtttttaaagccagtcaaatataatagtcttaataagatcagaaactctccaggagagtgagtctaccctcacgtccttgtaggatgatcttgattatagtcttattataggactataactgtattctcaacatttctccagaaaggaccttgtaaaaaggtcttttgtaccacagtattggttttttcccctctctcttcacttaaaaaaaaaaatagcaaggcagaaatagtgtattgaaaagttgttcatctattatgaagtccttgagtggtgaaaaatccgttgtacatgagaacatttctatgcatttaagccagaaacgaggtacatggctgtgtgctcttctgtcaaccaatgaaatgtgttttcacatgtgtggcagtgcaagtaaataacacattatttgactgaatcaggcatgatactgcaccaaagtgttggtacatattcacggtagtaaatcagtacccctgttaaaggatttatcccattgcttcatattaataaaatggttacaatataaaaaaaaaaaaaaaaaaaaaaaaaaaaaaaaaaaaaaaaaaaaaaaaaaaaaaaaaaaaaaaaaaaaaaaa

SEQ ID NO: 1373 - DNA, 1900 bp, Homo sapiens
aattcccggggtcgacccacgcgtccgatggagaaatttgttgataaaaagaggaaagaaaaacatgcctcacagatgatttccaacaaggatgagatgggcccaagagatgaggctggtgaggaagccgtggatgatggtaccaatcagatcaatgaacaagccagttttgctgtaaacaaactgcgagaactaaatgagaaacttgaatataaaaggcaagctctaaattctattcaaaatgcaccaaaacctgacaagaagattgtttccaagttgaaggatgaaataatcctaatagagaaagaacgcacagaccttcagctgcacatggcaagaacggattggtggtgtgaaaaccttggcatgtggaaagcctccatcaccagtggagaggttacagaagagaatggtgagcaattgccatgttactttgtcatggtaagcctacaagaagttggaggagttgaaactaagaactggacggtccccagaaggctcagcgagtttcagaatttacaccggaaactcagtgagtgcgtcccttctttaaaaaaagtccagttgccttctcttagcaagctgcctttcaaatctatagatcaaaagtttatggaaaagtcgaagaatcaattaaataagtttttacagaatctgctttcagatgaaagactgtgtcagagtgaagcactttatgccttcttgagcccttctcctgactacctcaaggttatcgacgtgcaggggaaaaaaaattctttttcattatcctcgtttttggaaagacttcctcgygacttcttctcccaccaggaggaggagacagaggaggacagtgacctgtcagattatggtgatgatgtggatgggaggaaagacgccttggctgaaccatgtttcatgttgattggggagatttttgaacttcgaggaatgtttaaatgggtgagaagaacattaattgccctcgttcaggtcacttttggaagaaccatcaacaaacaaatccgggacacagtcagctggattttcagtgagcaaatgttggtttactacatcaatattttccgggatgctttttggccaaatgggaagttggcaccaccgaccacaatcagaagcaaagagcaaagtcaggaaacaaaacagagagcacagcaaaagctgcttgaaaacattccagatatgcttcagagccttgttggacagcaaaatgcccgccacggtataataaaaatattcaatgcactgcaagaaacaagagccaacaagcatctgttatatgcgctgatggaactgctgctaattgaactgtgtcctgagctgagagttcatttagatcaacttaaagctggccaagtttgagactacacaaataaaccaccagaaaaatgtctgtgtaataatagacatgaaacattttcctcttttccacagagggcttaactgagaaccgtattgatttttattttagttacctccctctagttttatgtgaaattagtagaatcagggaggacgggacttatgctgtggtaggcaacagaaaaaaacttctattgattttaatttaatatgaatactttaaagatcaacataccgattgaaatacaaatgttaatatgtgagaacctaggaagtattttaaatatttatgaaaatattttgttttaaaatgaactatgaatattgtacagttaatttcctcactgaggactgtgaacattcttatattatttcatgtatattgaagaacattgttatgcaatgctttgtgtaaagttattgtgaagattttattgtctttatttttaccaaagatttcccatagtttgagcattcaaagcaataaaatataaaaatgaawmaaaaaaaaaaaaaaaaaaaaaaaaaaaaaacc

SEQ ID NO: 1374 - DNA, 2644 bp, Homo sapiens
ccgggtcgacccacgcgtccgacctggcctgctggagcgcatggtggaggcgctccgcgcaggaagcgcacgtctggtggccgccccggttgccacggccaaccctgccaggtgcctggccctgaacgtcagcctgcgagagtggaccgcccgctatggcgcagcccccgccgcgccccgctgcgacgccctggacggagatgctgtggtgctcctgcgcgcccgcgacctcttcaacctctcggcgcccctggcccggccggtgggcaccagcctctttctgcagaccgcccttcgcggctgggcggtgcagctgctggacttgaccttcgccgcggcgcgccagcccccgctggccacggcccacgcgcgctggaaggctgagcgcgagggacgcgctcggcgggcggcgctgctccgcgcgctgggcatccgcctagtgagctgggaaggcgggcggctggagtggttcggctgcaacaaggagaccacgcgctgcttcggaaccgtggtgggcgacacgcccgcctacctctacgaggagcgctggacgcccccctgctgcctgcgcgcgctgcgcgagaccgcccgctatgtggtgggcgtgctggaggctgcgggcgtgcgctactggctcgagggcggctcactgctgggggccgcccgccacggggacatcatcccatgggactacgacgtggacctgggcatctacttggaggacgtgggcaactgcgagcagctgcggggggcagaggccggctcggtggtggatgagcgcggcttcgtatgggagaaggcggtcgagggcgactttttccgcgtgcagtacagcgaaagcaaccacttgcacgtggacctgtggcccttctacccccgcaatggcgtcatgaccaaggacacgtggctggaccaccggcaggatgtggagtttcccgagcacttcctgcagccgctggtgcccctgccctttgccggcttcgtggcgcaggcgcctaacaactaccgccgcttcctggagctcaagttcgggcccggggtcatcgagaacccccagtaccccaacccggcactgctgagtctgacgggaagcggctgaagccctgataacctcgcctttgtttttcgggggtctgtctggatgtggagaagctctgtgtgagcggtgaggggtggagggatgtcgcggagaggggaagggggaaactgaccaagaaagaaattctaaggagagcatgagagaaggctggcattggcaggaggagagcaccaggacgaggatgggaagcgacctccagatttatcaaatggtcatgcccactgggagccgtggatatgcgtggggacatcctgggtcatctcagtcatggagggagacggggatgtcacgccgtcccgcagggcccagcacagccccagacccgaaaaaagtgttctgcccaagattccgagagccctgcgctctagggcaggggcagagttttggaaacagtgcaggctctggagccagactggcgagattcaaatcctggctctatcgcttcggagccaggtgggcctgggggggcgtcgcagtctctctgtgcctcagttgcttccaggatgcgggacccttggctgcaggggttgcttccgccactagagggcgcgccggtcccgctcctggtggcccactgtggctgcccggcgacagtacgcccagggcctgtgttccatagccatctactctcttgagcctttggacttctctccaagcccctgtgggaggcggacagcagtgaccacctccccttcttttggactgcgacctccttccctcctgggagagccctgtgacctgcatgctactcttaactgttctattcaagactgaatagaagtatttcagtcttgcagaggaggaaatgctcagagctccgaggtgcggctgtggtcgagaaccgggtgctgggccgggcgcgggggctcacgcctgtaatcccagcactttgggaggccgaggtgggaggatcgcttgagcccaggagtctgagaccagcctcggcaacatgccaagaccccgtctctatttttaaaaaagaaaaagaaccgacttctgaatcgcagctccactcatgactaatacctcattatttcagctgtctgcacctaattccccacttgcacggcagtgtagacaataaccatagctcacactcactgagcacctactgggtaccaggcaccattctcagtgtttcacctggatcaactaatgcgtccctcacctcagccctctgaagtgacagctgctattattttcattacacagatgaaaaagctgaggccagaatcgtgaagtcacttgctcaaggtcaggcagcttaggaaggggcagatcgggggcttgaacccaggtggtcaggctctggagcccacaattgtcttacccactatgcccctctctagtcatggtccccaagaggggcttggagacccacttagcaggtgaaagcaatggcagccttccttatttgattatgcacctaagaataaatggtatttgggcatgtattcccaatatgtgtatatttatttataaatatatacagatactattatctgtatgttagtaataaagcttaaattattccattttaaaatt

SEQ ID NO: 1375 - DNA, 1785 bp, Homo sapiens
  misc_feature (1768)..(1768): n equals a,t,g, or c
ggggaaactgaaaaatacttgggcagaaagaaaatatcatcaaataacacctatttcttttcagctatagagatggctggatatcaaaagcaccacgggagctttgcaatttgctgcctcttttcagccctcagcttgactctcagttttcaagagggagaaaatgaatgtttcccagcattctctgtcctttgctccaaagaagagagcaggtgttggcttccaaaccttccgtattttcttattgctgttagggggatcaactgcatgtttcctgagggaaaagggtggctcactgacctacttgaaggcattctctcagtggaagctgggcaagagaatccagggatttcttttgcaggtttctgcgcagtgcccctgccatcaagctgcctaaaatgtgaatattgcttccctgcgtttcagaggtggtaatattggggcaagtggtggaggatctaaaaaaaaaatcatctttgtgctccctaccttgcccctggtatggattaaacagccaccaccctccttctcttataccctgggggcctcctgacaatacttccaattgctccattgattacttagattttttgggacacaaagggcccacgttgtgtcttcctgacaacacttttagttgctctattgattacttagatttttgttggcaattaggagcttttcagtaacattctttgctccatcggtagtctctgctggctcttgttcactcaggaaacacctgagcacagggcttcaggaaagccttctattaaatgggcagaggccccagcaggactcctgcatgttcatctgcacagccagagacagctggagggcaggaggagccgcgttcacatagggttctgcagccttggagccgccgtttcttccaagtactcttcagatcagtggttcttagccctgcctgaactgcagagtcctccgaggagctttcaaatgaagcatggcagcctgggcaggttgcaggtccattaaatccacatctccggggtgggagccggtggcatccttgctttgccagaactcccccattgaccctaatgtgaaacctgggctgagaggccctgcctaaagctcgattattttcacctgtggatgtaggcgatcgcttccttttgtggctgttgtcaggaggcagaaaatcccctgggttgttggctccctggagtcttatttttacagagtgccctgtttcaggtgcagcaacctgactgatgtttttacaaatcaccttttggtggcctcctgtcactgctgtctcccttcaagggttaaataagcctctctcacccattccttttcacacctgtgtcgtgtattattggcaggcctcagtcctcagggtgtcaaatggaactgatggatgccagacattgtggatatctgcaagtcctggttggtgaccagggacttgaagagtagactttcttctcaaacttatctttgtgctgttttccttccccagacctcatagtctggagcccatgtttccaggggtggaatttgattttcccagagaggagctgtgttcggcttctaggctgaggagctaagctgccgagcctctgccagccctctgtggattcgctcctgcattattcagcgcctttgctgacagagcaccatgttccactgctgagcagatcagggtgaatttccaagagggaacattgcagatggttttgcctttagggatggattttcttactcccaagtgactcacttctggtaaaattaaaaaaanaaaaaaagggcggccgc

SEQ ID NO: 1376 - DNA, 2664 bp, Homo sapiens
ccacgcgtccgctctgtcactggtgccttctggaagatggcttccccttggggagcatttcctgcaaagactcacaagtttaaaataatttaggatatttctctgtacttgagagccaggataggatgagagttggtcctgccctgatgctgtaaggccactcctgtctcagaccctgaggtcctcaggagtggtttcccaagtactgttgtagttgtatggcaagatcactcttgattattttaggagctgattttacttttcctacctcttttaactgcttccaaaagatgaatctggccaagaagagcaggggctcattcactcatttactcactcattcctggtgcttgagtttattcctgaaggaagctgaccaagggttgagagaaaacaactttgatttttctcatgtctgccccagcaaacctcctttgtggactgattctccttctgtgcctggaagaaactgggataatcccaggacttttctggtcccttctaggtaattcagtgtcttccactaatgtggccccacacaggctgggcttgttgattagtataggtccagcaaaacagttaaaactctacatgtcttccgcatgtgaacctcttcccaacctcacctggtgctgtggcaggtgggaggctgggtgtcaggctggctgctgccccctgggttctgcccagctggtagctatggcttccaaccctccagtgggaggaacaagagggataagaggtaaggacaggagaggttctgtatggctggcatggcagagagctggcacatgaggctggcaggaaatccagagggctctgggggcattctcatggtctcctaagtgaccacactaccctggggtgtctctgccacaactggccaactcaggaggtgtatcctctccagctggtcccttacactcacttccttagccctaggtggccgtggtacctctagcctcttgccaaggtctgccctcacatctccaggaacccttctgggcaggatttaagacatcccaggccagtgttcaggcactatgaccccacctggtccacaggaaatgtgcacctttgatccactgggttagggttatttccacatgcagcctagttgcctactgggagctccaggagtcaacttttgccctttagatttcttgagtgtaagagggataccaggtctctgcccaccaccagcctcagaaggcacacagtaggcacttgcaggcctcgtgaaacccctcttggaatgaagtaaggagaaagctgcccatccctctcatggtacaggttgggtggggacagactgagagcactgcccccctctcccaaggaagccctcctgtcaaacttgagcttctctcatcttcaacacctcctctacctagatcacccagaatttcacatgggaacaattggcacttcttgtcttggggcctcagctaaaattcagactggaaaagctccatattaacatcctgttctaatgcaagtaaaaaaagagctgctatggtctttgcttcttggtatttagagtctagtgggagaatattggctacttaatgcagtctcttccattttcaatatgtaactgaggcatccttctactgataacagccaaaacttcaagaaaaaatattttaagcctttaaaaatacatttgtgggctggtaggaaattaaggaataatcagagaccaaaaactaagtgaagctgagaacccagagataactttattaaaggagaatattaaacatatacttcacgcagaaggaagagaattccaggtggaagatttgagatgcaagggggaatgaaaaacaagaaggtggtgactatatgggtaaatcaaatcaaatcaaacaccttgtgtaaaataataatggtgatataagaattttaaaaagagaaataagtatatagtcataatatgatacaaatttgaagagggtgatgagttaaaaagttctaagattcttgtgttaactttggaggatggttatctaatttgtaataaaattttcaggataatcatcaaccgtagaaatggggttgaaatttcaaactaatggaaagaaaaaagaatgagaaaatataatcaatcaaaaggaaaagactagaaagggaaaggaaaaaagaaacacaaaagaggtggaacaaaagtccaaatatatcagtaactacaataaacataaatggaataaacataacaactaaaagataaagattattaaagtggattactatatgctgtttacagaaaacacatctacactctaagggtacagaaaggatgaaagtaaaaggatgggaaagggtatactggggaaatataactgaaggaaatatgatgaatctatattaatgtaaaaaaattgattttggggtaaaaagcatcactggagatagagagaatcactatgtaatgattaaactattcatttcatcaagcagataatataattttgaattttattctttccataacataatttcaaaatctgtaaagcaaatattgacagaactataaggaagaatatataaattcatcatcagagagaaatattttaaatactgtaactcagtattttatagaagaagtaaataaaagccagtaaaggttatagaacatttgaacaatgcaaaaaaaaaaaaaaa

SEQ ID NO: 1377 - DNA, 2487 bp, Homo sapiens
accggtccggaattcccgggtcgacccacgcgtccgcgcgcgctccctggaaggagaagtctcagctagaacgagcggccctaggttttcggaagggaggatcagggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggcgacagcggcgaggggagcgctggagaaggcgagcgggcagcgccgggagccggagatgcagcggccggaagcggcgcggagtttgccggaggggacggtgccgccagaggtggaggagccgccgcccctctgtcacctggagcaactgtggcgctgctcctccccgctggcccagagtttctgtggctctggttcgggctggccaaggccggcctgcgcactgcctttgtgcccaccgccctgcgccggggccccctgctgcactgcctccgcagctgcggcgcgcgcgcgctggtgctggcgccagagtttctggagtccctggagccggacctgcccgccctgagagccatggggctccacctgtgggctgcaggcccaggaacccaccctgctggaattagcgatttgctggctgaagtgtccgctgaagtggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaaggtgaggggcagagaggaaactgaaaacccgtggaacagcagagggctggcaggagagggggctcatgtgactgcaatgatccagtacccaggtctccctttccccagcatatcttccccttctccttgattcgctatgatgtcaccacaggagagccaattcgggacccccaggggcactgtatggccacatctccaggttggtggtgttctggtggggtgggcggggtgctgaagctggcacaggaggactggaattggagactggggtggatgggggcagaaggctctgggaaaggtgacaccactcctgaccctggtgactctgccaggtgagccagggctgctggtggccccggtaagccagcagtccccattcctgggctatgctggcgggccagagctggcccaggggaagttgctaaaggatgtcttccggcctggggatgttttcttcaacactggggacctgctggtctgcgatgaccaaggttttctccgcttccatgatcgtactggagacaccttcaggtatctgtccataactggtttttcatcctggacatctgatctctgtgatccaaagcttctgaacctcaactctctaatctgccacctcaacctgggtcctaagctaatctctcattctcagatctcaccatttcatccctgtgacactgacctctgacctcatctccccaccaagcccataaggccctgacccctgactcccagtttcagatctctgctctctgacaggtggaagggggagaatgtggccacaaccgaggtggcagaggtcttcgaggccctagattttcttcaggaggtgaacgtctatggagtcactgtgccagggcatgaaggcagggctggaatggcagccctagttctgcgtcccccccacgctttggaccttatgcagctctacacccacgtgtctgagaacttgccaccttatgcccggccccgattcctcaggctccaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgacctacaaaaaaaaaaaaaaaaaaaaaaaaa

SEQ ID NO: 1378 - DNA, 649 bp, Homo sapiens
  misc_feature (480)..(480): n equals a,t,g, or c
  misc_feature (500)..(500): n equals a,t,g, or c
  misc_feature (527)..(527): n equals a,t,g, or c
  misc_feature (576)..(576): n equals a,t,g, or c
  misc_feature (610)..(610): n equals a,t,g, or c
gaccgtcacaggkcagagggagcaagagatttgcatctgagaaactaagccctggtcatcatggggaagtggaaggagagcctacagaatgcakaccacttgcctcccatactgctattacgtstcatccacctcttctgcgccgtcctcgctggaggaaaggagaacgggcagatggctgtaagtgatggctctgtgaagggcctgctgagtgtggtgcggkgctggagccgtgggccagccccggacccgtgcctagtgccactggctctagaggcactggtaggtgcagtccatgtcttgcatgccagccgcgcacctcctcgtggcccagagcttcgtgccctgcttgagagctacttccatgtccttaatgctgactggccagctggtctgagctcaggccccgaagaggcccttgtcaccctccgggtcagcatgctcgacgccatccccatgatgctgcatgtgaagaccggncagtgcttgcagccaccttnctcagcaacaattgctttgaacacctnactcggctcattcaagaacaagcaagggtcctggaccaagacacagacncattgcagtccatgtagtcagagtgctgacctgnatcatgaagtgactccccttgggccaaggaggtggttaa

SEQ ID NO: 1379 - DNA, 1239 bp, Homo sapiens
gaaaataaatcggcagcaaagagagacgagacgcatgctgatcttcaggtgttggggacatcagggacgcgaacatttattgagctcttattgtataccgcgtcggccagcatttgtktccatttcacacatgaggaataagaggcccagagaggtgaagtgacttccttaaggccacacagatagtaagtggccgagacgaatttgaaaccaggggtgtcctgtttgaacttggtgccaaatagagtaactcggactccagttggaggggttcgggagaaccatagaagakgaagggccgtgtcttccgtggacaggccaccggagccgccagctgtttggaactgagctactgcagaaagggaagtggagagtaagggccargccccgtgggggcagatggccggcagaaggctgaatctgcgctgggcactgagtgtgcttygtgtgctgctaatggcggagacagtgtctgggactaggggctcgtctacaggagctcacattagcccccagtttccagcttcaggtgtgaaccagacccccgtggtagacgttacctgggcttgyatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactgggtgaggaactgaggctgtgttcctgttggggctggccttggtcccacagcaaaccattccctccgcagctctttgctttcctgggctttctgaccagcgccctgtggatcaacgcggccgc

SEQ ID NO: 1380 - DNA, 1951 bp, Homo sapiens
  misc_feature (25)..(25): n equals a,t,g, or c
atttaggtgacactatagaaggtancgcctgcaggtaccggtccggaattcccgggtcgacccacgcgtccgagctaccatgtcctcttggagcagacagcgaccaaaaagcccagggggcattcaaccccatgtttctagaactctgttcctgctgctgctgttggcagcctcagcctggggggtcaccctgagccccaaagactgccaggtgttccgctcagaccatggcagctccatctcctgtcaaccacctgccgaaatccccggctacctgccagccgacaccgtgcacctggccgtggaattcttcaacctgacccacctgccagccaacctcctccagggcgcctctaagctccaagaattgcacctctccagcaatgggctggaaagcctctcgcccgaattcctgcggccagtgccgcagctgagggtgctggatctaacccgaaacgccctgaccgggctgccctcgggcctcttccaggcctcagccaccctggacaccctggtattgaaagaaaaccagctggaggtcctggaggtctcgtggctacacggcctgaaagctctggggcatctggacctgtctgggaaccgcctccggaaactgccccccgggctgctggccaacttcaccctcctgcgcacccttgaccttggggagaaccagttggagaccttgccacctgacctcctgaggggtccgctgcaattagaacggctacatctagaaggcaacaaattgcaagtactgggaaaagatctcctcttgccgcagccggacctgcgctacctcttcctgaacggcaacaagctggccagggtggcagccggtgccttccagggcctgcggcagctggacatgctggacctctccaataactcactggccagcgtgcccgaggggctctgggcatccctagggcagccaaactgggacatgcgggatggcttcgacatctccggcaacccctggatctgtgaccagaacctgagcgacctctatcgttggcttcaggcccaaaaagacaagatgttttcccagaatgacacgcgctgtgctgggcctgaagccgtgaagggccagacgctcctggcagtggccaagtcccagtgagaccaggggcttgggttgagggtggggggtctggtagaacactgcaacccgcttaacaaataatcctgcctttggccgggtgcgggggctcacgcctgtaatcccagcactttgggaggcccaggtgggcggatcacgaggtcaggagatcgagaccatcttggctaacatggtgaaaccctgtctctactaaaaatataaaaaattagccaggcgtggtggtgggcacctgtagtcccagcaactcgggaggctgaggcaggagaatggcgtgaacttgggaggcggagcttgcggtgagccaagatcgtgccactgcactctagcctgggcgacagagcaagactgtctcaaaaaaattaaaattaaaattaaaaacaaataatcctgccttttacaggtgaaactcggggctgtccatagcggctgggaccccgtttcatccatccatgcttcctagaacacacgatgggctttccttacccatgcccaaggtgtgccctccgtctggaatgccgttccctgtttcccagatctcttgaactctgggttctcccagccccttgtccttccttccagctgagccctggccacactggggctgcctttctctgactctgtcttccccaagtcagggggctctctgagtgcagggtctgatgctgagtcccacttagcttggggtcagaaccaaggggtttaataaataacccttgaaaactgaaaagaaaaaaaaaaaaaaaaaaaagggcggccgctctagaggatccctcgaggggcccaagcttacgcgtgcatgcgacgtcatagctctctccctatagtgag

SEQ ID NO: 1381 - DNA, 3393 bp, Homo sapiens
  misc_feature (3348)..(3348): n equals a,t,g, or c
  misc_feature (3371)..(3371): n equals a,t,g, or c
  misc_feature (3386)..(3386): n equals a,t,g, or c
  misc_feature (3390)..(3390): n equals a,t,g, or c
aatcccttcctatatttggtacgcctgccggtaccggtccggaattcccgggtcgacccacgcgtccggggaaaagggcatggttgggaggttgagcagtaagagaccattaatactaagtattttgcctgaaatgcttctttataattatttcagggaaggaataagataatctcagacttactggggtggggcttggggaatgtttggatgttgctctttttcttcttccttctttttttttttttttttttttggttggtgttgtttggcatttttttcttttcctttttaaagaaaatgttttcaggaaacatgaacaaacatactgccaattatagtggggctgggaaggcacaggagctggcgacctctcagctgcatagttgggacggcaaaccctgctgtgagcttctcagacttttcacctacttcacctattaagaagccatgaggagttgtaaactcttgttcagggaagaaaagagggcaggaggaaktaacccaatgcctttaaatacaaaacagatgaaaaacaaaatactcatttttccttttctattgtgggtttggggagccaaaccaagtgtgactgtgagcacgttcactgagaggcatgacaacattattgaagaggtctttccattatgtctggttctcttattttcttaagtcaagccttaactatgwacatactttaagatgatacgggtctgtcaccataaacctgtaaaagggcatcgacagcttttcagataatccaggaatgttgagacatggctaagtttctagctgatacttagtcattccctcttgatattgttgggatgggtagccaaaaggcaggcttgtgggagttaagagccaatgatacctggaaacatgggaggtagctgggggtacaagtggatgttgagactgaaggaagaggtggaaagaagacacagaaggcacccagatgccaaaaggcctggcatgaatgagagttggcatctgtcctgttgtggtgttcccattcttgccatacccatttgcccagattgttctgattctcatgttcaattgactatcccacatgagactacagtttataggcagtgaggaattgtttcttcctgggaaatgtccttccagcaacttcagaggaatgggaaagtgttaatcttacgtgaagcaaaggagcctggactaggggcagagagaaagaagcagcagcccaccttctttgtgtttgcacatgtgcctatgtcgtgtacattggtacctgactgtggctcagatctgcgtcgcagcagcgagagaagaaatcactccatatccgatgagaggaagggtggcacararatggtgtctacaattagagacatttctgactycaccttagcctaagcaaactttatatactgagtaacatttgaaggttgtcttttaatggtggggggtgttttttcctttttaaactacagtgcttgcacaagagagggagggactywkaawwkkttagggcaggtgagggagacagkrgatggsctgrgatgacttgagtccatcatactattgcttggcaggtgtcctcccccatgtttgattcaaattccatgagtgacctacctttccccaggaatgggactgagagggtagtctccagcaactcagtctgcacagggctccccgttcaggctgcctttggtggttgtgcttttgtaagtttctttctctgcacttcgacttacctctgaatcagaaagcaagcccagcaggtgaatgagggatgtctgcttggcattgcccaatctaaccagggaggctggctggccacccactgtccgctagaggggagagctagcaggtgttggtatgaactcaggaatagaaacacgaggcctttttaaatacgagggagaagaatccatgatgcatacctgtaaccccctagaacccaagtgccagaattcctagatgctgcttctgtttgaacaaaatgtcactgcttttacacttgaaaaaaacacactcgaaaaatgttcaactccatgaaaaatattttttggctttaagaaattgtttggtgtttaactgtttcctttgattgccattccaccagtaaattgttggttgatttgcactgcactctggggttggggttgggaggggagggtccttatacagagccgaacctggggttgctcaggaagtgggccagggaatgtggaagtcgttgacattgcctgggccaaaagagtgggagatagtttttctcccctcagcccactcctggtagcacctgtcgccagcctggtacaaagccaggcctttttcttctgtgagcatctcatcactgtccagcagcaggtggaaaaagggggacaacaaccagacctattttttctcccccattttttccaaattttgctgtgccaaatgtttaaaattttataaatatgaatctattgaaatttccttaatcaagagcttcttcgtgtaaagtttgcttttttagctatagaaaaagaaaacagtaaatatctcttaatggcatccagccttgctgagctcaccttttttcctgaagaatgggtaggagtgaaatatttaatgtaaacatttcaccaagtccctttaccctaattttgaagctgcattaaacccaactcactaacacagggaatgattgcaccctagtcctctgtgggccaagaaactttcagaagcattaaaaaaatagttgaagtatatcacttctcaccaagtgggtagagtcagttggctgtttgtcccttgttttttatttattccataattatgtttgtgctttttgttttgtaaacagtaatggaacgtacatttttattttgtttagaagacaactttgattcaatctttcaagaactgttccattcttggtttcttcttagggggataaaaagttaccagttaatttgttttgagatatttaagcattctttgagttatagaattgtgatgcagggatttgtgaatgagacatttacatgtgaaaggtgacttcactagttacctgcttgagcagagtaaagtgtgtatatgtacataaaatgtaagtaatcttaactccattgtgcagtgccttttagatgttccgctttctataaagtcttcaaatttttgcatatatattatatatatatgatgtaatgttatagaaatatatgtataatatacatattttttccaggggtatctgatagctctgtattttgttatggaagttgaaagaaaaaagtattttacctcagaaattaaataaaaaaatacttttaagtaaaaaaaaaaaaaaaaaaaaaaaaaaaaaaaaaaaaaaaaaaaaanaaaaaaaaaaaaaaaaaaaaaanaaaaaaaaaaaaaanaaancaa

SEQ ID NO: 1382 - DNA, 1035 bp, Homo sapiens
ccacgcgtccggaaccaagtcccctgcatgagatggagtcccatctcagcacatggccctgccatccatcctgttgtttgttcttaattcttctctttccttcacaccctacatccatgaccaaaagtaaagcccgcctacctcacttggaaaattgctctcaaaacgacacctccaaaccactaggccaggccaggccaccatcatctcccaccagaacaacagacctcaccactggtcccacttccagtcctgcccctctaggtattctccatactgcagtcagagtgacacacttacacacacttaccctcatgggagaagagaaagctgtgttcgttgcaagggcccaagtgggaaccttggcttagtattcagaaaagccagaggtagtgagtttccgaccctaggcagatgaccagcttgctttggaagtggctctcctgtctgccagagggctggtgagggaagctctcagggcaggaggctgctcccaggcctcctgtcttctggaaggagagggatgtgcaccagccctgtagaacagccatgtctgtgggcccctctggcaggtgggcttaggacctccaaggggcgccttcatcgagttggggtggaggcagacttagcagccccatgagagttcatctttatgtgcatcatgcttgggtttttccttgctcccatttgcttttcctggctccaaagaatgaccaaaccagtgtttgcttttttaatttgccatattaaatatagcctttgtggcaggcttttacatccaggcagtaaactctagaaatggacattgatcagggggtggttgatgtaaccgaggttgtaaatgctaagaacggagatgccattccagtttaatgcttttatctagcaaatgtgccttgtatggagggggcataaatcttccaactgggggaggcatgggggaggggcaggggatggtgggggcaggatgtgaccttgctgtgtgtttccaccaggtgtcactgttaactggcaatgcaaaaaaaaaaaaaaagg

SEQ ID NO: 1383 - DNA, 1939 bp, Homo sapiens
gcgtccgcggaagggtctgcagggcttgtggggggcagtgttctgcaaggggcaggcggcgctggctttggctgcttgtggggtcctcttaggctccggggggcctgcggcggcctgggaggcagacccccgcgggcaggtgtggccgtgtcccgaccgcgcgaggaccgaagttggcggaagcccctgtgcggtgccttccagcccggaggaggctggcctgaagcccccaggcgttgccgaagcctccccctgccagcgcccaaagccgcgtttgggcttttacaggtgtagtttcccctcgacttggagcccgtcaaccccttcgtctcctaattctcaaccccccttttttttcttcttgcacgccagtaaagtgcaaggcccccaaatgtaccgctcgttgatgtatcacccagctcgggagcctgctgattatcaggccaagaaataaaaccttgcttctgccagaagcccggtgccctctcccagcctggcaacagagcgagattccatctcaaaaaaaatctattcttcattattaaataagcgtgcagttgttgagttttactcaaagtgaggcagtgttgtagatctagagtcccaatatctggctccatttcctacaaaagaaatgtaagctatgactgtcactttatttctctaggccttagttacctcacatatagcaaaaggactattttgaggataatgtataggaaagaagtgtataaattataaaacattgctgtattgtttgtatattttacattttgtaatcagtgaaagtttaatcagttaatgtttaacagattcaaatgccgtgttttaaaacagtttctgttatctcccattcctctttgcttagtgtaatagtagttgcttatgctaataacaaaagaaaacaaagaggaagaatttagctgggcttcccagaggagtgagtcctggaacagaataccaacttgggtctctatgtctcctgctgactacttagggtagttgcaaacatatcctcaactatgttggttctgaaaagtcaggcaatgggtcattttggaggtagggatgtgggagggcccttttgatactaggataaccattcattgaacaaatacttccagaacatctactcaatataagccacagtagaaaatgtaaatatgtgtaatccttagtcctgcctccaggaacactgtcctcaagaggtgtggaacagacagaccaaaagcatggagtagcaggtagcaaagataatactaacataggagattgggatagattccatagggatacagataacgtgctgtggccgggaggtggacacagttttgctgtataaaagttaaaagagattttcaggaggaagcatctgtgggagtgagccttggagggtataggattggggtggatgaaaatcaagacaagggctgttagtaggtgtgcgggagctgaggtataggaacagggggacagtgtgctcttagccatgctttagctgattgaggggagagtttttgctgtcttctcagggtataacccaggtccattttgtcctttccctgtgactggtgacttctctgccctgaagttggctactctgcagagataaacattttcacctctggggaataagtagtagtgatgggaaatcctactaggtgttttgccatgctgctagcaccttgacttttcttatcaccttgagcaattacttaagttctctgtgccttggttgccttacctgtaaaatgggactattaccaatctctgacagttactatgctaattaaatgagattacctttttttttttttttttgaggtggagtttcgttcttgttgcccaggctggggtacagtgagctgagatcgtgccactgcatgccagccagggcgacagagaaagagttatctttttttttaaaaaaaaaaaaaaa

SEQ ID NO: 1384 - DNA, 1262 bp, Homo sapiens
  misc_feature (568)..(568): n equals a,t,g, or c
  misc_feature (639)..(639): n equals a,t,g, or c
cctyctataggkmaagctggtackcctgcaggtaccggtccggaattcccgggtcgacccacgcgtccgcttacaacttctctyttgtttctgtgtttcttccacaccattatggcgtatttactgatctacaaccggttttaagttagttgcctgcttaaaattttctcatgaattctcattacattttcaaacaaaatccaaagtttttaccatgaccttgtggatatctttctgacctcatttactactgttatcttccttattcattccattccacccacagtggccttcttgcaagtcagagaatgcaacaaatatgctcctgccttggggcatttgcacttctgttcttttggcctggtcacttcacctccacattctccattttttatgactttcttcctatatttggatctctgttcaaatgtcacccctcaaaaaggccttcaaaactaccctatttaaaatagcacctgccactgccatctccatacccattttcatttttccatagcacttatccctacttggcattatgttatatatttgtttatttgkttactgnctgtctcccccactggactgtaagctccatgactgtaagtacatagatgaattacaaaatgaatcaatggngaawtatccttgmcatatattatttaatgattttgmctccattttaagtaaaaaaaaaataccatttttttcactcttcaaagtgatatagtttaatcttctaaactacatttttctcatttcccgatttaattaaatcagtgatataaaaaaaagagtgatggggatatgtgaaagaagactaaaatagatgccaggaaatactaaaactgctgaagtttagtggtatattttttctttacacacagtattatttgagttactaattgtgtcactgaattacagaataagcaaaatactaggtaaacagaatcacgcttgggggctatattttgtgtaaaatttgtgttatgcaaaaataatattaaatatttaattactacagttttgttatttctttcttattttaggaaatgatttgcagctgagtgaatcaggaagtgacagtgatgactgaagaaatatytagctataaataaaaatttatacagcatgtataatttattttgtattaacaataaaaattcctaagactgagggaaatatgtcttaacttttgatgataaaagaaattaaatttgattcagaaatttcaaaaaaaaaaaaaaaaaaagggcggccgc

SEQ ID NO: 1385 - DNA, 1931 bp, Homo sapiens
  misc_feature (1904)..(1904): n equals a,t,g, or c
  misc_feature (1914)..(1914): n equals a,t,g, or c
  misc_feature (1921)..(1921): n equals a,t,g, or c
ggcacgagcggcacgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaacaaaaaaaaaaaaaaaaaaaaagggcggccgncctaaaaggntccaagnttacgttacg

SEQ ID NO: 1386 - DNA, 1802 bp, Homo sapiens
  misc_feature (1790)..(1790): n equals a,t,g, or c
  misc_feature (1792)..(1792): n equals a,t,g, or c
  misc_feature (1801)..(1801): n equals a,t,g, or c
gaattcggcacgagtctctctcacttttgaaatgcttattattttaatgacaataatgcagagagagagagtatttttgaatagacttaagttttccttcaactaatgtctccttggaggacagaaatacaactaaaccctctgtcaacgtgggtatgtatttttttactttctatttttcaattagttcttttatgttttttcttctagtcattgttaaagctaccaatggaccaagatatgttgtgggttgtcgtcgacaggtaatactttatatttgtatagtgcctgatgattgacaaagcagtttcatgtaagtkattgtctcyaattcttgaggcwagcaggtggagcatttatgcccataactcacaaggatgatttgttcagacatagctagttattaacaaagcctgaattcaamccatgggctttgactcctggcattccgtactttctactgtattacattgtctcagtcagatctgttaatagccacttagaaataaaagtattttagaactggaaaacagacattttattttaatgtcatttttaaagaggacttaaaagtgttagatatcatcagttacctgtgtttatatttagacattcagaactgttacttatggactgtaccatggcctaagttaattttgtatgaggtcatttagattagggtagggcaagttgaaataattctaaattttattttacagttatcaaagatgccaacaaatgacctcaagtcattcagtagtgtctgaaatcaatttatgtattattctttaggaagtgtccttagataattcttttaaattcattggaagagttttctctgtttaattgtcatttcaggttcaggttttaaaacattcacagaacatggctgtaagggagaatttaatccaggaactataaatctcctattaggattttgcctagtatataagcggttgacattttctaagtcaaaatattagatacctaaactgacaagggattttcatgtccctttcagggctctgtggatgccgaaagttggcatttctaagatatttcaggttgcatgaggacaagactgtatttgaagactaaaaaacattagaaaagccgaagtatatataagttgagtatcccttatccaaaatgcttgagccagaaatgtgttttagattttggctttttttttttcaggttttagaatatttgtgktgkactggttgagcatycctaattaaaaaaaatcaaaagtttgaaatgctccgatgagcattttctttgagcatcatgtcagcattcaaaaaatttcacattgkggagcattttggattttcagattaagaatactcagcctgkatttcctatagatgtaaacattgaaatagcttcatattgatttctcctcttattttttcaagtaacctcacttcttagccgttttttccttaattgttatattaatcctagtgttttgcctatcttcctaaatttgaagctctttgtaaaatcctgtgacaagtggtcagtaatttatatgattccgaaattgtattggcacgcagttttttaaactattaaaaagtaacttgggtcgggcggggtggctcatgcctgtaatcccagcactttgggaggctgaggtgggcagatcacgaggtcaggagatcaagaccagcctgaccaacatggtgaaaccccgtctttactaaaaaaaaaaaaaaaaaaaaaaaaaaaaaaaaaaaaaaaaaaactcgagggggggcccgtacccaattcgccctatagtnantatagtgant

SEQ ID NO: 1387 - DNA, 968 bp, Homo sapiens
  misc_feature (35)..(35): n equals a,t,g, or c
  misc_feature (45)..(45): n equals a,t,g, or c
  misc_feature (135)..(135): n equals a,t,g, or c
tccccttggggccggaaaaagcggggttggcctgnccattggttntccatgccgcccgcccatgccccagtactagcctgcagtcccaatgtagcccctccctcytccmagagcccytcmaaccgccccgstcanttgtgatttcaggaggatttgatgaagatgttaaagcgaaagtggagaaccttctcgggatttccagcctggaaaaaacggaccctgttaggcaagcaccctgcagccctccctgtccccttcttcccctccccttcycccgcccgtggagacagctgttytcagcagggctctccgcagggagggggccggctccttccctggcagcaacatccttgcccttgtcacacaagtcagcctccatctgcgcagctctgtggatgcgctgctggagggcaacaggtatgtcactggctggttcagcccctaccaccgccagcggaagctcatccacccggtcatggttcagcacatccagcccgcagcgctcagcctcctggcacagtggagcaccctcgtgcaggagctggaggctgccctgcagctggctttctacccggatgccgtggaggagtggctggaggaaaacgtgcaccccagcctgcagcggctgcaarctctgctgcaggacctcagcgaggtgtctgcccccccgctgccacccaccagccctggcagggacgttgctcaggacccctgaggggagagctcatgccagggggctcctgctggaggctgggggggctctgcwytkycwwwtggcctgggcaatacggcccacgtgggcgtcgtgccctctggcccagcagtgtcttgcccacactcagttcctgagggccctgggcagcccctgggggagagactagaaaacacagaaggaagcagcacagggagacccgctttgtgatctgcatgtgtgacactgattctttggaaataaagagtggaagctg

SEQ ID NO: 1388 - DNA, 2232 bp, Homo sapiens
  misc_feature (507)..(507): n equals a,t,g, or c
ttagcagcagcctgtctattgggacagcttggtcagcaaggggtgacctttgacctccagcccatggaatggatggctgcagccacacatgccttgtctgcccctgcagaggttcggttgactccaccaggtagttgtggattctatgatggcctccttatccttctgttgcagctcctcactgagcaggggaaggctagcctaatcagggatatgtccagttcagaaatgtggaccgttttgtggcaccgcttctccatggtcctgaggctccccgaggaggcatctgcacaggaaggggagctttcgctatccagtccaccaagccctgagccagactggacactgatttctccccagggtatctttctatcacatggaagtatcctcatgtccatcctgaagcatctgctttgccccagcttcctgaatcaactgcgccaggcgcctcatgggtctgagtttctccctgtcgtggtgctctctgtctgccagctcctttgcttnccctttgcgctggacatggatgctgacctccttatagatgtcttggccgacctcagggactcagaagttgcagcccatctgctgcaggtctgctgctaccatcttccgttgatgcaagtggagctgcccatcagccttctcacacgcctggccctcatggatcccacctctctcaaccagtttgtgaacacagtgtctgcctyccctagaaccatcgtctcgtttctctcagttgccctcctgagtgaccagccactgttgacctccgaccttctctctctgctggcccatactgccagggtcctgtctcccagccacttgtcctttatccaagagcttctggctggctctgatgaatcctatcggcccctgcgcagctcctgggccacccagagarttctgtgcgggcacacacttataggctcctgggacacttgctccaacacagcatggccctgcgtggggcactgcagagccagtctggactgctcagccttctgctgcttgggcttggagacaaggatcctgttgtgcggtgcagtgccagctttgctgtgggcaatgcagcctaccaggctggtcctctgggacctgccctggcagctgcagtgcccagtatgacccagctgcttggagatcctcaggctggtatccggcgcaatgttgcatcagctctgggcaacttgggacctgaaggtttgggagaggagctgttacagtgcgaagtaccccagcggctcctagaaatggcatgtggagacccccagccaaatgtgaaggaggctgccctcattgccctccggagcctgcaacaggagcctggcatccatcaggtactggtgtccctgggtgccagtgagaaactatccttgctctctctggggaatcagtcactgccacacagcagtcctaggcctgcctctgccaaacactgcaggaaactcattcacctcctgaggccagcccatagcatgtgattccagattcctgcggtccagcctccaactttggttgccagctctttcttattctactacacaagccgccaactcaactgagagctaaagagactagaaaagagataagctgccaactcaactgagaacaagaaactagaagagatttatatataaagcttcttccttctcccagatgcaggatgttttcaaccagtaaattttattgctgttggtgccagagaagagtcctttcttctctacatccaggggccttttctccaataatgtgcctttaactctagggacctgcctcacggaccttagggaaaaacctcaacctgaaagatctcttcctttctggagctcctttaatcttcccagcaggtttttgccttagacgtgctggccccaggacagtgatgaagacagagcctgtctcagctctaggctgtggggatcaatgccatcagtccctgttattgagggattatcccttagccaacattcctatctgtgggtgggcgtggagagtgtatctttttttggggtgtgtgtgtatatgtgtgtgtgtatgtgtgtgtgtgtttaatagttctgtttgtaaactcttttaataaaagttgtgcctcaccatacttgaagctcccaggacaagggttgagaggctcaacccctctttcagcttctatgtggtgttggaggtgctggtatcgtgttcacacaaaaaaaaaaaaaaaaaaaaaaaaaaaaaaaaaaaaaaactcga

SEQ ID NO: 1389 - DNA, 751 bp, Homo sapiens
  misc_feature (158)..(159): n equals a,t,g, or c
  misc_feature (202)..(202): n equals a,t,g, or c
tcgacccacgcgtccgaggagctggacttctgagacagccattctccttgcatagcactgtctgctgctacagctcatagaagtcaacaattttcttcaacactggtaggcagcctctaaatggccctgatcaccctcacctcctgccattcacaccnntgtaaaattccacccctggacctagtgactcacttctaacaangagaatacagcaaaagtaacatcgcttctgaggtgaggctacaaggagactacgatgcctgccttggtcacccttctcctgctctttccattgctccctctgatggaagccagttgccatgtgatgaggtgccctatggagaggcccacgtgacaaggtattgtaaaaagcctctgaccaatagccatctagaaacggaggcccagtccagcagcctctgagatgaatcctgccaacctgagcttggagacagattctctccctatcctgccttgggatgatcacagccaccaccaacaccttcactgcctggtgagaggccaagccagtgaacccaaggtaaactggacagaatcctgacccacagaaactgagataatgtttgttattttaagctgctcagtttgttacagagcaatagataactaactcaaacaccataaaattctaatattttattctatcacacaaaccaggtaataccaagtaaatgccattactatacacatatttttgtaacacaattacatgtgattttttaagaaggct

SEQ ID NO: 1390 - DNA, 2334 bp, Homo sapiens
  misc_feature (2278)..(2278): n equals a,t,g, or c
  misc_feature (2290)..(2290): n equals a,t,g, or c
gggagtgtggctgcagaacccaggtggcagggctttcctcaggccccttactcctgacctggacgaggccggggcttcctcaaggaggctctctgactgccacccctgcctgcctgcccggccctgcacaacatgcagccctccggcctcgagggtcccggcacgtttggtcggtggcctctgctgagtctgctgctcctgctgctgctgctccagcctgtaacctgtgcctacaccacgccaggcccccccagagccctcaccacgctgggcgcccccagagcccacaccatgccgggcacctacgctccctcgaccacactcagtagtcccagcacccagggcctgcaagagcaggcacgggccctgatgcgggacttcccgctcgtggacggccacaacgacctgcccctggtcctaaggcaggtttaccagaaagggctacaggatgttaacctgcgcaatttcagctacggccagaccagcctggacaggcttagagatggcctcgtgggcgcccagttctggtcagcctatgtgccatgccagacccaggaccgggatgccctgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccatcttacgtaccttctacatgctgggagtgcgctacctgacgctcacccacacctgcaacacaccctgggcagagagctccgctaagggcgtccactccttctacaacaacatcagcgggctgactgactttggtgagaaggtggtggcagaaatgaaccgcctgggcatgatggtagacttatcccatgtctcagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggcagatcacttcgaccacatcaaggctgtcattggatccaagttcatcgggattggtggagattatgatggggccggcaaattccctcaggggctggaagacgtgtccacatacccagtcctgatagaggagttgctgagtcgtggctggagtgaggaagagcttcagggtgtccttcgtggaaacctgctgcgggtcttcagacaagtggaaaaggtacaggaagaaaacaaatggcaaagccccttggaggacaagttcccggatgagcagctgagcagttcctgccactccgacctctcacgtctgcgtcagagacagagtctgacttcaggccaggaactcactgagattcccatacactggacagccaagttaccagccaagtggtcagtctcagagtcctccccccacatggccccagtccttgcagttgtggccaccttcccagtccttattctgtggctctgatgacccagttagtcctgccagatgtcactgtagcaagccacagacaccccacaaagttcccctgtttgcaggcacaaatatttcctgaaataaatgttttggacatagaaaaaaaaaaaaaaaaaagggcggccgctctagaggatccctcgaggggcccaagcttacgcgtgcatgcgacgtcatagctctctccctatagtgagtcgtattataagctaggcactggccgtcgttttacaacgtcgtgactgggagatctgctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctgttcatgatcataatcagccataccacatttgtagaggttttacttgctttaaaaaacctyccacacctccccctgaacctgaaacataaaatgaatgcaattggtggtggtaacttggttaatggagcttataatggtaccaataaagcantgcatcacaaanttcccaaataaagcattttttcctggaatttaaatgggggttgg

SEQ ID NO: 1391 - DNA, 604 bp, Homo sapiens
tcgacccacgcgtccgcagggaaggaccctttaagaggacatttactaaaatgcactttgcaacattaaaaagaagaccctggaatacatttctctccttctaagtgaaatgctctcaaagagctctaagatggtgtcagttaaacgggctgacccggggtctctgggtttcactttcttgctgtcctcccttcccaagtgtacagtgggggtctccagaggccgccccacatgcaccagctgctctgatggctgagataacgtctggcattcccgttcttcaaattaaacagaaacactattcagtgttttcggttttaattaagaatacggtaaatatcagtcaatacagcccacatgaacatggacccctttggggtcctcaatgacttcagaagtgattagtgctgaggtcagaaaaccggaggacaaaatcaattacacgtcctgacaaggagctgagcctggcatcaactcagagaaggggtttgcagataacagcattcacctgaggttccactaacacggaataaagctgtggtataaaataaaaaaaaaaaaaaaaaaaaaaaaaaaaaaaaaaaaaaaaaaaaaaagggcggcc

SEQ ID NO: 1392 - DNA, 854 bp, Homo sapiens
ccacgcgtccgcccacgcgtccgctctgctgagctggaacctggttctgtgctggagctgtggctgggtgtggtttgctgagaagcccccggggctgttgcccaccttgcttctgccccttgttcctgcagcacgtgcagcacatccgcatcgatggctccacctcatcagctgagcgggaggacctgtgccagcagttccaactgtcggagaggcatgctgtggccgtgctgtccatcaccgctgccaatatgggcctcaccttctcctcggctgacctggtggtgtttgctgagctgttttggaacccaggggtgctgatccaggctgaggaccgcgtgcaccgcattggacagaccagctccgtgggcattcactacctcgtggcaaagggcacagctgatgactacctttggcccctgattcaagagaagattaaagttctggcagaagccgggctttctgagaccaatttttcagaaatgacagaatccactgattacctctacaaggacccaaagcagcagaagatctacgacctattccagaagtcctttgagaaagaaggaagtgatatggagctcctggaagcagcagagtcctttgacccaggaagtgcttcaggaacatctggaagtagttcccagaacatgggagacaccctggatgaaagctcattgacagccagtccacagaagaaaaggagatttgaattttttgataactgggacagctttacgtctcccctgtaaaaggggcaaaaagaaaaaaataaaaagcattttaaaatcaaaaaaaaaaaaaaaaaaaaaaaaaaaaaaaaaaaaaaaaaaaaaaaaaaaaaaaaaaaaaaa

SEQ ID NO: 1393 - DNA, 1043 bp, Homo sapiens
ccacgcgtccggggcaatgtcgtgttgctgctcaagagcttagggatccatgacctaatgcactttgatttcctggaccctccaccatatgagacactgctgctggctttggagcagctgtatgctctgggagccctcaaccaccttggggagctcaccacgtctggtcgaaagatggcagagctgccggtggaccccatgctgtccaaaatgatcttagcctctgagaagtacagctgttcagaggagatcctgacagtggctgccatgctctctgtcaacaactccatcttctaccgaccaaaggacaaggtcgtccatgctgacaatgcccgtgtcaacttctttctccctggcggtgaccacctggttctgctaaatgtttacacacagtgggctgagagtggttactcttcccagtggtgctatgagaactttgtacagttcagatcgatgcgccgagcccgggatgtgcgggaacagctggaagggctcttggaacgtgtggaagttggtctcagttcctgccagggggactatatccgtgtacgcaaggccatcactgctggttacttttaccacacggcacggttgactcggagtggctaccgcacagtgaaacagcagcagacagtcttcattcatcccaactcctccctctttgagcaacagccacgctggctgctctaccacgaacttgtcttgaccaccaaagagttcatgagacaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttctatacattatttaatacctattaaataaaattatttttggaataaagcttgtgggaacattaaaaaaaaaaaaaaaaaaaaaaaaaaaaaaaaaaaaaaaaaaaaaaaaaaaaaaaaaaaaaaaaaaaaaaaaaaaaaawaa

SEQ ID NO: 1394 - DNA, 1370 bp, Homo sapiens
gcgtccgcccacgcgtccggcgttttacgcaggctgtggcagcgacgcggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccaggtgcattccccatcttaactgatttaacccctgaaacaacccgacgctggaagttgggttctcatccccactctacatatgtaaaaatgaagatgcagagagatgaagctactttcccagggctatatggcaagcaagtcgcaaagctgggatcccaatccagacagtctgaccgtggaacgagactcatacacgtaataaatgctctgcccccaacttgtccaccacaaaaaaaaaaaaaaaaaaaaaaaaaa

SEQ ID NO: 1395 - DNA, 1054 bp, Homo sapiens
cacgcgtccgcggcacgctgggaaagaatcctccagttttagctcctacttcaacagcatttccttatctatacagtaacccaagtgggatgtctccttatgcttctcagggttttccatttcttcctccatatcctccacaagaagcaaacaggagtatcacttctttatctgttgctgacactgtttcttcttcaacaacaagtcataccacagccaagcctgccgctccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaagaagatgcaaaggcagcatgaacttagtgagagctgtagtgcaagtgcccttcaggcaagattgaaagtagctgcacatgaagctgaggaagaatctgataatattgcagaagacttcttggagggaaagatggaaatagatgattttctcagtagcttcatggaaaagagaacaatttgccactgtagaagagccaaggaagagaaacttcagcaggcgatagcaatgcacagccaatttcatgctccactataggtaaattgtatttcaagtttgagtctcaaggtgattgcatcagtgttctttaaatagacatgttgttaacggtgcctgttcatcagccttaagcataattctgtcattatagttactgtgctatgtaacatagaatgctttgtattatataataagcataatataaacatataactagtagaaaaaaaaaaaaaaaaaaaaaaaaaaaa

SEQ ID NO: 1396 - DNA, 1288 bp, Homo sapiens
  misc_feature (1286)..(1286): n equals a,t,g, or c
ggcgcgcgggtgaaaggcgcattgatgcagcctgcggcggcctcggagcgcggcggascagacgctgaccacgttcctctcctcggtctcctccgcctccagctccgcgctgcccggcagccgggagccatgcgaccccagggccccgccgcctccccgcagcggctccgcggcctcctgctgctcctgctgctgcagctgcccgcgccgtcgagcgcctctgagatccccaaggggaagcaaaaggcgcatccggcagagggaggtggtggacctgtataatggaatgtgcttacaagggccagcaggagtgcctggtcgagacgggagccctggggccaatggcattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggcacttgttcagattacccaaaaggagatgcttctactggatggaattcagtttctcgcatcattattgaagaactaccaaaataaatgctttaattttcatttgctacctctttttttattatgccttggaatggttcacttaaatgacattttaaataagtttatgtatacatctgaatgaaaagcaaagctaaatatgtttacagaccaaagtgtgatttcacatgtttttaaatctagcattattcattttgcttcaatcaaaagtggtttcaatattttttttagttggttagaatactttcttcatagtcacattctctcaacctataatttgggaatattgttgtggtcttttgttttttctcttagtatagcatttttaaaaaaatataaaagctaccaatctttgtacaatttgtaaatgttaagaattttttttatatctgttaaataaaaattatttccmacaaccttaaaaaaaaaaaaaaaaaaaaaaaaaaaaaaaaanaa

SEQ ID NO: 1397 - DNA, 1026 bp, Homo sapiens
  misc_feature (974)..(974): n equals a,t,g, or c
  misc_feature (1011)..(1011): n equals a,t,g, or c
  misc_feature (1024)..(1024): n equals a,t,g, or c
ggcacgaggttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgcgtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgaccttttgtaatgatacacagtgaattcttttttgacaaagnggaatgcggtttggtatgcagagctgctggttttaangcccatggcattnac

SEQ ID NO: 1398 - DNA, 1182 bp, Homo sapiens
cccacgcgtccggtaaaatataaagaaactgaaccagtgtgtcttttcaccatagatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctaccttaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatgtaaaaaaaaaaaaaaaaaaaaaaaaaaaaaa

SEQ ID NO: 1399 - DNA, 1576 bp, Homo sapiens
cacgcgtccgcggacggtgggcggacgcgtgggttgttctactacactcccctactgttaacattttccccaaagaagaggaaaatagatttgtgaaagcaattgcacttcaaaatgcaaatgacagtgggggaaaaagaataccctgtttgctgccagttgatactttttagtttgtgctgtttcatttgggaagaattgttcttgtatattaaaatggagttttgccttatttttttactgcttatcctggagttttgtcaaatatttgattgtctaagaaaatgctattatagattaacatgtcttagctgtttacttctaaatcttttaatttttttcagtgaaaaagtagtatctgaaaatcccaacattgttgtaattgggttagctgytgttatcatgttgtctatcatgtttataaaatggttactcatcttgcttattttccttttatccttyaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaaaaaaaaaaaaaaaaaaaaaagggcggccgctctagaggatcccccgagggggcccaag

SEQ ID NO: 1400 - DNA, 966 bp, Homo sapiens
ccacgcgtccggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacagatacagtactgtagtcttgaagagaaaattcagtctccaacagaagaaacagaaatcttttatcacagaggggtgtaggcgtgagttttaggtgaatttatgtggttcctgcttgaaaaccttcccctctccaggttcggtttagagaactttgccacaggtcttctggggtttttaaggctggctggagaagacagtgggagggtgcccccgtctgacacccctggggttgctgaggggacggttggagtggggatcggcctgcgaaaggatactgtgaaatcactaattaactaataaacctgtctcaagttgaggatttgaaaaaaaaaaaaaaaaaaaaaaaaaaaaaaaaaaaaaaaaaaaaaaaaaaaaaaaa

SEQ ID NO: 1401 - DNA, 530 bp, Homo sapiens
  misc_feature (16)..(16): n equals a,t,g, or c
  misc_feature (22)..(22): n equals a,t,g, or c
  misc_feature (45)..(45): n equals a,t,g, or c
  misc_feature (47)..(47): n equals a,t,g, or c
  misc_feature (54)..(54): n equals a,t,g, or c
ttggcccccctagggncttttngccaaaaaaggctattttagggngnccccctntaggaagggtaccccccttcaggtaccggtcccggaattcccggggtcgaccccacgsgtccgccccacgsgtccgcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcagacacctgaaaaaaaaaaaaaaaaaaaaaaaaaaaaagggcggccgc

SEQ ID NO: 1402 - DNA, 1781 bp, Homo sapiens
  misc_feature (5)..(5): n equals a,t,g, or c
acgcntccggcggaggcgcgcggaacagtcgccgaggcgattcccgcccaggctcctgtaaccgccaggcagtggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaaaaaaaaaaaaaaaaaaaaaaaaaa

SEQ ID NO: 1403 - DNA, 786 bp, Homo sapiens
  misc_feature (770)..(770): n equals a,t,g, or c
gatatgttttaattatctgatttagatgatctactttttatgcctggcttactgtaagttttttattctgatacacagttcaaacatcattgcaacaaagaagtgcctgtatttagatcaaaggcaagactttctatgtgtttgttttgcataataatatgaatataatttaagtctatcaatagtcaaaacataaacaaaagctaattaactggcactgttgtcacctgagactaagtggatgttgttggctgacatacaggctcagccagcagagaaagaattctgaattccccttgctgaactgaactattctgttacatatggttgacaaatctgtgtgttatttcttttctacctaccatatttaaatttatgagtatcaaccgaggacatagtcaaaccttcgatgatgaacattcctgattttttgcctgattattctctgttgagctctacttgtggtcattcaagattttatgatgttgaaaggaaaagtgaatatgacctttaaaaattgtattttgggtgatgatagtctcaccactataaaactgtcaattattgcctaatgttaaagatatccatcattgtgattaattaaacctataatgagtattcttaatggagaattcttaatggatggattatcccctgatcttttcyttaaaatttctctgcacacacaggacttctcattttccaataaatgggtgtactctgccccaatttctaaaaaaaaaaaaaaaaaaaaaaaaaaaaaaaaaaanaaaaaagggcggccgc

SEQ ID NO: 1404 - DNA, 1512 bp, Homo sapiens
  misc_feature (2)..(2): n equals a,t,g, or c
  misc_feature (8)..(8): n equals a,t,g, or c
  misc_feature (16)..(16): n equals a,t,g, or c
  misc_feature (21)..(21): n equals a,t,g, or c
  misc_feature (29)..(29): n equals a,t,g, or c
  misc_feature (528)..(528): n equals a,t,g, or c
  misc_feature (600)..(600): n equals a,t,g, or c
  misc_feature (1496)..(1496): n equals a,t,g, or c
cngaaaanccccgtgncattntgggaaanaacgccccgcaggtaccggtccggaattcccgggtcgacccacgcgtccgcccacgcgtccgctcgctggtctttgtcctcttctgtgatgaagtgagacagtggtacgtaaatggggtgaattattttactgacctgtggaatgtgatggacacgctggggcttttttacttcatagcaggaattgtatttcggctccactcttctaataaaagctctttgtattctggacgagtcattttctgtctggactacattattttcactctaagattgatccacatttttactgtaagcagaaacttaggacccaagattataatgctgcagaggatgctgatcgatgtgtyctycttcctgttcctctttgcggtgtggatggtggcctttggcgtkgccargcaagggatccttaggcagaatgagcagcgctggaggtggatattccgttcggtcatctacgagccctamctggccatgttcggccaggtgcccagtnacgtggatggtaccacgtatgactttgcccactgcaccttcactgggaatgagtccaagccactgtgtgtgnagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcatcgtcttcgcttacttctacatggtggtgaagaagtgcttcaagtgttgctgcaaggagraaaacmtggagtcttctgtctgctgttcaaaaatgragacaatgagactctggcatgggagggtgtcatgaaggaaactaccttgtcaagatcaacacaaagccaacgacacctcagaggaaatgaggcatcgatttagacaactggatacaaagcttaatgatctcaagggtcttctgaaagagattgctaataaaatcaaataaaactgtatgaactctaatggagaaaaatctaattatagcaagatcatattaaggaatgctgatgaacaattttsctatcgactactaaatgagagattttcagacccctgggtacatggtggatgattttaaatcaccctagtgtgctgagaccttgagaataaagtgtgtgattggtttcatacttgaagacggatataaaggaagaatatttcctttatgtgtttctccagaatggtgcctgtttctctctgtgtctcaatgcctgggactggaggttgatagtttaagtgtgttcttaccgcctcctttttcctttaatcttatttttgatgaacacatatataggagaacatctatcctatgaataagaacctggtcatgctttaaaaaaaaaaaaaaaaaaanaaaaaagggcggccgc

SEQ ID NO: 1405 - DNA, 2287 bp, Homo sapiens
  misc_feature (1370)..(1370): n equals a,t,g, or c
ggactattctaaatattaatgtattaaaaaggaaaatacaacaaaatgtatatttagacacgagcttacatggcataccttatatttgtatcattctttaaagtttacaaaaaaaaaccttatgtttttatgtaatcagtcattacactagggagaaatttatcagctttagttctaaatatgctcatgaggtataaaagctatttcttcatcagtattttgcttttatgctgctttttctttttgatactccaggtttataaactatcttttaaaattttaagccaggacttcaaaaattgtagagtacttgtttggcgttccctaccttcattctcttagggttaaggagcctttctttctgcagctaagggcagaggctgtgcctagggctataccaccactagcatctgtatttgagactgtttccttagatgggtaagaggtggaaaacaaacttagtatcaggggtccatgaagcccatggcatcatttttgaaaatatttctagttttgtagccaaagcaattggtttagtaaaatgagacttcttcaggagtcmctcctttactgtggayccattgcttagtgggaatggaagtatatgtatctatcttgkgtattaacttctgacttatttatacaagagcagctataggagtttacaaaagaactttaagttattaagttactataaatttggggatcctagagtgatcttaaatatggcaagatacagctcatttagaataaaatctcacatccattattttaaagggaatgattggggggaaaaactggtgaagaagaaatataaaaaggaccctaaaaagaattctgcaaaataagagaagaaataatttgtgacaggtaatagaatactagtaggatagaaacaactagaaaggaaagtgtgacacagtttttaaatttagatgtagaaaataatgaattaatgagattggtgaaaggaaatcatgcaaaacatttgaatgcaaagcatttctaacaaaaagtgactggagcacttgccattgcaacaaccctgtttttgcaattaggtttttgactgttaaaatggatattttcataaaamtggtgttctgaattttgctacagggctgcttaaatttatgattacctgtagacacttgatatttacatagattacagctttggtaatatgtcactggagtaattacgctgtaatacctgttgagaattcataccatctgatgcttatatattaatttcttatgtttgtaagtttggctttggggaataggtgtggagaaattaaagagtgaaggccatatttcattttttataaattatctttcaagctcagatagcttaagagcagtttatantaaggagacccttttctccttgaggatagggataggtaaggtaaacttgtaaaaaggatgtcacagaagtcactttttaattaagtcatgattgagatactgaactcttccactcattcttctttcccattttcctattatgtttgataattatatgtatttttaaaaactgtgagagggaaaattagtcataacccttttgggttatccacttaaatttaggtattttcatattactcaggtaaagatggaaatgacagagcacagmcatttattttttaaattgatagggtagaaaatgaaatgtactyctgtttattcttaatactatatatatatacacacatagttttagcaaattggaaataatatattcatttgtatggcaagataaatgcagtcatcttaatactagtctatacatttttgccaaatggcgcaaatatacctccatttatattttgtatcttaaaatgtagtttaaaaataggaccatgtatgagacacttttttacaaaaagtgccgtatatacatatgtaacaggtgagtgtgtgtttaacataatttataattatttctgtcagtacagcgtatatggaaaattcaagttgtttttaacatattcaagtatgttcagtataaaataagttaatcccatttcataatgtaaatcatatttttgttatttgccatattttatttgaagtgataaaattttataactcaaatttgaatgtcatagtacattgtgtgctaaccatggcaagcaaacatttacatttgttttttacaataaatttcttttaaaatatactttctatttttctgtactgacatatgcaataaattggtacattaaaaatttgattaatgtcttcaaaaaaaaaaaaaaaaaaaaaaaaaaaagggcggccgc

SEQ ID NO: 1406 - DNA, 2902 bp, Homo sapiens
  misc_feature (11)..(12): n equals a,t,g, or c
  misc_feature (15)..(15): n equals a,t,g, or c
  misc_feature (2782)..(2782): n equals a,t,g, or c
  misc_feature (2848)..(2848): n equals a,t,g, or c
ccttttagctnntgnaaaaggctatttaggtgacactatagaaggtacgcctgcaggtaccggtccggaattcccgggtcgacccacgcgtccgcccacgcgtccgyyyacgcgtccgcccacgcgtccgggctggccctgggcatgggccagggcctcaaagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcatccccccagaggacaccaggattgacggaggccctgtgattctactgcaggcaggcaccccccacaacctcacatgccgggccttcaatgcgaagcctgctgccaccatcatctggttccgggacgggacgcagcaggagggcgctgtggccagcacggaattgctgaaggatgggaagagggagaccaccgtgagccaactgcttattaaccccacggacctggacatagggcgtgtcttcacttgccgaagcatgaacgaagccatccctagtggcaaggagacttccatcgagctggatgtgcaccaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggggcccaggcctcctggctccccacccgaggctgctctctctgcccaggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcacagctgttccctgatattcaggggcattgctcattgctcccttctcggaccagccttcttcctcccaccatggcaggtggggagcaggtctcccagaaacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgwggcacagacaggtggaaaacgggatagcctggcagtccctctgttgctgcattcgtgcctgggtgcctctcttcttnctcaggtactgcagaagggagcgaacagggtactgtcgctcttgctacagacaagcctggcactgnattcaaatcagcttcattactggatcaaatgcagtaccttgctaccatgggaca

SEQ ID NO: 1407 - DNA, 1363 bp, Homo sapiens
aggtaccggtccggaattcccgggtcgacccacgcgtccgttcatttctcttggagtagaattgctgaatcctatggacgatttcctgttcagtgtctccattttaagtgggattctttgcagcatcctggccgtgttgaagttcatgctggggaaggttctgaccagtagagcactcataacagatgggtttaactccctcgtgggtggcgtgatgggcttctccattcttctgagcgcggaagtgttcaagcatgactcggcggtctggtacctggacggcagcataggcgttctgatcggcctcaccatatttgcctatggggtcaaactcctcatcgacatggtgccgagggtgaggcagacacgtcactacgagatgtttgagtgaagggggccagcatccgcatgagaccatcgagatgaggagtttccacataggcaaagggtgccaatatttaactgaacatctggtttctttttggaagttttctttcacatggtttgtcattacaagacaaggtctgcccagccaggtggatctaccttgcccccatcacctgccgcccccatcaaacatgttgggacaatgcccataggaatggacctccttccccgtctccagctgggactggcgttttttagtctctggagtatgatggttctcatgggtaggatgagatctttggcagaaaggtcttcggtggtgctctgagcctgcgctgcataggactgagcagacccacctcctccagcttgggtggccctgccactcctggttccaagtctctcctttcctggcaggtcttaagggaagattgtacccctcaccctttacatacccagaatcatcagtatgtcacttcctaatttctatcagtgtatctcattatttcatactgttttactaatcctragtctaaacagatttgctcaaaaggagaccattctattttttaaagtacttagtgatacacgtataagctttgcatggacgaattaaataagcacattgaccttttcttgtacattcagaacctgaacatccatgtgaaaactgggtccatttttgagagatgtgaaactacagtttatttgtaataaataaatataatctatccgtatatgcatatatctatatgctgtgttaagtggtaatggtacattacagtctgtgagagatggatcgctccctctgtaaggaacaagacgttctcagctgatgtcacggtaggtttagattctgtagagtgttccccaaccygcaccgttctgtacctctcacaccactgcttgcccgggcagtagtggctgaccaataaagacctttacctgttttgtatggcaaaaaaaaaaaaaaaaa

SEQ ID NO: 1408 - DNA, 2537 bp, Homo sapiens
aattcccgggtcgacccacgcgtccgcccacgcgtccgcccacgcgtccgcggacgcgtgggttaggccctaatataaaaagcattgtcaccatgttgatgctgatgctattgatgatgtttgctgtccactgtacctgggtcacaagcaatgcctactctagtccaagtgtagtcctggcctcatacaatcatgatggcaccaggaatatcttagatgattttagagaagcttacttttggctaaggcaaaatacagatgaacatgcacgagtaatgtcttggtgggattatggctatcagatagctggaatggctaatagaactacgttggtggataataacacctggaataacagccacatagcactggtgggaaaagctatgtcttctaatgaaacagcagcctataaaatcatgaggactctagatgtagattatgttttggttatttttggaggggttattggctattctggtgatgatatcaacaaatttctctggatggttaggatagctgaaggagaacatcccaaagacattcgggaaagtgactattttaccccacagggagaattccgtgtagacaaagcaggatcccctactttgttgaattgccttatgtataaaatgtcatactacagatttggagaaatgcagctggattttcgtacacccccaggttttgaccgaacacgtaatgctgagattggaaataaggacattaaattcaaacatttggaagaagcctttacatcagaacactggcttgttaggatatataaagtaaaagcacctgataacagggagacattagatcacaaacctcgagtcaccaacattttcccaaaacagaagtatttgtcaaagaagactaccaaaaggaagcgtggctacattaaaaataagctggtttttaagaaaggcaagaaaatatctaagaagactgtttaaatgcactgttctggttcctaacttgaagcagttgtccttgtgagaaccggtctttgcctttagctcatgtcgtgtttcacagcaaagagggtacagaaccatcactggtccaggttaatgtacaaaattttctggcaatgcctgattaaaaaaataaaattggcttgttgagaacagctgttttcgatttctaatgtgaagcaagacagagcactgctgtaaatgtctagcagcagattttttttttattggtacatattatccttcaaatctgagaatttggactaactgcaccaaagaaccctctaatttggtccctggcacatgcatacttgtcaatgtttttattcttttacaagacctgcattttatttgaattacccgaatagcaatatgtaaaatacaagtgacaaaatgtgatgagagcttcttgaaccggtaaactagtacaggtctgagaaagacatattagaagaatcattatacttccttgaattatatttattttcatgtttctctaatgcaaagaatgtttcatcaaatgtatattttctgttgcttactgtttgctctgagaagaagctgctgtttcaaagatggacctctgagtagctaattgattcaagtagtttttttatgttgacacattattactgctgttagcagtcgttttcaccaggtacttacagagcagatttcatacatcattcattcaagggctaaatttatattttttggaaatcatggcaactacacaggatgttgcttaccaggacggagttttggtatcttagtactgaagttagcactatgtttacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgttaaaaatgtgacaattgtcaaaaaatgcactaaaatgtaaatggagattgaacaagttcactttccagcttataggcaactttatacagacttgaacattttctccagttgtttagtaaaagtgaaagagaaagggtttttcctgccacaggatataacttttttttatataacaagcataacacaccactgcttttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagtctggatttctgataccttgtcatttgggggattttattttactttgttgctttaaaattcaatgcagagaagttgttgactgtaggggaaataaagttaattcaaatttaaaaaaaaaaaaaaaaaaaaaaaaaaaaaaaaaa

SEQ ID NO: 1409 - DNA, 927 bp, Homo sapiens
cactagcagcttctactgtaaggttagagctgacagagaaagaactccttaactactatttgcttcattctctacaaaggaaactagagaagtgggttgatgtaatagaaagaacatgtgtttgtggggccaggcaaacctgggtttaattctgtttcaacactgcttaacaaaatttatgggaggctattgttttggatggggctcctgcaccaggcccctccgggaccaaaccaaaatggagtcactcatactaaaactccaggtcactgaaccaaaactaagttgtttatctgaccttccaagaaatcaggagggagaaaacaacaaatctccaaacaggccagttttaatcagcgtgataaggaagtcctctcttttttaaccctataaagaaagtaactttttgaaatgatcaatacactttgtattccttagttctgctttctttagcccctttctgcctataaagcccacttcctctgctcaacttactgaagcagtattccattttatagaatgagatgctgcccaattctggaatcactaataaaagccaattagatctttacatttgttgaaattttgtctttgacaacattactagttatattattctgggtatccttttccccatctgtaaaatggacatagcgatatccttcccatcagatttttctcattaatagaagtaatacattcaaaacactgagccaggctcacaccagtgagcaacttgttaatattactcagaagcatattatagatattgacagaaagcaatactgttcctaattaggggaagaaatcctaagagagtacctaagagtttgaatttagattataacatttgctctgagtattttacattacagcctttggggggaaaagtacaaatgagatctgagaacagtggtactcatcttt

SEQ ID NO: 1410 - DNA, 847 bp, Homo sapiens
gaattcggcacgaggagcagactgtcaatctaaagagccaaaaaaatcaaaataaaacattgtaggttcgttgggtgtgtagtgattacagccttgggaatgctccgtggggcctctggaatgtgtagagggcatctgcacttaattgtgtttttccctgtgctgcttctgtcccatccactttacaaaaaatgggtcttaacctggagtctatgaacccctgcaatgacatgcaaaatgtcatatgtttatacttttcttgggtgaagatccctaggtttggacaaattctcaaaagggtctctggccctgcccttagtctctwcmttccccaaaaagaacmcattaaatttattgctttaaacagaaaaattggaggcatctagaaaagtcctccctggaggtagcagagtcaaaggaggtgatgacttagtgttctgttctccggaagctcaggtttctggggttcctattaacagggtgttaatgagcagtgcttcctaagggggtggcaggaaatggtgtgctggtgccctcaagggagggagcctgtgagtgagcagcatttccttgccacttggatcgcatttagatgtttcctgtgttgtttacattcctgctgtcacctgtgattagaagcagttacccagcctgggtgacagagtaagactctgtctccaaaaaaataaataaataaaagaaaataaaagaaaaaatgtaaaggcaggaatgtgtacaggacctcacgggatgtggaggttacagtgagctgagatgcgccactgccctccagcctgggtgacagagcgagaatctgtctttaaaaaaaaaaaaaaaaaactccaag

SEQ ID NO: 1411 - DNA, 587 bp, Homo sapiens
ggctgcaggaattcggcacgagtaaggctatataaacgggaagttaagtattaatagaatccagtgtgactaacaagggatatcgagttcttcagacctgtggtatacataataagcttgaagaatttgtgcacaaaagtcttaactgttttgcagccttggttgtggttagatgctgtagttttctaagctactacatgttgtaaccagcttggtagatttaacctagtaataagatgcttagtttaactgttagtttaaagtcagtttctatagcggcacagtctttatttttggaccttcactttccaatccagatgacacttgtccataaagaaattgctaaacttgagacctaaaaacaaaacaaaaaacaaaaaaactacagacaagtaacctttaaaattatttcgcttgatggaaatttaccggaaggctttaaccaattcagtttgcttagactcataaagaaaattatgataatgtctaggtaaacttcagcaaaacatttttttgtgaaattatactatagtacataaaattgaaatattgctgatttaatgtaaaaaaaaaaaaaaaaaactcga

SEQ ID NO: 1412 - DNA, 486 bp, Homo sapiens
gcacgagaggaaatataaatgtgcatgttctctacatgtggcttaagtaattacttaataattaccacattcttgctcctcagtatctcttcccttgttccccctacacctagcaaattatttgactcatccagtcattggaaatactgagttcgaatcaaaatgctggagtgagaaggaatgttacacgtagtgcagcctctccatgtagacatgaaaaaactgaggtccagaatttgtgccttatccaaagtcacaggtttatgtggtgatactcttcctctcctagagcctttaattataattattactattattatcatcaacagtttagcttttctctgccatctgagaagatgaactaacgaatggctaaagttagaagtttagaatggaaataaggtctgactcttgaaatccttccagcatctttttctttagcaactctgttccacaggcagtgggagaaaaaaaaaaaaaaaaaaa

SEQ ID NO: 1413 - DNA, 1144 bp, Homo sapiens
tcgacccacgcgtccgcgcttgacttgcttccagacaaaggttgtctcaagtttgttgctcaaaccgagttctggagaacgccatcagctcgctgcttaaaattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcaatgtacctgatgatcaaggcattccttcctaaaatgcttgctcagaaatctggcaatattatcaacatgtcttctgtggcttccagcgtcaaaggagttgtgaacagatgtgtgtacagcacaaccaaggcagccgtgattggcctcacaaaatctgtggctgcagatttcatccagcagggcatcaggtgcaactgtgtgtgcccaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagcttgtgattttaggatctccatggtgggaaggaaggcaggcccttcctatccacagtgaacctggttacgaagaaaactcaccaatcatctccttcctgttaatcacatgttaatgaaaataagctctttttaatgatgtcactgtttgcaagagtctgattctttaagtatattaatctctttgtaatctcttctgaaatcattgtaaagaaataaaaatattgaactcatagcaggaaaaaaaaaaaaaaaaaaaaaaaaaaaaaaaaaaaaaaaaaaaaaaaaaactcgag

SEQ ID NO: 1414 - DNA, 780 bp, Homo sapiens
  misc_feature (2)..(2): n equals a,t,g, or c
  misc_feature (4)..(4): n equals a,t,g, or c
  misc_feature (12)..(12): n equals a,t,g, or c
  misc_feature (738)..(738): n equals a,t,g, or c
  misc_feature (776)..(776): n equals a,t,g, or c
cngncagtcacngtccccgattcccgggtcgacccacgcgtccgggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgccaaaaaaaaaaaaaaaaaaaccgcggccgaaagcttattnccctttaagtaaggggttaatttttagcttgggcactnggcc

SEQ ID NO: 1415 - DNA, 1703 bp, Homo sapiens
gaactagtcagtcctatgcttgaaacgagatgccccttcaatttttgagacttactatccaagttatggtttcagatctaacacttcttgtaatcagtgtgcaataaatgatgaaatgacattcctggaaatcactaagcgatttacttactctttttctagctcaggctcagcagactttttctgtaaagggccaggtagtaaatgtttgaggctttatgggccacagactatctctgttgcctcttcttatttgtgtctttttttcgaccacttcaaaaatgtaaaaatcattcttagctcacaagccataaaaaacagactacaggccagatttggcccatgggccatagtttgccaacccgttttaaacactgaggttcgagtctcccattaatggtggcattctctgggataacgcctaaaacattggagttttaattaagttgtattaagtcaccattatcgaaaagatgtattagaaattatgacccgtacagactgggttaaaatgtggcttgtgtgtcttctgcagcttgcacctgcctgcccgcccaggtgattttgcaggcacaatctgaggtgctagaacctggggctttctctgcctctgtctagtcctgctggattgtaagctccatgagggcaggagcttgcttgttgtttgctactatgttcccagcacacagaacactgctgggaaatatgttcggggctggttctcatttgtcttgatagcatccagatttttccaagtagttggctttccgtatgtccattttactctctgtccatatatatacacaacattacatagtactcatgcaccagttaccattcccagggattatgtaattcctcagtacagccctgtgtggtcttgtgtctccatcttacagatgagaggccatgatcaggcagctagtttgtagaaagctgccagggtttgcacccagccattatggctacactgctgggactcttagcacccctaaagggaagcacttgagtggctcgttgttatgtcaccatcaggcttccatctcccagcagatgtcagaggatctctggttttcacttctgtaacttttcaaagctctatcaccctttggagaatataagaacattctgagacagacatacagatttgtcaaaactgccgagtttgtccaaactcactgaactgtacccttaaaatgggtgtgttctattatatataagttgtatctcagtaaagttgatttttaaaattgttctcatcacaaagtcaaatggatttggaaagctttaattagagaagaaaaaaagaaaccttttttaatcagaagagtccagcctcttccaacaaaagttgtaattgctttgttttccaagctagctatttaaaaatcaggagttctggccaggcatggtggctcacgcctgtaatcccagcactttgggaggcccgaggcaggcagatcacgaggtcaggagattgagaccatcctggctaacacgacgaagccccgtctctactaaaaaatacaaaaaattagctgggcatggtggcgggcgcctgtagtcccagctactcaggaggctgaggcaggagaatggtgtgaacccgggaggcggagcttgcagtgagccaagatctcgccactgcactccagcctgggtgacagagcaagactccatctcaaaaaaaaaaaaaaaaaaaa

SEQ ID NO: 1416 - DNA, 588 bp, Homo sapiens
  misc_feature (565)..(566): n equals a,t,g, or c
ttccgaattaatcgactcactataggaawtgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccaaaaaaaaaaaaaaaaaaaaaaaaaaaaaaaaaaaaaaaaaaaaaaaaaaaaaaaaaaaaaaaaaaaaaaanncgggggggggcccccccccccc

SEQ ID NO: 1417 - DNA, 1146 bp, Homo sapiens
  misc_feature (1140)..(1140): n equals a,t,g, or c
cttaattattaataagccaatgtgttatgataccaatayctgttttaaaaaactaaaaccaaccatgcttctggcatgataaaatcatggaattaaatcaggggtttacattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctattttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttaaaaaaaaaaaaaaaaaaaaactcnaagggg

SEQ ID NO: 1418 - DNA, 1128 bp, Homo sapiens
tgtaaaagttatcagtaatcctaattcttttcctgggttttccttttgtcacttattaatcagtttttgaaaggacgaatgaatttagagatgtactctggagcagtatcatgttaaaccaggggtatattagaaaaatcatcctcataatcattctgggaagtttttcctccccaaaaaaagccatcctgatgggttttcaaaaccagaaaaaagctcttaatgaggaacagaccactggagtacccatgagcatctcaggaaaactgagaccctcgagaagccttgatttcgtgcaacccccaaggtttcagagccagcagcccagtgctgtggttgacagacgtggttttktggrgaaagcagccagaggccaggaattttcagagtcgtgagtcacgrtytcccacccaagattagagcamagattagccatactgagatttggtaaaatcattctgtctaagcaatggaggtgtgtgcamacgtgcagtgcctgttcacaggggatgcaggcagatcsygggtttaggatggggraggccaccgcacccccyttcaytgctctgcacctgctccctcacgtggacactgtccacaactgtggctctcacaggacagttgcccaaggagctcatatcttattggagatagggggtcgtacaggtgacattcatgagcagtgtgagccgggtgacatgggggtgtcaacccagcatctgtccaggagctcctcctgcagcggctctggcaggtggcctgaggctcctttttgagagagaactgtttggccttcctgtctcctctcctctgatctgttctttcttggaacaccacccaagaacgtcacctcctccatcagattgtgagctcctggagggcaggagctgtgtccttctattcatcttcctatccccagaaccttgcacagatcctggaatgtggtaggtgctcagtaaatgtgtgttgaataaatgaatgaatgaatgaacaaatgaatgaatttgcttacttcaaggcaaaagaaccatgaaactgtattttgagtttctatgttatagcagtcagcaaatcctattaaatactttgtgtttccaagcaaaaaaaaaaaaaaaaaaaaaaactcga

SEQ ID NO: 1419 - DNA, 644 bp, Homo sapiens
aattcggcacgagagattacatccctcctgtgttcacaccccaccatgactttacaatgatcttacagtgcaagagtctttacaagaccctacaatacatgatcttcctcgcagcattttacctctcccctatttcttaatacacttcttcttcactctgggccagctacactaaccttcttgttgtttcttgtatacttatcagacacattcttccctcaagctatttgtatttgctattccttcaaataaccttatagcttgttcttaacatccttcaaaccattgctcagatgtacacttccacatgactctttaccttaacactaacaaaaataaaccgtctgccctgtactctctctttttctgctttatttccaccccatatacttatggccttcaaatatgctataaatgtttttttatttatatttttgttatctgtctctactaaaaatacaaaaattagctgggtgtgctggctggcacctgtaatcccagctacttgggaggcttaggcagaagaatcacttgaacctgggaggcagaggttgcagtgagctgagatcgcgccactgtactccagcctgggcaacaggagtgagatccgtctcaacaaaaaaaaaaaaaaaaaaaaaactcga

SEQ ID NO: 1420 - DNA, 735 bp, Homo sapiens
  misc_feature (376)..(376): n equals a,t,g, or c
gaattcggcacgagtagcagcttgattttctgttagcctatgaaatgttattgtcctataaaaataactttaaactgatttaatatttcatatttacattatatgaaaatcaattacattataaaaggaatccctaatgcagaaacaaagatgcaactttcaaaattcttattattcctatttgtatatacacgagagaacccaaccagtgcctgtgtttggggggaaaagtcaacagtgtagttctaaaccttatcccaaacagaaaatgtggktaatgatgtcactttccttgctggkcatcattaggcttaaattaaatgctgaagctgtcatcaaagagtttacactaaaatcttcagggctttaaataaanggttaagtccagcttccaaacacaattttccacattagcagctccaatcttcttaaataaagctctgttttcctatatttttatgactgctgagaccccacagggaccaatatttgtattcaaattacatttcatggtttcccattgtttcacaatgagttctaataaatgggatttactataataatccaagtatgacatagccggtatgctttcatgaatgtttttatgtagattttcctcccatgaacatgagtaaataaatctgtttcctgaatggattgtggttgcatttaaagctctgtaataattctaataaatttactctatagaaaaaaaaaaaaaaaaaaaaaactcga

SEQ ID NO: 1421 - DNA, 678 bp, Homo sapiens
ggcacgaggcggaggtggagacgcagagctatatttggtagactgtgaacagactcacctgcctagagcagtgtattcacattgggattattagagtaaagtgtggacaagaggtataatgcagaggtcttaatgtgtcaggctggggaatgtacttagtattctgtctctcatgtgtctcaaaccagggtcctcattcacctgttggtacttggtgacaaggataaaaaagctcctccctactctgctagttttacttcaaataatgaagggaaacttataattaattgataagtcatgttaaatatctctgtagcaacttaaataggaaatatgatgctgaattttcttgaattcttaaaataagggatttccaaataatttgaagttattactgctcttttgagattgttttcaaactctgacaatcactgatcattctctctgcctttggaattcttgagagacaaagtgtggttatcacataagtattagggagtcattacaggttgatgcatagaggaagagagagccacgtttctaataacactcatacctgaaatcattccattaccattctttaatagtttcattctgacttcattgtagcaactcttactttattcttcttaagtttttaaggccaaatcatggtttcataaaaaaaaaaaaaaaaaa

SEQ ID NO: 1422 - DNA, 1447 bp, Homo sapiens
aattcggcacgagagatttaagtgcagcgtggattttttttttctcactttgccttgtgttttccaccctgaaagaatgttgtggctgctcttttttctggtgactgccattcatgctgaactctgtcaaccaggtgcagaaaatgcttttaaagtgagacttagtatcagaacagctctgggagataaagcatatgcctgggataccaatgaagaatacctcttcaaagcgatggtagctttctccatgagaaaagttcccaacagagaagcaacagaaatttcccatgtcctactttgcaatgtaacccagagggtatcattctggtttgtggttacagacccttcaaaaaatcacacccttcctgctgttgaggtgcaatcagccataagaatgaacaagaaccggatcaacaatgccttctttctaaatgmccaaactctggaatttttaaaaatcccttccacacttgcaccacccatggacccatctgtgcccatctggattattatatttggtgtgatattttgcatcatcatagttgcaattgcactactgattttatcagggatctggcaacgtagaagaaagaacaaagaaccatctgaagtggatgacgctgaagataagtgtgaaaacatgatcacaattgaaaatggcatcccctctgatcccctggacatgaagggagggcatattaatgatgccttcatgacagaggatgagaggctcacccctctctgaagggctgttgttctgcttcctcaagaaattaaacatttgtttctgtgtgactgctgagcatcctgaaataccaagagcagatcatatattttgtttcaccattcttcttttgtaataaattttgaatgtgcttgaaagtgaaaagcaatcaattatacccaccaacaccactgaaatcataagctattcacgactcaaaatattctaaaatatttttctgacagtatagtgtataaatgtggtcatgtggtatttgtagttattgatttaagcatttttagaaataagatcaggcatatgtatatattttcacacttcaaagacctaaggaaaaataaattttccagtggagaatacatataatatggtgtagaaatcattgaaaatggatcctttttgacgatcacttatatcactctgkatatgactaagtaaacaaaagtgagaagtaattattgtaaatggatggataaaaatggaattactcatatacagggtggaattttatcctgttatcacaccaacagttgattatatattttctgaatatcagcccctaataggacaattctatttgttgaccatttctacaatttgtaaaagtccaatctgtgctaacttaataaagtaataatcatctctttttgattgtgaaaaaaaaaaaaaaaaaaaaaaaaaaaaaaaaaaaaaaaaaaactcgag

SEQ ID NO: 1423 - DNA, 1654 bp, Homo sapiens
ggcacgagttttctgatcagactctttttattgttttgttttttataaacaagtctcaggtggaaaaagaaagaaagggaggagctagctctctgccttctcagccaattgaaatcgtggaaaccaatgggcttcagctagccccactcatcactgctgggggggaaaagacatccctactccccttccccgtggcactcatgatattctcaatgccccaacaagggtcatcttggttcctctcggcgtttctgtcctggcctttggctctggctccggctctgactccgactccggctccggccagggccccgggagcccctagagctgctggagcccctggaagagttgctgccggccgtggaacatgtgctggtgccctggccccgggacaggaagcttggtctgctgtatgggagccaggcctcttcatctgggtggagcacccgctgggctgccaggggcacggcctggaccgctttcctctccccactgcgctcccgctccagggaggacatgctgcctgctgccctcagctctagggcccagctcgcctcttcctctggcggtggcaagggtggtgggggcaagtccccaggactgttctccctcctgtagggaagagccttgggtttcttccggaatcgagcacggggtccttgaagtgggggagtcatctccccattcccctgccaggttctgcctggggcactgctggctgtgctaggggcaggactggggctgaggtggggtgaggctgcagggccagcacccaagccagcaggcctcgcttcacggatgcccagcatgggctgggatacactgagaggggaactcggcccaaggggcaccctcctgggcatctgatggagatggggcatgtcagttgggggctggggagggtcaggaggtgagggtgtaagagtggctgtggactgctgtccataggaaggtgtgggagagggggtttcccttcgggatggggtgaccaggcaccctccactggagctgggctccgtcaggtgacttctctcaggcattggcgggcaccactcctctggctctgagctgccctccagctcctcctccggcccttctaggcagctcagttcacaagaaggaggaggtgggggcagggcttctggccagttcagagagggcatctgcacaggtttccccagaagcttcactttgcctcccttggctccactgtccccctggctccactctggaggagcgtactggctccagggacccagatctcctgagggatgttgggggaagcccccatggaaggtctgcagctcctcccccgctgggtcaatggtgctatagacaggaccctcgccaggggcggccgtgcccctggccgtctgagctagatacagggagattcccgcttcgttgtaatatctgtcgtccgggtcaggattgctagggcagcagcttcccctgggttcctgggccgaggggcttcgagatgggtggggccacgaatctgccagccatgagtagggggctttccgtcctcgaacttgccccttctttatggagatggttgcaaagcctggcctcctcgtggcgtcttagaggcaaacgtcatccagatcccgccccgtcttggcccgcagccctccctagtcctggcagctcc

SEQ ID NO: 1424 - DNA, 1076 bp, Homo sapiens
  misc_feature (910)..(910): n equals a,t,g, or c
  misc_feature (912)..(912): n equals a,t,g, or c
  misc_feature (958)..(958): n equals a,t,g, or c
  misc_feature (1038)..(1038): n equals a,t,g, or c
aattcggcacaggaaaataatttacaatgaactggtgtttgtgcataatatctctcaccaccctcctctccatcccagtacacattgttggtgaggaaaaagacatgcttaagtgcacattctgtctcctaaacactcttaagaaatgtgttgtatggaagagattatatcataatggtggagcaaataacctgtaattttgttctagtgttaactgcctccattttaggggttgagtttctactccttttccatgatctcttctcttgctgtttaaaaaatgatttcacagagtaaaggtcagagtgcgttaaaatgcttttgtatgaagacctagcaaatacaagacctgcttggctgattgcttatggttggaagtgactcatctaagcacaggagtgtgaggtttatggcttagaacgtaagataccagcctctgtagtggccaaataagccggcctttttgtttgttattacagatgggttttgatgtcaaggtcaactgagttttgagttgtccataagatggacagaacatctgcatataacaccaactgaatgaacccccagtttgtctagggctttgataaaaaatttggccctctagaccgggcgtggtggctcacacctataatcccagcactttgggaggccgaggtgggaggattgcttaaggtcaggaatgcaagaccaacttggtcttgtagtcagtgtagtgagaccccatctctaccaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaanangcccgcaccgatcgcccttcccaacagttgcgcagcctgaatggcnaatggcaaattgtaagcgttaatattttgttaaaattcgcgttaaatttttgttaaatcagctcattttttaaccaatangccgaaatcggcaaaatcccttataaatcaaaagaata

SEQ ID NO: 1425 - DNA, 2348 bp, Homo sapiens
  misc_feature (1)..(1): n equals a,t,g, or c
  misc_feature (2266)..(2266): n equals a,t,g, or c
ntataggctyttgcaaaagctatttaggtgacactatagaaggtacgcctgcaggtaccggtccggaattcccgggtcgacccacgcgtccgcggagatccagtgaaagagtgttcatctcagaatgttactatgtcatgtagtgaaggcttcaaaaacctattttaccgaacttacatgctttttaagaatgcttctggtaagagacgatttttgctctgtttgttactttttacagtaatcacttatttttttgtggtaattggcattgccccaatttttatcctttatgaattggattcaccactctgctggaatgaagtttttataggttatggatcagctttgggtagtgcctcttttttgactagtttcctaggaatatggcttttttcttattgtatggaagatattcatatggccttcattgggatttttaccacgatgacaggaatggctatgaccgcgtttgccagtacaacactgatgatgtttttagccagggtgccgttccttttcactattgtgccattctctgttctacggtccatgttgtcaaaagtggttcgttcgactgaacaaggtaccctgtttgcttgtattgctttcttagaaacacttggaggagtcactgcagtttctacttttaatggaatttactcagccactgttgcttggtaccctggcttcactttcctgctgtctgctggtctgttactacttccagccatcagtctatgtgttgtcaagtgtaccagctggaatgagggaagctatgaacttcttatacaagaagaatccagtgaagatgcttcagacaggtgactgtgatttaaacaaacaaaaaaaatctatgaatgcacatatcatataccatgacttctgaagactataaatgaattccacaatcagtgcttcactgagaaccaattttacctatcttttcttctaaactgaacagtcagagagacagctcctggctttagcttcttgtggtaccacgcactttgagcactttgtgcgtatcatgcaatatacttgcaatacacagaacaaatttcaaatacgcctcacttttagacttagaagagaaacattaaaacttaagggtgtaaggagggatcaagaaacttgataaggtcaaaagcaataatctctctgacatattccaggctcttacactgagaccaaagagaaatctttacctcagtttcttcatcagcagaatgggtttctggcctctctcagggataattttgaaggcataatgaaaattatgatgaatcactcattggtaggaaaataatgatataagtttcaaatatgtatrattttacctatacttggtaatgctttgttttatagagcctgttaagctgctattgatagtcggagcttatatactgtgacttctgaagactatacatgaattccacaatcagtgctttgttgatacaaaatccttaaaagggaggcactttaaagaatatgtatttttcacttttcttaatatgtttcatcggtgacaggcatgataatatttctatatgtaatgggtaattgggaaaaaatagatgataaataaaattgctctaaagaagttaaaaaactgaatgaacagctaatactggtataaagtaactaatgtttggagccaacatttgttccttgtgtcagcaaaaggatattcacattccatgatccctggctgagaattctgcctctagtctttcttacccagctgttgtctatccttgttcaattataaatactgctaagggcatttttaaaatacgatcttgtagtccttaaatttgaatccgtcagcacggtcactcataggaaaatgatcaaacaagcaagccagtcatgatttgactccttcccatctcatttcttactgccttacgctcatcctgaggtccaccttggtctctaaaaacaccatgtgttctcatgcctccatgtcttttcacacactgttccatttgctcttcctcccacattacattgaaactttcaagcctcagtcgaaacattgcttcttctggatagcagccttcttgacatccctcctcactccccagtccctacagggcttccatagctctttgtgtgcacttcgatcccagcattttccatcgacttgtaattgtttctgctacctgacaatcatcgccttgagtactgggacaacctttgattactcattatatcctcaataaatatttgttgaactaaaaaaaaaaaaaaaaaaaaaaaaggncggccgctctagaggatccctcgaggggcccaagcttacgcgtgcatgcgacgtcatagctctctccctatagtgagtcgaa

SEQ ID NO: 1426 - DNA, 926 bp, Homo sapiens
  misc_feature (10)..(10): n equals a,t,g, or c
  misc_feature (15)..(15): n equals a,t,g, or c
  misc_feature (18)..(18): n equals a,t,g, or c
  misc_feature (80)..(80): n equals a,t,g, or c
  misc_feature (921)..(921): n equals a,t,g, or c
  misc_feature (925)..(926): n equals a,t,g, or c
gcgcgggcgntaaanttngtgcccatccctagagtcttcattatgaaaatatcaataaatatttcattagtttacatttnactctggtataaaatgaaacttttaaaaataagtgaaatggatgatttcccagtggaagtatgtcaacagtcttaagatcattgccagatttcataaaatatttaagtatttgaaaaagaaacaaaatgtcttcatactttagggaaacgaatacmctgtataccttctgtacaaatgtttgtgttttcattgttacactttggggttttacttttgcaatgtgacccatgttgggcatttttatataatcaacaactaaatcttttgccaaatgcatgcttgccttttattttctaatatatgataataacgagcaaaactggttagattttgcatgaaatggttctgaaaggtaagaggaaaacagactttggaggttgtttagttttgaatttctgacagagataaagtagtttaaaatctctcgtacactgataactcaagcttttcattttctcatacagttgtacagatttaactgggaccatcagttttaaactgttgtcaagctaactaataatcatctgctttaagacgcaagattctgaattaaactttatataggtatagatacatctgttgtttctttgtatttcaggaaaggtgatagtagttttatttgatactgataaatattgaattgattttttagttattttttatcattttttcaatggagtagtataggactgtgctttgtcctttttatgaatgaaaaaattagtataaagtaataaatgtcttatgttacccaagaaaaaaaaaaaaaaaaaaaamaaaaaaaaaaaaaaaaaaaaaaaaaaaaaaaaaaaaaaaaaaaaaaaaaaaaaaaaaaaaaanaaann

SEQ ID NO: 1427 - DNA, 1247 bp, Homo sapiens
  misc_feature (2)..(2): n equals a,t,g, or c
  misc_feature (9)..(9): n equals a,t,g, or c
  misc_feature (1131)..(1131): n equals a,t,g, or c
  misc_feature (1202)..(1202): n equals a,t,g, or c
  misc_feature (1209)..(1209): n equals a,t,g, or c
  misc_feature (1226)..(1226): n equals a,t,g, or c
cncccacanccacaaattggtttggttggttgtaagtcaggcttcccaccaaagtccaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtatycaaycgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccmaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaaaaaaaaaaggaaaatatatataatacttaaaaaaaaggtatctaggaagggctaccctcaggattggggacntctcttaaccctacctccgggaccccgggggagggatgttgcccctatgtgggggtctgtttattccattntttttcnttttagggttggtatcntttttggggggtttttttccc

SEQ ID NO: 1428 - DNA, 775 bp, Homo sapiens
ggcacgagcacttccctgccttagtaaacagagtatactggagagtatttaaccttttcttgatgagtcatggtcatgattataaacatcagccccttttataccttggtacggtgcagtgatatcattaagagctatcaatatgtgtagggcttggcttggccttttataggatgttatgctgttctcactgatggttttttactgctctctgctctgtcagtggagctatccggggcaattgtagcgtttgggtccttttacccctatgtcccccggctatacttttaaaacagctttagctgttctttatcttgtgcacatgatacaaaatatgttcccgtacaatatggggctgtcacttcttgccaacccagcaccctcttcctcttctaacctgctttctgaggcttctgctcttcacctcctgctcgctgatggaaacctccagggcaaagctgaaggtttcttggggaagccaggaaagccagtatttcctatgtgtcagatctgcttggcttccaagaagggatgcatgggctttttggccagtttccaggaggctctgggcttcctgcttcttccccgcttcccccagagttcacagatgttgaagtttctgaaggttgacgtcactggaagtctgaccacaaacaagttggctgttactgtatttgaaacccagtacctttggcagctcacctctaaccagtaaaaaaaaaaaaaaaaaaaaaaaaaaaaaaaaaaaaaaaaaaaaaaaaaaaaaaaaaaaaaa

SEQ ID NO: 1429 - DNA, 945 bp, Homo sapiens
  misc_feature (1)..(1): n equals a,t,g, or c
  misc_feature (13)..(13): n equals a,t,g, or c
  misc_feature (15)..(15): n equals a,t,g, or c
naatacgatcatnanagggcgattgggtacgggccccccctcgagttttttttttttttttttggcaagtgagaagatgcagataggcaaaaagraaaaaaaagagatcacacagagattcactgttaacctttggtgtataataaaatcagacactttcctttgcattatgtcacatagaaatgtacaaataaagtgtacatatatacacacatatatgtatacactgttttgcaactcgttattttcactttgcaatatacaatgagcatttttccatgcaaatgaatgagacctcttattaaatgaataagattgggtcaaaagatgagatgttgacaagagtcatatgtaaatctcagcaacatcgaatgactggagtaaaacgatagcaaatatttatcaagaaagtgcagacaaacagaaagcagtggcaacattaataacagaaaataattgaattgtcagagaaattaattaaatgggataaggacggtcccgagaatgcctatggttagaatgcagagccctaaatttctttctyagaccccttatctcttccaaacacctttccatctcatctccctcccttgtcatttcttcatctttaaaatgcctatagtctatgtcctctttaaattcttcgagagactgaagcagcctctgtctaaaattcccttctgtttgctggcgttcaaattctccatacgggcgtttttcctccctctttggcacgctgcactttggctttccttcgttttctttgcagggtttttgcatgatgttgttgttgtttcctgcttaactctgtgcggggtagtttcctgctccttttcttcccccagatgtctgtgaacacagatcctgggacctcttccttcccttggccacaagcacgcacggcacgcttgtctgcagggcagtaaggagctggtacctcgtgcc

SEQ ID NO: 1430 - DNA, 2890 bp, Homo sapiens
  misc_feature (45)..(45): n equals a,t,g, or c
ttatatgctacagctacagtaatttcttctccaagcacagagganctttcccaggatcagggggatcgcgcgtcacttgatgctgctgacagtggtcgtgggagctggacgtcatgctcaagtggctcccatgataatatacagacgatccagcaccagagaagctgggagactcttccattcgggcatactcactttgattattcaggggatcctgcaggtttatgggcatcaagcagccatatggaccaaattatgttttctgatcatagcacaaagtataacaggcaaaatcaaagtagagagagccttgaacaagcccagtcccgagcaagctgggcgtcttccacaggttactggggagaagactcagaaggtgacacaggcacaataaagcggaggggtggaaaggatgtttccattgaagccgaaagcagtagcctaacgtctgtgactacggaagaaaccaagcctgtccccatgcctgcccacatagctgtggcatcaagtactacaaaggggctcattgcacgaaaggagggcaggtatcgagagcccccgcccacccctcccggctacattggaattcccattactgactttccagaagggcactcccatccagccaggaaaccgccggactacaacgtggcccttcagagatcgcggatggtcgcacgatcctccgacacagctgggccttcatccgtacagcagccacatgggcatcccaccagcagcaggcctgtgaacaaacctcagtggcataaaycgaacgagtctgacccgcgcctcgccccytatcagtcccaagggttttccaccgaggaggatgaagatgaacaagtttctgctgtttgaggcacagacttttctggaagcagagcgagccacctgaaaggagagcacaagaagacgtcctgagcattggagccttggaactcacattctgaggacggtggaccagtttgcctccttccctgccttaaaagcagcatggggsttcttctccccttcttcctttcccctttgcatgtgaaatactgtgaagaaattgccctggcacttttcagactttgttgcttgaaatgcacagtgcagcaatcttcgagctcccactgttgctgcctgccacatcacacagtatcattccaaattccaagatcatcacaacaagatgattcactctggctgcacttctcaatgcctggaaggattttttttaatcttccttttagatttcaatccagtcctagcacttgatctcattgggataatgagaaaagctagccattgaactacttggggcctttaacccaccaaggaagacaaagaaaaacaatgaaatcctttgagtacagtgcttgtccacttgtttacaatgtcctccttttaaaaaaaaaaaaatgagtttaaagattttgttcagagagtaaatatatatccatttaatgattacagtattattttaaaccttaagtagggttgccagcctggtttctgaaaaaccaaatatgccggacagggtgtggccacaccaagaagacgggaagacctggcttgtgaccctggcttcccatgtccttctggtctcacccgcgaagtgccctatcctggaagtatgaaatgttagccaattaataccaagacacctcatctgctccttccccagtggatggggttcttctgtaaaactgtttgcacatggccaggggagggaactaggacccttgtgtcctgtctgagccttatggaggcaggacggtgtcattggcggatgtgtcctgctccattgagatggatggcaaaccccatttttaagttatatttctttgatttttgttaatttagaggtgtaggttttgttttttgtttttttgtttttttttaagagaaacatttataactggatagcattgcagtgaaagcagcttgggatgttggagctaatgccagctgtttatactgctctttcaagacagcctccctttattgaattggcattagggaataaacaagcctttaaacgtgataaaagatcaaaaacctggttagacatgccagcctttgcaaggcaggttagtcaccaaagactaacctccaagtggctttatggacgctgcatatagagaaggcctaagtgtagcaaccatctgctcacagctgctattaaccctataatgactgaaatgacccctccactctatttttgtgttgttttgcacagactccggaaaagtgaaggctgccaatctgagtagtactcaaatgtgaggaactgctggtcttggattttttttccattaaattcagctgatcatattgatcagtagataaacgtaaatagcttcaaattttaaaagtggaattgcagtgttttttcactgtatcaaacaatgtcagtgctttatttaataattctcttctgtatcatggcatttgtctacttgcttattacattgtcaattatgcatttgtaattttacatgtaatatgcattatttgccagttttattatataggctatggacctcatgtgcatatagaaagacagaaatctagctctaccacaagttgcacaaatgttatctaagcattaagtaattgtagaacataggactgctaatctcagttcgctctgtgatgtcaagtgcagaatgtacaattaactggtgatttcctcatacttttgatactacttgtacctgtatgtcttttagaaagacattggtggagtctgtatcccttttgtatttttaatacaataattgtacatattggttatatttttgttgaagatggtagaaatgtactatgtttatgcttctacatccagtttgtacaagctggaaaataaataaatataacataaaaaaaaaaaaaaaaaaaa

SEQ ID NO: 1431 - DNA, 1198 bp, Homo sapiens
  misc_feature (1189)..(1189): n equals a,t,g, or c
  misc_feature (1191)..(1191): n equals a,t,g, or c
tcgacccacgcgtccgatttaattcttattccccacagtttaggtatttttcattagtacatcaatttgacacactgaatgcaagactattaaggaagaacgattaaatattattttattttgtgaagagttggcagcagattacatctcaagaacttgcagagagaggaaggtagatggacaatcctaaattgtaagatgttacaaaaaacagtgaagtaagagtactcctgaagactaaaatagagaggctggggtttgagccattttactgagtagcttagctggaacctgatatcagaagtagcctttaacaaaaagcctcttggcaattgtatggtactaacaactagagtactgaagtgtaagttgaaaccaagttgcagtgggaaatcaaaggtgaggtagcttatttgaaaccagcaaatgagacaggttggacagttttaaaatctcttctaacaaagaaactgcacggtagcaaggactagcggttctcaaagcccttctttttcagtgttctcattcaccttggcacccaagtatgtttaacaggccatgcattaaaaataaatacaaaaatataaaagccgcttaaagggaacttacaaactgacaatctctcctctgtatttgtgttcatagtggctgggagtttaattatatgcacaaaagttaggagccacttgtttctgcacagactgtaggagcaagatgaggagatgggcaggttttggtaagagcccccagttctggtggacaggcatacttgtggcattgggtgcggcattgctgggaggaccacgtcttgggaggcgattgacttttggtttgtaatttccctttaaacaagaagagatggctcacattttccatatatatctcaatgaatgtactgtattactgttttaaaaatttgatgaaataataatgaattggtctccttttgttatctggtccttgtttaatttgtttaagggtttttgtatacaaaagtttacatttttatgtatatttttcttgtgtaaaaactgatgtaatatgtgtatgaaacactgtatgtattatctgtatatagtgtgacaaaatcatttttctttctttcttttggatgtattaataaatcttgctgtgaagtaaaaaaaaaaaaaaaaaaactcgagggggggcccggtacccaataaccctntnatgatct

SEQ ID NO: 1432 - DNA, 1792 bp, Homo sapiens
  misc_feature (1)..(1): n equals a,t,g, or c
  misc_feature (1078)..(1078): n equals a,t,g, or c
  misc_feature (1129)..(1129): n equals a,t,g, or c
nattawctcccgctcgaaattaaccctcactaaagggaacaaaagctggagctccaccgcggtggcggccgctctagaactagtggatcccccgggctgcaggaattcggcacgaggagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacagaaaaccatgttctgcttgtttgaaaatgattgtaaatgcaaagccttaagagtaatgatcagatctatgtcaaggtcagtgccttgagctataaatggcagaacttctagaagaaatggatcatgtggctagaaacctctcggcctgcaacaagtatttcgagcaggattactggagcagcttaagatgcctagatgaaaggtttaccatcactgctggttaggaaatggattatgagaactcgaacagagggaaggtgaaatgcaaccggaggaaacactctgatatgaggtttgaggccttcaaaattgctttgcagcataagccacagtgagtcaggagtaccagggagtggatagaatgtttatttgkttaactgagactttttagttcatcaattattttgaagggtagaacactctgtgggctctctttctatttccttctgggtacaatcacaaaaaaaaaatctctcctagctgaaattacatgcagtactagcaaaggggtctctttgytataaactgttcattaattgacgaacatttgtgtacttaactatgtataaggcatctcatcgttcaatttcaaatacaaattaaaatattttttcacatttgttatcctgttatgttttctcttttacaaattgtctgttcgatctttttgtctctctttaggccttattcttgtcaattcatatgtgctctaatgaattgaatattttctgtatattaaacattactancctttcctctgtcacactgattgaaaaatgatctatttagtttgttgtttngtctttaattttgtaagctttaaaaagttaatatgcccttcagacaccatcccaacatcacataagaattttttcatgttataaattctttgtggacatatttgataactgttttattatgaggaggaccataattaattcaaccattcccctattttggtcatttaggtttttgggtttgggttttttgtttgtttaacgtctttgcttgctattttaaagaatgctgcactaaatgtgaatgcttgagatttcttctctgtatttagaatattttcctagaatggattctcagaagaattctcagtctgtggagaggaacatttttaatgcatggaagagctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttaaaaaaaaaaaaaaaaaaaaaaactc

SEQ ID NO: 1433 - DNA, 3814 bp, Homo sapiens
ggcacgagctcagagatgcctcactcttccttgtaccctcctcccttcttcaaaatgaaattgattattagggtttggtttattatttcattgttctttgtgcaagggcgaacaaatccatgtatactcctgccctacacacacccacaggtagcgctccatctgctattctgtgccttgcttttttcagacgcgttaggaaaggccacatcagtcatgacatacacaggcttctttactcacagcactcattgtcgctttcatatttcttgctttagtctgagttttttaattctataagtaaaaacattttttaaatccagaattcaaaagtgatcataaaagttattcctccttttatcatatactctcagccgtttatgtggagtaggagtgtgagtgtgtagccttccagacccttctgtgttacagaacagaggaatttcttattgaaatttaactttgaattgttatactcgtaattttcttagttactatgctaatatctcattatttaccggttcctagacatcagacaaaaactgataaattctcaaatacagagtaacagacaaagttgtttcatagtgtctggtatcaagatgataaagcatacacccatcttcctcagcttcatttctaaaaatggaactgaggaaaccaagttatgaaatataatcaaattattaaatataaatttaagcatatattattaaatataaattaataaaatacatttattgattataaactacttaaatataatccattgagttctatctttgggtctgtcatcaccttatagaactttttagacttttgtctcgaaaactggaacagaaagatcaggttttattacatatgaacatttttaccataaagtgtaattcagaaaacttcctagtttcctccttttttcaagatactaggaaaatcaggctttagttttatgctttccgctctgtactcccaaacaagagctcttaaatatttatacttctgttacccccaaagtttactgctgtgatttggagaagtaccaagttcatgtatctgtttgctttatttatcctattttttttctttctaggtattttttgatttaatgagagaaattcgagcgagaaagatggatgacagcaaagaaaagaatggaaaaaagaagaggaaaagtttagccaagagaatcagagaaagatgctgcattttataatcaaagcccaaactcctttcttatcttgaccatactaataaatataatttataagcattgccattgaaggcttaattgactgaaattactttaacattttggaaattgttgtatatcactaaaagcatgaattggaactgcaatgaaagtcaaatttactttaaaaagaaattaatatggcttcaccaagaagcaaagttcaacttatttcataattgcctacatttatcatggtcctgaatgtagcgtgtaagcttgtgtttcttgggcagtctttcttgaaattgaagaggtgaaatgggggtggggagtgggaggaaaggtgacttcctctggtgtttattataaagcttaaattttatatcattttaaaatgtcttggtcttctactgccttgaaaaatgacaattgtgaacatgatagttaaactaccactttttttaaccattattatgcaaaatttagaagaaaagttattggcatggttgttgcatatagttaaactgagagtaattcatctgtgaatctgctttaattacctggtgagtaacttagaaaagtggtgtaaacttgtacatggaattttttgaatatgccttaatttagaaactgaaaaatatccggttatatcattctgggtgtgttcttactgacaccaggggtccgctgccccatgtgtcctggtgagaaaatatatgcctggcacagcttttgtatagaaaattcttgagaagtaactgtccgctagaagtctgtccaaatttaaaatgtgtgccatattctggttcttgaaaataagattccagagctctttgatcgcttttaataaactgcaagttcattttaaatgaagggccagcatatatacttgcaagataattttcagctgcaaggattcagcaccagttatgtttgaatgaaccctccttttctctgagattctggtccctggaaatccctttctgctagtggtgagcatgtaagtgttaagtttttaatctgggagcagggcataggaagaaaatgtcagtagtgctaatgcattttgcactagaacgcttcgggaaaatattcatgcttgccatctgttcatttctaaatttatattcataaagttacagtttgatacaggaattattaggagtaattcttttctgtttctgtttataatgaagaacactgtagctacattttcagaagttaacatcaagccatcaaacctgggtatagtgcagaaaacgtggcacacactgaccacacattaggctgtgtcaccattgtgtggtgtacctgctggaagaattctagcatgctacttggggacataatttcagtgggaaatatgccactgaccgatttttttttttttcctctttgcagtggggctaggacagttgattcaacaaagtatttttttcttttttctcagtcctaatttgaacaggtcaaagatgtgttcaggcattccaggtaacaggtgtgtatgtaaagttaaaaataggctttttaggaactcactctttagatatttacatccagcttctcatgttaaatatttgtccttaaagggtttgagatgtacatctttcatttcgtatttctcataggctatgccatgtgcggaattcaagttaccaatgtaacactggccagcgggcccagcaatctccatgtgtacttattacagtcttatttaaccaggggtcctaaccactaacattgtgactttgctttgagacctttcctctcctgggtactgaggtgctatgaagccaactgacaaagatgcatcacgtgtcttaggctgatgccactacccgatttgtttatttgcaatttgagccatttaaagaccaataaacttccttttttaaaatgtttgtggtgttacttgatgtttacaatgtaacatgtaacattcaaatgtatcaaatgaggcatctttaccaaacaactaaatcttttgagctctcagtttggagacttcttttgtgtaatgccagatttcctaaataacagtgtcagcattgctcagatttaatcaaggctcagaaatggaaggactcgtgtacaactacattcaagatattctatgccgtcatgaaatgacaaatgtgtacattacttttagaatgctccaaactctagaatgaataggtgacagctttatattcattttctaatcagaatgacccccagagacaatttccaaattgtgggaagaatgacaccctgtaccatttcaccaagcttcaggccaacgtttgatgtccggagggaagcgtggcctattaactatcgaatagcctgcaagttagaaacaatccagcccaatattgagcacaacctttcaaaatctggttcattttaatttcgtaactcataagcagtgctagaatgagcacatttaagtaataattggcataattttaaatctcattgtgtgtacagatccttaacaccaatatggaatatgatgttaaatactatgcgtcataatcccagcattttgagaggccaaggcaggaggtttgcttgagcccaagagttcgagaccagcctggacaacatagccccatttacaaaaaaaaaaaaaaaaaa

SEQ ID NO: 1434 - DNA, 1093 bp, Homo sapiens
cagattcggcacgaggttttttttaagatttattttttaaaaattatttttgtggacttgggtatcaatgatggcacctacttttgggaatctgtagctgtgctttgagaattgccatcggtcatgtgttgcaccgttctctgtatgtttacgtcctttggactggcttctcccaggattcttttctgtttttgtttttttgatttgggctttatttttttctgtgtactgtactatattgtaaaagggattttagcagagactttagtctttggggcaagaggagaacaggaatgctgggctgtttactttaggtggagaacccatcttcagacctttggactattttctttcaactgcagtgtatagaaaaaccaaactacgacctcagagcagagtattaatgaaaagcacaaaaaaaggaactaagttcagcgaggggtggggggaggggggagatttttcttttgaaaaataatgactcttaggacatttgtttttcagttcaagtgctcttcagcactgtcttgtctcccaatataccaacccactggcacatttttctcttgttttctctctccgattttgctctgtctcctcagttaagtgtttccttcctttgtgccccccgctggtgaccctctgcttccctctctctttccctttggcagctgcaatacacagtgttattttggggaaataaatctagcaaagcctcgccttccatgccgagcgtcctcttggctctgagagggaaaggtctgtccttgggatgctctctggtcttttttccccctaagtctttctctttcccatcatacccttccctgcccaccttgttttctgttctccttttattaggaattcccaagtgaattttattaatgtgggagtggaacagatgctaaaagctatccaggattttgtttctgtttgttttaaattttgtggttccttccctttcctccccctcccatgcgtaagacgttctgtgtaacctccattaaatttggtacaaaaccactcgccagagctgtggtgtcagaaaaataaaatatattgtttcttamaaaaaaaaaaaaaaaaaactcga

SEQ ID NO: 1435 - DNA, 1866 bp, Homo sapiens
  misc_feature (262)..(262): n equals a,t,g, or c
  misc_feature (674)..(674): n equals a,t,g, or c
acccacgcgtccggtcctcttcttcagcacatgccaaagctgttcctcacggcctgtgagacaagagcatcttggatgtaggacaatggaagagttagatgccttattggaggaactggaacgctccacccttcaggacagtgatgaatattccaacccagctcctcttcccctggatcagcattccagaaaggagactaaccttgatgagacttcggagatcctttctattcaggataacacaagtcccttgccggcgcantcgtgtatactaccaatatccaggagctcaatgtctacagtgaagcccaagagccaaaggaatcaccaccaccttctaaaacgtcagcagctgctcagttggatgagctcatggctcacctgactgagatgcaggccaaggttgcagtgagagcagatgctggcaagaagcacttaccagacaagcaggatcacaaggcctccctggactcaatgcttgggggtctsgagcaggaattgcaggaccttggcattgccacagtgcccaagggccattgtgcatcctgccagaaaccgattgctgggaaggtgatccatgctctagggcaatcatggcatcctgagcattttgtctgtactcattgcaaagaagagattggctccagtcccttctttgagcggagtggcttggnctactgccccaacgactaccaccaacttttttctccacgctgtgcttactgcgctgctcccatcctggataaagtgctgacagcaatgaaccagacctggcacccagagcacttcttctgctctcactgcggagaggtgtttggtgcagaaggctttcatgagaaggacaagaagccatattgccgaaaggatttcttagccatgttctcacccaagtgtggtggctgcaatcgcccagtgttggaaaactacctttcagccatggacactgtctggcacccagagtgctttgtttgtggggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaatgccaactgatccatagcctcttcagattccttataaaatttaaaccaagagaggagaggaaagggtaaattttctgttactgaccttctgcttaatagtcttatagaaaaaggaaaggtgatgagcaaataaaggaacttctagactttacatgactaggctgataatcttattttttaggcttctatacagttaattctataaattctctttctccctctcttctccaatcaagcacttggagttagatctaggtccttctatctcgtccctctacagatgtattttccacttgcataattcatgccaacactggttttcttaggtttctccattttcacctctagtgatggccctactcatatcttctctaatttggtcctgatacttgtttcttttcacgttttcccatttccctgtggctcactgtcttacaatcactgctgtggaatcatgataccacttttagctctttgcatcttccttcagtgtatttttgtttttcaagaggaagtagattttaactggacaactttgagtactgacatcattgataaataaactggcttgtggtttcaataaaaaaaaaaaaaaaaaaaaaaaaaaaaaaaaaaaaaaaa

SEQ ID NO: 1436 - DNA, 1257 bp, Homo sapiens
aggaaatgctttgggatgagtctattcttggattttgaatgtttagttttgtttacccaaggttgaattgaaaaaaaaaaacagtcaatatggatttagaaaaaggaacacctgatgaagaaaaggagaggtagatacagtcagtgtcacttcaggacacttaggttttttttgtataaaaatttaaattgaattaaaagaaggaaaaaaaaagcccaaacttaacctctgagaaagaacataagaactcaaggagaacataagagaaaaggaaacctgttacagaaaagacaagaatctgtgttttggaatgagtctattcttgggtattgaacttttagttttgtttgcccaaggattaattgaggaaatcagctaagaaaatggactttagacaaaagcaagaggatcagatgaagaaaaggagaggtagatacagtcagtgtcacttcaggaaagctatttaaaaaaacttgaaatttaactgaaagaagaaacaacaacaaaaaagcctaaacctagcctctgaacaacactaacatgagaacacaagaacttaagagaaaaagaaacctactcaagaaaagacagaagagacagtgatttgggatgagtctactctaggattttcaactttttagttttgttccttcaaagttgaaggaaaaaaagtttggttttataaaattcatgttattgtaatttttctaggtggatggctattttaatctctaaaaaagccaagtgaagtaaaagtattcagtatgccttttcctcaagttactttccttcattttcttaaaaaaraaaaaaaattattaaatgtttctcacatatctcacatataatgtaatttccctaaatgaagttgtctctacttctgctcatcaaattgctgtgatagtgaattatttattcatgggagataatttattttaaaggacagaattaccaagcgttacaaaatcagttctttccttggttttgtgttagtgttggtggtattttattgttgtttttctgtgtttatgtgtctcagctttctccaaggaatatgtatgaaataacttaaactgattttttctttgttaaatctaatttgcagtgtatttttgcattttctagttctgaaagtggaaaatgaaacagtctataataaacttagatgatatatagttttaaaacggtctcaaaaagtactgatataaggtcagtctatattctggaaatgtttatattaaagtgttttaatttcta

SEQ ID NO: 1437 - DNA, 973 bp, Homo sapiens
ggcacgagttagaataaggtggattgggaatttagtcacagttttataataataagtcatgtgtctaatttaatgtattggggaatttttttttccatattaaattttctagcattcttcagtctggttctgatcagtgtattattgtggacaggaatggtagtgtttaggagcttggaccctggagcggaactggttggatttgaatcccatctctatcactgctgtgtgacctcaggcaacttacctaactttcctggccctcagttttcctacatagaaaatgggaataataaaagtatctgcttcataggattattacgagaattcgctaactcaatatatgcaaatctgttggaccagtgcttagcacataacagtcaataaaggttgagtgtcagcttttattaacagtaataaaattggctttctctccagtcagctaaattaattaggattttactttattcttccagttttataggaacaataccaaacctacctgagtttttgcgaataacttagtgacagcaataatcaaaataaccagtaaaatctaacagcaatagcagaacctacaagaaattattttcttcttggggctgttgaccagtgtcataaagactgttgaccagtctttatgaagtcacattggatttatcttgtgggtaattttttcatttgggaacttaattttgattaactgaaaacattattattaaatatcttttttataattgtatgcagcataaaaagcacaagtcccttttccgtgccaaatttttatttcagcctgatgatgatagagattaaaccctgtcaaatccttttgatatcttaggttttgctgataattgatattctacaaatgagtgggtaaatgacagattgtatttgaagcatatcagacaaaaagtagttattgaatctctacttgatacccagcattgtaccaaaaaaaaaaaaaaaaaaa

SEQ ID NO: 1438 - DNA, 1287 bp, Homo sapiens
  misc_feature (1282)..(1282): n equals a,t,g, or c
gaattcggcacgagatttactaaaatgatgtaataaataacatgttaatagactcaagctttaccttatgaaattgatgtatttttaccagttatttctaatgtaacattgaatatataagatctgacaaatgtatgtttaaacatgaattagaagagttgagaactaccattatgtatagggattctcatagtgtcttggcccttaattggaaagttgtggcaactttaaagtactttttactgtatgttataattctttataacttagagagagacaatggtcactcaaactatgagaactatgaattaggagataaaagtttaaatttgttgttgttttataacagtatgtacaagttagttttcccttatatatttacgttttcaagttttttaatctcatcatatacatccatactctataaaatgttttatattcaaagaactgtaaaatcctaaacattagttttcactattgaaattgttttttaaagataggcataaatagttgtccttagacttattcatacaaatatagtcatttacttctatgtagtttgagattctgagagttattccaactttatgaagattgatttcaatgtgcctgctaagtcctaaaagattcagaaagaaaatttatatattattgatttaaatatcatcctttaaatatgttgtataacattcaatatagtttatgtatcagtgattgtattttattctgaatgcatgatctcaagccttaactactataatctttttctgcccctcagaaattgaataacctaaccaagatgcctttaggggatgccctaagtaaatgtaatttcagatttcagggttttttttttttcctctctaagtgttccttccctttcttctcctgctctccatcatgttatggagaccagtgaggaaccagtgttaacttggtgacaatgtgacagctggtgctttatctaagctccgttttctatttcttgggaatgctttattgtggaaactgcttcagatacttaaattgaatcataacttgcttctgtaaattgcgtaaagacaacaaactgattttagtttgaaaagtttatcttttacttgtaaaccttgtttgccagttaccttccgaaagctgtgtaaagagttatttttaacaaagtcttaacaatatatgttactttttagatactatagaaaataataaatataacctgtaaaccacaaaaaaaaaaaaaaaaaaactcgagggggggcccggtacccaatcgcsgwgtgatggngctat

SEQ ID NO: 1439 - DNA, 541 bp, Homo sapiens
  misc_feature (2)..(2): n equals a,t,g, or c
gntccaatttcattttaaaagatgtagaaagaagaatcaagcatcaattaattataaagcctaaagcaaagttagatttgggggttattcagccaaaattaccgttttagaccagaatgaatagactacactgataaaatgtactggataatgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtgctttggacatttgaattaatgtaaatatatgtaatctgtgacttgatattttgttttatttggctatttaaaaacataaatctaaaaaaaaaaaaaaaaaaactcga

SEQ ID NO: 1440 - DNA, 1872 bp, Homo sapiens
gcctccggggccccgtcaatctgcagcacctcatcctcagcggcaaccagctgggccgcatcgcgccgggagccttcgacgacttcctagagagcctggaggacctggacctgtcctacaacaacctccggcaggtgccctgggccggcatcggcgccatgcctgccctgcacaccctcaacctggaccataaccttattgacgcactgcccccaggcgccttcgcccagctcggtcagctctcccgcctggacctcacctccaaccgcctggccacgctggctccggacccgcttttctctcgtgggcgtgatgcagaggcctctcccgcccccctggtgctgagctttagcgggaaccccctgcactgcaactgtgagctgctgtggctgcggcggctggcgcggccggacgacctggaaacgtgcgcctccccgcccggcctggccggccgctacttctgggcagtgcccgagggcgagttctcctgtgagccgcccctcattgcccgccacacgcagcgcctctgggtgctggaaggccagcgggccacgctgcggtgccgggccctgggtgaccccgcgcctaccatgcactgggtcggtcctgacgaccggttggttggcaactcctcccgagcccgggctttccccaacgggaccttagagattggggcgaccggcgctggggacgctgggggctacacctgcatcgccaccaaccctgctggtgaggccacagcccgagtagaactgcgggtgctggccttgccccatggtgggaacagcagtgccgaggggggccgccccgggccctcggacatcgccgcctccgctcgcactgctgccgagggtgaggggacgctggagtctgagccagccgtgcaggtgacggaggtgaccgccacctcagggctggtgagctggggtcccgggcggccagccgacccagtgtggatgttccaaatccagtacaacagcagcgaagatgagaccctcatctaccggattgtcccagcctccagccaccacttcctgctgaagcacctcgtccccggcgctgactatgacctctgcctgctggccttgtcaccggccgctgggccctctgacctcacggccaccaggctgctgggctgtgcccatttctccacgctgccggcctcgcccctgtgccacgccctgcaggcccacgtgctgggcgggaccctgaccgtggccgtggggggtgtgctggtggctgccttactggtcttcactgtggccttgctggttcggggccggggggccggaaatggccgcctccccctcaagctcagccacgtccagtcccagaccaatggaggccccagccccacacccaaggcccacccgccgcggagccccccgccccggccgcagcgcagctgctctctggacctgggagatgccgggtgctacggttatgccaggcgcctgggaggagcttgggcccgacggagccactctgtgcatggggggctgctcggggcagggtgccggggggtaggaggcagcgccgagcggctggaagagagtgtggtgtgatggacgggcagcttcctgtgtgctccaagggatgagcctcgtggggcagagggcccggggccgccgcctggcctgggagtccctccctggtttttattctcagtacctcaggctcccctgtgtacttggaggggcagggagccctttcctcggttctggcctccagaccagggtaagggcaggcccctccaacaggtgctcacagccaccgaggcaggggctgcagccacccactgggagtcttgtttttatttataataaaattgttggggacacctcaaaaaaaaaaaaaaaaaaaaaaaaaaaa

SEQ ID NO: 1441 - DNA, 706 bp, Homo sapiens
ggcacgagttcagagtctcaggtgctgcttggcaggaaaatgcagggcaggaggggctgggcctcagctcgaggctcccaggtgcagccccccactccactgcagggcccaggggggccaagaacagccacaacaacaacaaaagccaaactgggaacggaatcgtggaaaaaaccctcataggcttttgggaacttacaaagaaatgcccacatccattctactaacatggcatctactaacgtggcatctactaggatgccacaaaacagacaaatccttccacgtaaggctggacacgtgtcagggcggtgtctcaaagctgggccacaggcagcatccacggccaggccactgggtggaggagacggtgctggggaggagccggagggaggggccggggctgttcccttaggcagaacggctcacctgtggtgtgcgcacagcaggattgtggggacacaagatgcccccttcattcatcagttacttgtattctttgtatgaaacacctgccgataaaatgtgaaaaaggggcatttcctaaagtactttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctggggggggggcccggaccccaattcgccctatagggggcggaataacat

SEQ ID NO: 1442 - DNA, 2915 bp, Homo sapiens
  misc_feature (1)..(1): n equals a,t,g, or c
ntcaaatgtacgtaagcaaagaagagagcaccaggatataaaactgccacagcagcttggaagacagatgattcagattttggggactttcttttgcgtgttacatagatttgtttgtcatcatgcagttaagcaggtgttgagggaaagctgagagaatgaaggctctaaatccccagtggaagcatgatatggcgaagcagagctggtgctgaattgttctctctgatggctctatgggagtggatagcactgagtcttcattgctgggttttagcggttgctgctgtttcggatcagcatgccacaagccccttcgactggctcctctctgataagggacccttccatcgctcacaggaatacacagattttgtggacagaagccggcagggatttagcacaagatacaagatatacagggagtttggccgctggaaagtaaataaccttgcagttgagagaagaaatttccttggctctcctctgcctcttgcccctgaattcttccgcaacataagacttttgggacgtcgacctacccttcagcaaatcacagaaaaccttatcaagaaatatgggacacatttcttgctatctgctactctgggaggagaggagtcactcacaatttttgtggacaagcggaagttgagcaaacgagctgaaggaagtgattccaccaccaatagctcttcggtcactctggagacgctacatcagctagccgcttcttatttcattgacagggacagcacccttcggagacttcaccacattcaaattgcatccactgccataaaggtaacagaaacacggactggtcctcttggctgcagtaactatgacaacctagattctgtcagttctgttctggttcagagtcctgagaataagattcagttgcaagggcttcaagtacttctcccagactatcttcaggaacgttttgtacaagcagctttgagctacattgcttgcaattcagagggagagtttatctgcaaggaaaatgactgctggtgtcactgtggtcccaaatttccagaatgcaactgcccctccatggacattcaagccatggaagagaatcttcttcgaataactgaaacctggaaagcttacaacagtgactttgaggaatcagtcttctatacttgcgggaaaatgagatgtatctgtagtttaagtgacctttgaggcattcaatccaggatgaattcaagttatttatgaaaaggctacctatgaattatttcctcaacacatctactataatgcatttgtggacaatggattctaattttcagcgccgttatgaacaactggagaacagcatgaaacaacttttcctaaaggcgcagaaaattgtacacaagctttttagccttagcaagaggtgtcataaacaacccctcatcagcctgccaagacaaagaacctcaacctactggcttactcgcatccagtcttttctctactgcaatgagaacggcctcctaggcagcttttcagaagagacgcactcgtgcacgtgtccgaatgaccaggtggtctgcaccgcgttcctgccctgcacagtgggagacgcctctgcctgcctgacatgcgcaccagacaaccgcacccgctgcggcacctgcaacaccggctacatgctcagccaggggctctgcaagcctgaagtcgccgagtccaccgatcactatattggctttgaaactgacctgcaagatctcgagatgaaatatctgctgcagaaaacggacagacgaatagaagtccatgccatttttatcagcaatgacatgcgcctcaatagctggtttgatccctcctggcgtaagcggatgctcctcaccttgaagagcaataagtacaagtcaagtctggtccatatgattttgggtctctctttacagatttgcttaactaaaaacagcaccttggagccagtgttggctgtttatgtcaatcccttcggaggcagccactctgagagctggtttatgcctgtgaatgaaaacagctttccagactgggagcggactaagttggacctacccctgcagtgttataactggacattaactctggggaacaaatggaagacattttttgagacagtacacatctacctgagaagtcgcatcaagtccaatggtcccaatggtaatgagagcatttactatgaacctctggagtttattgacccttcccggaacctgggctatatgaaaatcaataacattcaagtgtttggctacagcatgcactttgaccctgaagcaattcgggacctgattttgcagctggactacccctatactcagggatcccaggattcagcacttttgcaactactagagatcagagaccgtgtaaataaactctccccacctggtcagcgtcgtctagatcttttctcttgcttgcttcgtcatagactcaagctgtctactagtgaggtggtgaggatccaatctgctctgcaggcgtttaatgccaaattgccaaacacaatggattatgacacgaccaaattatgtagttaaccataaatgtcaagcacaacccaaaatcttgaaggagtttttacagtgcttttgtggaacagtttatgtttggaagagtaaatttaaattgtcttttcaatatctgtcttatatcagtcaataacattggatggcaatttacacacatgaacttgctgacaatgaatatattatacagcagttttggtttatgaatgacataaatactgacaccagtctagaagacattctactttttacaataaatttcatttgtaattttatatgttccgtggcaatgcttttgtgcattacatcctctagagggaacataaaaagataccaataaaattttgtagctgaacagttattaaaaagaaa

SEQ ID NO: 1443 - DNA, 638 bp, Homo sapiens
  misc_feature (597)..(597): n equals a,t,g, or c
  misc_feature (628)..(628): n equals a,t,g, or c
  misc_feature (630)..(630): n equals a,t,g, or c
cggcacgagtttatttccaaggtaagtaggggtagactagaatggacatagcagctcctgtcttatttgctttaaggctgcaatttctgttcattctcttacccatgcactttgaaatttcattgctctgcaaagtttccactgaaacatcaggtcgagaagacaaaatgtagagaatagcaaaccaaaaatatactcttcagagagcccagtgatggaaattatattctacgtaaggccattaaccagctacaaagcagtagcagctaactaacctggggataaaagaccatctgctggctgcatactgattccaagcataatgggtctcccattcccacctccacctggctccacaattccctgcatgtcttttaacctcctcttcttcagactcaatgcttccttatgcaactccagaaacccagtatcttatttaaacacacctgccatttgaagtagacaggtcaaggagaggtaggtccttcttctggtataacctcaggttcatcatgggaatatagataagctgtttcactttcttggcctatttactctcctgtaaaaagagggagttgcaggagattcttcaaagcnaaactgaatattttgatggattgaaaaaaananaaaaaaaa

SEQ ID NO: 1444 - DNA, 845 bp, Homo sapiens
ctcgagttttttttttttttttttgatacattgccctttttctcctctctatccaatattcagttgcttttttttttttggaaacatagtcttgctcttgtcacccaggctggagtgtaatggrcgcgatctcggctcactgcaacctctaccttccaggttcaagtgattctcctgcctcagcctctggagtagctgtgattacaggcgtatgccaccacgcccaagtaatttttgtgtttttagtagagacagcgtttcaccatgttgtccaggctggtctcaaactcctgacctcaggccatccacccaccttgggctcccacagtgctgggattacaggtgtgagccactgtacctggcctcctttcaactttatattcacctatttttatcttttttaaaagcaccacttgcctttgttttaattctctgtcaagcaattaattgagattttcatcctgctggcaaccactctagttctgcagcatcctcatgagaagcaaggtccacttctcatttgtcttcctttcaactgtttctatttccacactttcactagcaatattaatttcaaccaatttctaagacaagaagtatgccactgaatgtataactgatcttaacaacagattaacaaattgttgattccctgccattttcaaaatatcaaatatacaagacagtaatttttttaaaatattttttcatctctgagggaaaggatgatttgaagactcctttcaaattcccaagaaagcctctcaatattatctgtgtaaactactgattcacaggaataaatatttgttatttaatataaactaaaatgaaaaaaaaactcc

SEQ ID NO: 1445 - DNA, 898 bp, Homo sapiens
  misc_feature (402)..(402): n equals a,t,g, or c
  misc_feature (452)..(452): n equals a,t,g, or c
gaattcggcacgagattatgtagtagatgtcactagaattcttgaaatttgtcttcaagtcatggcagtatttcagtatcgctcctttgggattgcctgagtgatactcaagagttagactagttttatctgggttctttgaagaaccggggacacctcactggcttatgttgaatttctgcactgcagggaccaactataaatggtgtttttggttttttacgtgttaagagctttaaaatgtaattcttcctatcattcatgcacaaatgttctcacacaaattgcttcacagattgataaaactttgaataatttttccctgaagaaatgttgaacttttctgcaagctgttggaatkggagcgcgtgttgaaaggcytgaakgggaccgtactgtacngcctawttcttttaaaaaaaattawgatttcyatttttwatycatttacngatgactgaatakgtycaggccagaaaatatccccttatttcaaaatgcagcaatctataaacaaaatacttgccatttttctaaatgacacctttttctataatttgtatagaaaattaagtgcaagggccaggcaccgtgtaacgcctgtaatcccagcactttgggaggccaaggcgggtggatcgcctgaggtcagtagttcaagaccaccctggccaacatggcgaaactccatctctactaaaaatacaaaacaattagccaggtgtggtggcagacgcctgtaatcccagctacttgggaggctgaggcatgagaatcacttgaacccaggaggcagaggtggcagtgagctcagatggcgccattgcactccagcctgggtaacaagagtgaaaactgaagctgtctcaaaaaaaaaaaaaaaaaaaaaaaactcgga

SEQ ID NO: 1446 - DNA, 754 bp, Homo sapiens
  misc_feature (311)..(311): n equals a,t,g, or c
cagcctcatctcctgttggccccttgtatgtaccctgtgtttgagttgtaatgaacccctgcttgtccataatctttcttttaactcctgtgcttctctctcatcctttgcagagccttcactttctgcttaaagtggaccttgacttctctttatcttgctccatttgcacctgaaacttgtcctcaactgcagtgctaattccttggtaatgttttataactttgtcaggcagctagacactgtaagtatagaacatgctgggaaatccaaattaaaaatgacagttggcacaaagctgacttctgggnagggaccaaggaaaagtagccagagtggcaggatagctgcttccatcacggattgccagcaatgtaaagcgtagactccagaggaacagtgctaacttaaattaactatgcaggcatcagtacttctggttctgatggcccggggatttctaagtagtagtgagtctcagcattatttgttatacagtctactgctagatgaacaaggctaagtctacagagaaggtaaattatagaaattaggccccgtctctgctaagaatacaaaaaattagccgggcgcggtggtggggtcctgtggtcccagctactcgggaggtgacgcaggagaatggcgtgaacccgggaggcggagcttgcggtgggccgagatagcgccactgcagtctggcctgggcgaaagagcgagactccgtcttaaaaaaaaaaaaaaaaaactcgta

SEQ ID NO: 1447 - DNA, 699 bp, Homo sapiens
  misc_feature (483)..(483): n equals a,t,g, or c
gaattcggcacgagcggcacgagccaccttctcagtccagtctatgggtatgacagtttatctgctgaaaacccatccttgcttctttgttgcctaccagatgcaggtcgcactcataatcctccttcccggactcaggaacagcaagactgttactatgccattgtcccctgccctccttcccaccctccttttttttccctctcccactcccttctttcacccctttctttctgttttatgctgcttcaagtattaattttaaaattgttctacaagaatgcgatttatcagaaggatgtgaaccaagcagaatttcttagtatttctttgccttagggcattccccttgtgtggkttaaaatttgtcccccattcctttttgcctgtggaacttatccttattcttcaagagactcctamtcctaatagcactttgaatttaacctccctggtagttcttctcagccaaatttcaccttnctgaaaacaggattctctgttctccatgtctggctaatttttgtattttttgtggagacaaagtctcactatgttgcccaggcaggtctcaaacacctggccttaagccatcctcccaccttggcctcccaagtgctgggattataagcatgtgccactggacccagccagagaccctgtctctttaaaaaaaaaaaaaaaaaaaaaaaactcgta

SEQ ID NO: 1448 - DNA, 1517 bp, Homo sapiens
  misc_feature (159)..(159): n equals a,t,g, or c
  misc_feature (1123)..(1123): n equals a,t,g, or c
  misc_feature (1510)..(1510): n equals a,t,g, or c
agtggcttaaaggcatcgttttagggattactgggaagtatcttcaaagtaatacatgagaaacattccttcctaaatcctttattatattgaatatcgtattaattggttttcagaggttaaattaaccatgtattcctgcaataaatgtcacttgtntcttgtatataatcttttttatatattaccggattgattcattagtattttgttgaggatttttgtgtctatattcataagagatgctggtctgcagttttctttttttgtgataatctggtttttgtatcagtaatacaggccccatgaaacgagttgggaagtgttcacctctcttgtattttttcaagagtttgtgaagaattgctattaattctttaaatgtttggtagaatctaccattgaaatcatgtgtcctgggcttttttttgagggaagtgttctgataactaattcagtatctactttttatagctctgttcagattttgcttcttcctgagttagttttggtaatttgtgtatctctaggartttgtccatttcatttatctcatttgttggcataaattaaactaaatttggcctgagcctacctgtatatcttgagtccctctgtaaggaactgtagcctaacttgtacataaacaaactgaaatcctaaattaggaatgtagtttttgtaacagctcctgagtctcaggcagtcacagcagycaagtctgtcaattgcaggctgctaactaagcagcccatgstcaaatgaggcaaaaacctttgcttttaacacatagtatagctttgtaatccttttcttgcacactcgggtaatttcttcctttttcattccckgwattttccakgaatatgartctyccttttttcccctcctgtcagtctagctaatggtttgtcaattttgttgatcttttgaaraacaaacctttggttccactttcttgttgcatatgctgartattctcataattggagtggaaagctgatctttgattacttattttacttagggctgaggagttcatggacttcgcaaaacctccttgaatctaaattgcatcttctttcctggtttctgggctgaaacatgttttttcccatctwanawacccttggtcttttcatkggcgattaagactagagaaagttctagatmccttgtccttttatgctgtcattttgtttaaaggctttctatgtagtaaaactatctatatagacaaaatagagccttgagttgtggtcttgaatttgatcaacatgatttaccacattctgtactggatatttcttcacctgctgctactgtaaaccattttattcttggatcttctgtagagtatattatcacaggtactttttacaggggtgtctaatcttttggcttccctgggcacattgaaagaagaagaattgtcttgggccacacatcaaatacgctaacactaataatagttgatgagctaaaaaaaaaaaaaaaaaggcaaaaaagncccaaaa

SEQ ID NO: 1449 - DNA, 712 bp, Homo sapiens
gaattcggcacgagagcyccctctccatgggataccctgtggggcacttcagagtccccaccagcaagaaggctctctctcaccagatgtgccccccgccaaccttggatgtctcagtctccagaactcagatgagccagctcccttgtgaagctgtaagaacatggtacttacaggagtaaggctcatgaagtggagagatgagaagactttcgggacagattgtgtggaggctgtcattctcctcgtgacattgctgtgggagaagaaggaggcattccatgttggcttcagtgaagaacttcagtattttccagagagaagtactgagaagcttaaagtatttgaatgggaggaggagaagcaaactacagctacttcagaggataacactaaacacctagtccactctgtatacactagaggtgctgttaattttcttgtggagaaggaactgtctttagaaaaatatctcaaaaagccactgaagtagaaagtttcagcatgctgaagatggaacttgagaagatagaaagttctgggtccttagtggcatgactgagtcgctggaccactgttggaaccaccctatgtcttagtttttaaatctctttactgtctaagacatttttagtggaagtatttatctctggcatccaataagacctttaaggatttgcagttttaaaaaaaaaaaaaaaaaaaaactcga

SEQ ID NO: 1450 - DNA, 1043 bp, Homo sapiens
ggcacgagttgggccgggcacccccagaagctgaccttgagacaaggatttgggtgcaagtggtttatttggcaggtgcccagaaagtgctgacaggagtgggaaagtgagttaggggagagaaggaagccactacaggctatgttcatgtgcaggttactgctgtgggcaactggggcttacggatttctaggagatgacgtggaatacacctcagtgttgccccaccagaagggcaaggaagcatgggtatttatatgtcagctcccattcattattggctgagggcagctcctagagggcattgggtctgcgtttcaagcctgctgcacataggctgagaggaatccctgagttcgagtcacaggcgcccacagtcatgctcagacagcacatacaggaacagtgactgcagggggcataggtgggacacaaataccaccagttataaagaggaaagatgggaaggaaagacaagaggaaggtgtggagttagattcctgggtcagatgtgaacccctggctctcaaaacactccttctttttttctttttctttttttttgagacaggatctcactctgttgcacaggctagagttcagtggtgtaatcagggctcgtggcagcctctacctcctaggctcacatgatcctcccacctcagcctcctgagtagctgggactagaggcacacatcaccacacttggctagtatttaaatttttctgtagaagtccaggcgcagtggctcatgcctgtaatcccagcactttgggaggccgaggcaggtggatcacctgaggtcaggagttcaagaccagcctggccaacatggtgaaaccccgcctctactaaaaatacaaaaaaattagcctggtgtcgtggcaggctcctgtaatcctggctccttgggaggctgaggtaggagaatcacttgtacccagaatgtggagcttgcagtgagctgagatcatgccattacactccagcctgggcaagaagagtgaaactccatcgcaaaacaaaaaaaaaaaaaaaaaaa

SEQ ID NO: 1451 - DNA, 1173 bp, Homo sapiens
  misc_feature (548)..(548): n equals a,t,g, or c
  misc_feature (603)..(603): n equals a,t,g, or c
gctgtctcagaaaaaagaaaaaagtttctaaagtaaaaattgaaagtacttcccctacaaccacaggttgctttgacagattaatgtaaattcttccagatactcttctgtggatgtagaaacatgcagaatgaggcaagctttaatttgcttatgtcacttactgtggatagcctttcatatcttataagttaatgtcagagcagcaatctcatttttttccaatttgtaaacattttatttaaccttatgatggatattttggtggatttcagtattacaaaaatgcctattaatagtatattttcattatatttctgttacgaaattataatgctacaaacattactatgcctgtggcagtatacatctgcacaagttttgaaaatgttatgcattcataggcaaaaatgggataacttttgggcagtggtcatgattaatctgttgatcagaatccagagattgcccttctccttgccaattgctttaagagtacmctagtttttggccgggtgcartggctcatgcctgtatcccagcatttnggaggccaagacgggcggatcacaaggtcaggagatcgggaccatcctggctaanttggtgaggccccattctactaaaaattccaaaaaaacccacmaaaaccaaaaaaacccrgccttgktggtgggattacaggcatgtgcmacaacacccggctaattttttttgtatttttagtagaggtggggtgtcaccatgttggccaggctgatctcaaactcctggccttaagtgatctgcccacctcggactcccaaagtgcggaattacaggcgtgagccaccgcgcccggccactggtttttaaactttattttgaaattatttcaggctgggcgcagtggttcacgcctgtgatcccaacactttgggaggccgaggcgggcggatcacgaggtcaggagatcaagaccatcctggctaaccccgtctctactaaaaatataaaaaatcagccgggcacggtggcaggtgcctgtagtcccagctactcagtgggctgaggcaggagaatggtatgaacccgggaggcggagcttgcagtgagctgagatcacgccactgcactccagcctgggagacagagtgagactctgtctcaaaaaaaaaaaaaaaaaaactcgag

SEQ ID NO: 1452 - DNA, 1290 bp, Homo sapiens
  misc_feature (1)..(1): n equals a,t,g, or c
nacaatacatgcatcatatcttttgactttgaaggatatctcatgtcaaaggaatcaagttatgatttatagaggattcagctggaataccttgtgggtgctggctgagggtggcaaaacgcctaccgagacatgaaggttttagccactagttttgtccttgggagcctggggttggccttctacctgcctttggtggtgactacacctaaaacactggccatccctgagaagctgcaagaagctgtggggaaagttatcatcaatgccacaacctgtactgtcacctgtggccttggctataaggaggagaccgtctgtgaggtgggccctgatggagtgagaaggaaatgtcagactcagcgcttagaatgtctgaccaactggatctgtgggatgctccatttcaccattctcattggcaaggaatttgagcttagctgtctgagttcagacatcttggagtttggacaggaagctttccggttcacctggagacttgctcgaggtgtcatctccactgacgatgaggtcttcaaaccctttcaagccaactcccactttgtgaagtttaaatatgctcaggagtatgactctgggacatatcgctgtgatgtgcagctggtaaaaaacttgagacttgtcaagaggctctattttgggttgagggtccttcctcctaacttggtgaatctgaatttccatcagtcacttactgaggatcagaagttaatagatgagggattggaagttaatctggacagctactccaagcctcaccacccaaagtggaaaaagaaggtggcgtcagccttgggaataggaattgccattggagtggttggtggcgtgttggtgaggattgtcctctgtgcgctaagggggggcctgcagcagtgacagcttcaagaacttaacagccttgctcctgaagaactggctgcccaggaagccaagctagctttttaggggagtgttccagctgctggtagtggatcagcttagagggaacactcccacagccaaaagaatgagtgggagaaatggaggggacaatctcctgggagctatgcgcagtaacctaacttccttatgtcccatggatctcttcctgatcttccctgcccattgggtacccaggaaactgcaagcattgcctgtgttcctgggaagagttctaagaagcttgcattcattttctaccctttatgacttggatgcctccccacctccatttcccctcttctgagctgtgtattcatgtaaagggatgtattcagcctttttagt

SEQ ID NO: 1453 - DNA, 1794 bp, Homo sapiens
ggcacgagaagcatttagtaggattttaaagaaacttgagaactgttacataaggtgatgaattgggcatagcatgtaaaattatatttaagcaaggaaatgatctctggtgttttaatattcaacttgattgcttcctcttgggttctgtgtttcccactgtgtgacctgagctgtcagaaaaccttaagaattttctttgcatcatttttccatgcagtttgtgtacatgtctcatgtacctcgtggcagccactggttttgttcatcaaatggtgggttgtgggatgctctcctgcagtctccctctaattaaagaggttaaattgccgtttgctcagcctttagttcctttccacagcttcctaggctcttaaaaattagcactatattcctttcagattaaaaaaaaaacaaaaacaaaaacctgtttgctgtctttactgctgtggtcttgtctagagcaaatctgaacaaactgattgaaaggggtgtttggtggctggtgttctctttgactaaagaggcttacatgtactgtggtacagtctgcttacttaaaaggtgaggcttgaattaaaatacagccagatagaagccagactctaatcaaatgaggtgattagatcaatgaatgaagagaggagaggagtcaggtgttgcctttccctggctgttgaatagctgatgttccagattgccctacagtgttgtgttagggcatccaggagggatacttttcaggcttaggtacacctcagtctttaaaatgaggaattaggacacattcatgtgtgtgtccctaatctgctcctgagaagagaagtgcaatcagggtcttattttgtgaccactgacttgcacactgagacaaaagggccatctgcaagctgaaaatagtggattccttaaataaaaactattcacatttgatggtgtggtagttttaataaaatgttcaagtgtcaagttcattttcatttataatctgagacagttttataagtcacctccctgggggtaaaaatgcatgttctgtcctcatagtgagacacatcttctgcttagagtctagaaagctctaagaaagatttatgccatctgtgcagctggcatttttatagtaaaattttttttactttgctccaagtttaagttatctcatgacaaactttcttgaaagaggcattcactattattataggaagtatacttctttattgaaaaggagataatgtatcaggtaacttattaaagtattttctcaaagtttagtatctttaggaatacagtgcctcaatacaatataaaatattttgtaaataatagaatgaattcattttagaatttaaatgatgctaataaaatagaccattattctaaaagtttaactaatttagaatcaaccctggttgaaaataaagccttaagctgtttttttggaagactttaaatcctttatggctaagagatgacagacagggccgagtgcggtggctcatgcctgtaatcccagcactttgggaggccgaggcgggcggatcacgaggtcaggaaatcaagaccatcctggctaacacggtgaaaccctgtctctactaaaaaatacaaaaaaaattagccgggcgtggtggcgggcgcctgtagtcccagctactcaggaggctgaagcaggagcatggtgtgaacccaggaggcagagcttgcagtgagctgagatcacaccactgcactccagcctgggcaacagagcgagagagtgagactctgtctcaaaaaaaaaaaaaaaaaaaa

SEQ ID NO: 1454 - DNA, 1045 bp, Homo sapiens
  misc_feature (626)..(626): n equals a,t,g, or c
  misc_feature (906)..(906): n equals a,t,g, or c
  misc_feature (987)..(987): n equals a,t,g, or c
  misc_feature (1041)..(1041): n equals a,t,g, or c
tcgagtttttttttttttttttttaagcaacagtttattgagacggaaaaaatatgatccagcaaaggcgaggaggcgagccgggccccgagccagctggtgtcattgtcactggctcccaaacctgactcctgtggacgtgtctgtaccccaaacacagctgcccaccccagccctggcacagagcccttctgaaagaaagaaaaaagaagaaagacgcggcacctgacgccagcgggtaaaagcagggccccagaggcatttattgaaaacacagcatccaaaacacgacatctaggccaggcgcgatggttacagtgatgagagggtcactagacaattatccacaattctacgacatgagacagagactcagcaacagtcacagacagaagggtcatgtgttccttcctgggcagggctgaatgtggcaggtgcggcgtggaggctgcgtcctggcggtttgctcccaggcaaggggtacggggggccggcttggctgggtggggacctcaagtctgagggtgaggatggctgaatctacctcgcttatgtctcagggacggtcacccatacctaggatgaccccagccagaccctagaaggtctgatggccatcccaagtncccccgcgaggagaagagttccctggcaggggtgacacattcccggtcaacaagccacaacacagtggtgcctgcactctctcagctgttgccacaacacttggtgctggaattttctccacgtagtgaaacttttaagggacacatgaataatttaaaaagtcacacaaaactctacgaaaggcaggaatcctcactctgctgagagctacctcctgagatgtcgcttccggaccccggcagagggcaggagcgacatcagctcggcaggaggatcctngccagcgcgagggctggctctggttattataaataatctaatttaaatacgcacatacacacagatgtcctgcttctaccnaacgccaagaaaagcagacattagcatcacactgtcaacacttcctcgagaacngaag

SEQ ID NO: 1455 - DNA, 581 bp, Homo sapiens
ggcacgagattatgggggcagtttccccaatgctgttcttgtgatagtagggaattctcatgagagctgatggttttaagtgtggcacttcttcacgctctctctcacctgatgccatgtaagacgtgccttgcttccacttcaccttctgccatgattgtaagtttcctgaggcctccccagccagccatgtggaactgtgagtcaattaaaccttttttgtttatacattacccagtctcaggtagtatctttatagcagtgtgagaatggactaatgcagtctctttgttagattgcctatgtttcttgactgtctaataagatatgactttcagtgatacaaatgatcagagaaccttgcaaagctgatgtggtggagagagttcagggagaaccagagtggaacaaaccggaggaatgaatatggtagagtgcaagtgaatttgctcctgatttccagaagcagttgtcagcaacagagtttacccttgtatagcattaaaatagtctaggacaaaccagaaagtccataatgtcctccagcattaagagagcacctcgtgccgaattcggcacga

SEQ ID NO: 1456 - DNA, 3145 bp, Homo sapiens
ggcacgagcctggatatatttacagtggtgtttgttctttacagtcagagtgtccaagaactgtggaaggtctttgtattactacttttgacaaaaatttatgatgactgaccacctttctttcctgttaactgacatttcaacttgacaaatgtgatctttaccacattgactcatttgagtggctgagtacattctacatgtatagtattatgctgttttctttaagccattttgaggagcacaataaactggaaaaatgatttaccaaatatatggaattatatgtagtctgtttccttaatcctgatgctgtgttgttggcatgtgatccttcagaagtgaatatcatctttcatggggtggcaaaaatgccactattttgagaaagtctttttgattcctgggtacctgtaatgacctaaagctcttttatgccttttggaaccttgtatcttgtattgtttatttttgttttctccattaagtcatctggctccaaacagcagttttaacctcattcgtctctgtattttgctttatcccctctacactgcattgctgtagtgggcactcagagtgtgaatgttggtagtggatttttactttttgttggcaaattgcgctgatctgattccagctatggaaaacattaaaaaaaaaattcaacattgtctttacactcacaggaaatcctaggtaactattgtcattaatttttagatgacaaaaaggaacttggagcagccagaagaagtcagtattacatgaaatatgggaatccaaattatggaggcatgaaaggaattcttagcaattcatggaagcgaagatatcattcccgtcgtattcagcgggacgtgatcaagaagagagccctgattggggatgacgttggcttgacgtcgtataaacatcgacattctgggctagtgaatgttcccgaggaacccattgaagaggaggaagaggaggaggaggaggaagaggaagaggaagaagaagaccaggacatggatgcagatgacagagtggtggtagagtaccacgaggagctcccggctctcaagcagccccgggagcggagcgcgtctagacgatccagtgccagcagctcagactcagatgaaatggactatgatctagaactgaaaatgatttccacgccttcaccaaagaaaagcatgaaaatgactatgtatgctgacgaagtggaatctcagttgaaaaatattaggaactccatgagggcagatagtgtatcttcaagcaatatcaaaaaccgaattggtaacaaattaccacctgagaaatttgcagatgtccgacatctattagatgagaaacgtcagcactcccgtccacggccaccagtcagcagtactaaatcagatatacgccagcggttaggaaaaagaccacattctccggaaaaggcttttagtagtaaccccgtcgttcggagagagccctcttctgatgtgcatagtaggctaggtgttcccaggcaggatagtaaaggcctctacgccgatactcgggagaagaaatcaggtaatttatggactcgcctaggatctgcacccaagaccaaagaaaagaatacgaagaaagtggatcacagggcgcctggcgctgaggaagacgactctgagctgcaaagggcatggggggctctgattaaggagaaagagcagtctcgccaaaagaagagccggttagataacttaccatctctccagattgaagttagtcgggaaagcagctctggttcagaggcagagtcctgatgcccctggggcctatggcagctgccctaaagcctgacattcttgcacagggtggggcgcgcagtaggaacctcccccgcaggagctggcgccctctcgctcctgctcacacagtcaccctccgctcttgctacttcggcaagacatcttaagaatgtgacacattttcaagggcatctctatctttcgctgcagagttgtagttctgggccctcgattcctttcccaccaccccacaggctttaccctttgagaaaaaggcagccctccagattttgtagacatttttcttaatatttttaacattgtgtcttttaaaagaaatgttttacacagttcatccaaagagcagagaactgaacttctcactattgccttggccctgacagctgttaccagcacccttttcccaagaaaagtcaattcccaggtgcttattggacatccttcgagggggaagaggagggaagcggccagctcacccttccgggaccctagtgtggggcgaatctcacggacctgacctcagaggtgcaccagtgccgcccaggtagataagagctgcagcattgactgtgcttccgttcttccctcggggattgctcatggcatgggcctcttacgtgctgtcagcttgatgtgaagatcaagttcagtgctgtgggatttttaggaacaaaaaactgtgacgtctggatttggggttgatttttgtgctggggtgggattatgggtcaatgttgaagaatttttaagtctgtattatgtttaaaacatgaatgatttgaaagtttaaatttttaatttttatatgtggaaattcttcctgttggctaaaggggaagctcaagtggtgtcgtcttttgtgctgttaaatatatattctattctttggaagaaggcagagagaggagtcttattatttttaaatgctcctagttgtatagtctgtctgttgtacatagagttcagcttgttttttggctccagtaggaaaaaaaatccatccatctgagatggggtcctgttgtttattatcactctagaagttatacattgatatttattctttctgtccccacgttgtggcacctgaagacatcttcaaaattggcagaaaagataatagttataaaaattttagttcatttatttttaaactcctttcagattattttaccattaggaggaggtagattgtttcgtcttcctgtctgatttttgttttgtagtatttaattttgtattcctctgcagttttaagaaacagtgtttttcttcggtttgctggaacatgggcgttagagatggtaataaaccgtggtcctttttgcgaaaaaaaaaaaaaaaaaaaa

SEQ ID NO: 1457 - DNA, 1282 bp, Homo sapiens
ggcacgagctgggtccggtcaaccgtcaaaatgtccaaagaacctctcattctctggctgatgattgagttttggtggctttacctgacaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccagctgcacttccaacaacagtcgtgaccacacccgatctcacaaccggaacaccactccagatgacaaccattgccgtcttcacaacagcaaacacgtgcctttcactaaccccaagcacccttccggaggaagccacaggtcttctgactcccgagccttctaaggaagggcccatcctcactgcagaatcagaaactgtcctccccagtgattcctggagtagtgctgagtctacttctgctgacactgtcctgctgacatccaaagagtccaaagtttgggatctcccatcaacatcccacgtgtcaatgtggaaaacgagtgattctgtgtcttctcctcagcctggagcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaacaacgcagtagcatgttagattgaggatgggggcatgacactccagtgtcaaaataagtcttagtagatttccttgtttcataaaaaagactcacttaaaaaaaaaaaaaaaaaa

SEQ ID NO: 1458 - DNA, 1447 bp, Homo sapiens
  misc_feature (1420)..(1420): n equals a,t,g, or c
  misc_feature (1432)..(1432): n equals a,t,g, or c
  misc_feature (1436)..(1436): n equals a,t,g, or c
caagcgcgcaagggcgcgggcgagcaggcctgtgaattcgcaggatcatttcagacccgcacttcggcagccaactcgaaagcaggcggttgtgtgcggcagcagttggcgtttgctttgcacttcggaacctgttgcgttttgacccacggaggtggaggagtaactttttgacatgttggcctttccagttttgttggaagtttcatggtcggttttgtttygtttctcattcttctctccksgcccctcagccccccaacccccaaccccctcccggtccgtgttgcatgcacgctgttcaaatgtgaggtctgaaatggctggcacacgggaaaagctgcttgtgtcattcgtttctgggagtgggatggctctgagcagcctcgcctccctgtttgtactatttgaactttgcagatctctgttctctcaagcagaactcccaaccagatccattcttgaccagtgaccggctcggaatctggccttttgtgtgagatgatcacggtttcttttgtttatcacgccatttgcaaatcagagcaagagctctttctcaagggcaagaaacgcaaacaagaaatatttgtgagatgaaagttgtcaattggattttcttcctaaacaaacaacaacaacaaactactagaagtctccctgagtccactcgcttggatttctgacacagtttacaaaaaaggaaaaaggcactgctcctattttcccttatggctgagttcaccttaagattgtaaatgtgtatatgtcagtgaaaacattgaggcttggaaaatgtgttattttcgttgccctaagtttgagtcgactttagactcaaaaacattttgagcgaatatcaaagttaacttttaaaaattgcgaaactatttcagaatcgcaattttatcgaagattaaatcagacttttttgtctggtaattatatatttattatttagcaaaactgaagaaaaaaagcacagaattgtttcaacagatgtctctcattttcagctagcatttctctcccaagttgagctggtttaatgtgttttggatttccctcctcaattggcttattttttagatcacctgcaattcatttgcaaattgcaataaaacacattttagaaaaaaggaaccttcaattattagctttgtttctttttaaatgtatataaaaagactaatgtttgtgaatgaagttggctaacatgtatttagtttcattttggctttatgtaatataaagtttttaaaattttaaatatggttttaacctttatgtgtaaatgattttctagtgtgaccttctaatttaatattagacgtctaaggtatatctgtaaattagaatccgactatcactctgttcattttttttgaacaaagagtttaaataaagcctgaaccagggnacagataaaganaatnaaaaaaaaaaa

SEQ ID NO: 1459 - DNA, 1197 bp, Homo sapiens
gggttctcgcagccgtacctttctgtcgtcttctcgcccacgcgtccgcccacgcgtcgcgagaagacgacagaagggtacggctgcgagaagacgacagaagggtacggctgcgagaagacgacagaagggtacggctgcgagaagacgacagaagggtacggctgcgagaagacgacagaagggtacggctctttctccgctccgcccctcctcctcgtccctccctcaaggcmcggargcgaaacctctccacctcttccgagcggggtmacggcccggcygcggtaacctggtttccgagagtgccgggcggtcggcgggtcagggcagcccggggcctgacgccatgtcccggaacctgcgcaccgcgctcattttcggcggcttcatctccctgatcggcgccgccttctatcccatctacttccggcccctaatgagattggaggagtacaagaaggaacaagctataaatcgggctggaattgttcaagaggatgtgcagccaccagggttaaaagtgtggtctgatccatttggcaggaaatgagagggctgtcatcagctctgattaagaaaggagatttcttcatgctttcgattctgcatggggtacagccagtcacctcaccagagaatgacggctggagaagaaaactctgtaataccataaataagagtgcttgtaataaaagactgtgcacaaggattaatatttcccttcttaagtatcaaaagaactctggaacaaattataccattaggaaggttttcatgattcagttgattttccaaaaatgaagctatctcacccagctgggtttggaggagcaatctgcttattattctgtcgttaccacttactcaagcgagctgtgatatgaatacaagcaaccagtgggctcgggaaggtccgggtctcttctgccatcttccagataagagatttcagtaaaaaactgccatgctgagctgccttatagagctcttcgaaaatgttcgagttgataaagctctttgaggacaaggtacttcgtgcacctcatgctgaagattgcaccatgttggaaaataaatatgaagcaagtcaaactagatgcatacacttgtgtagaaatcaataatcaattaatagaagtgaaaaaatagacattaaaatgatttatttctaaaaaaaaaaaaaaaaaaactcga

SEQ ID NO: 1460 - DNA, 1527 bp, Homo sapiens
aatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgccttttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaa

SEQ ID NO: 1461 - DNA, 2412 bp, Homo sapiens
  misc_feature (329)..(329): n equals a,t,g, or c
  misc_feature (340)..(340): n equals a,t,g, or c
  misc_feature (977)..(977): n equals a,t,g, or c
  misc_feature (1117)..(1117): n equals a,t,g, or c
cacgagttttaaatcaattttttttcaagcaatcagattcttttctcctagaggagctgtgggcaagaaaactaatgaattctacatccttctcatcacctggtttaaattgttttctgctctgagtaaacagtaattactgtttaagtacatctcagcagaattttatcccaattgcaacagttcatgttcctcctaatgtaatctctgcggaggaaatgatcgtcaagggaagcaggctgacctgctcacgggatggcgttcttacaatctgcatcttatgtaatggtgattctgtgtgcctgtgtcataattattggaatattatnttatgcttttntttttgagactctatctccaaaaaaaagaagagacatagaaatttgaagaaggatcctttaatggtctacaccgtcttccaaagtcaagaagtggcagctgatatccatttgaaagtagaatcctagcttttcagagctagacmaggcctcagaaactatagttgaattcctcattgtaccaatgagaaactcaggcctagatgggtaaaaagaggtgtgttgtagcagtgctgggacagatctcggtttttctgcttcctatacaatcctcttcaacccaatactacaatgtatttattatcacatattaagctggagatttgtagccatgttattagagttgcaactgtttatcctatagattccagccacattttaaacacataacttcatgtagttaggccactaaaaataaagtaatccatcaaactagtaatacactagagaatttgacctacatactaagatgcctgaaatccacagtatatggcaatttaacccccatctaatagtggctcaatcaagtagctaaacatatttatttcactcagatggttggttgtttggtagaaggaatggactccttgggctattttgggaacaaaaaaggactaggacacaaatcaaagccacatncacagtaagaaatccgggctgatctctgccaagaaaagktacaaagaataattacttgatcacgtggggaaatttcgacataaaagaagtaatggataaaargaaagaaaaatgaccaattgctgragmcaataattatngcaaccctaaaccagaaagcactaagccaggaagtcaaaaactaagtcatmcacatatgacaaggtgcgggggttggtcctgagacttcagtgagaatatgtccgatcaggatatgcaaagaaccatttggaagatttctagttcataagggaagtaccaaatgaagtggatgggaccatacgcaatttgcataggacccccaaggaggaaatagtatgacatggtagtaaaaaagcaatcacgactacactcacaattttaggagaaaataaaactaaatccagaatttgaagccaacaacaacaaaaaaagtcattatttagggtatacgttcctgtgggcagtaccttgcaaagtagaacatcttcaagaagaaatatttgacttgaggtaaggctttcaagattgccatattacattcataaaggcaaactcatccttgagaccaaagtgacagaagattagaaattaaggctttgttttaaagaaatgttgacatcatactggaaattattatccagctacttacacattcgtttttaaatccatccctatgtttagctgccaaaatgcaaactgcgcattgywctctcacggagagcgccacaggtcaccagctattattctcccaggagtcattgagtaggctgccccaagtaccacataggaaactcaacgaactattttcatttcaaggaccattagaaacagaaaggaaaagagaaggtcagggaaacttagtttctaacaaaggaagtgaggcactttgaaaaagaaaatatttagagaacggagaggaagctaaacccaaacaaccaaaacgcacagctgacaattattccgggaagttggtaacttctgcctggtctctagaagcacaggaagaaaggactgttagcgtgaagaacactccagggttctgggtatctaggcagagtcagtcaacagggctaaccatgtgataatcctgggtaattccacctcacagttcactaaaaaacaagcggaaccctgggcaaagccctttggggctttaatagcaatggaggacatcaccctgtcactttctctgcttctacacagcaggcaatcaaggaaaacttgccaagaaatatgagtgaataaatgattttgaaagtttcattgagcaggaacatgaaaaggatgatttggggatagctggaaggatagttacttgcatgaataatatttattcaccgtcagtgtgatatttctcaatagaaagattgtatttaaaatgtacaactacaaaaaaaaaaaaaaaaaactcgag

SEQ ID NO: 1462 - DNA, 1305 bp, Homo sapiens
cagcttgtgcagactccgagccttcagtgacaaaggctttgctgtttgtcctcttgacctgtgtctgacttgctcctggatgggcacccacactcagaggctacatatggccctagagcaccaccttcctctagggacactggggctacctacagacaacttcatctaagtcctaactattacaatgatggactcagcacctccaaagcagttaatttttcactagaaccagtgagatctggaggaatgtgagaagcatatgctaaatgtacattttaattttagactacttgaaaaggcccctaataaggctagaggtctaagtcccccacccctttccccactcccctctagtggtgaactttagaggaaaaggaagtaattgcacaaggagtttgattcttaccttttctcagttacagaggacattaactggatcattgcttccccagggcaggagagcgcagagctagggaaagtgaaaggtaatgaagatggagcagaatgagcagatgcagatcaccagcaaagtgcactgatgtgtgagctcttaagaccactcagcatgacgactgagtagacttgtttacatctgatcaaagcactgggcttgtccaggctcataataaatgctccattgaatctactattcttgttttccactgctgtggaaacctccttgctactatagcgtcttatgtatggtttaaaggaaatttatcaggtgagagagatgagcaacgttgtcttttctctcaaagctgtaatgtgggttttgttttactgtttatttgtttgttgttgtatccttttctccttgttatttgcccttcagaatgcacttgggaaaggctggttccttagcctcctggtttgtgtcttttttttttttttttaaacacagaatcactctggcaattgtctgcagctgccactggtgcaaggccttaccagccctagcctctagcacttctctaagtgccaaaaacagtgtcattgtgtgtgttcctttcttgatacttagtcatgggaggatattacaaaaaagaaatttaaattgtgttcatagtctttcagagtagctcactttagtcctgtaactttattgggtgatattttgtgttcagtgtaattgtcttctctttgctgattatgttaccatggtactcctaaagcatatgcctcacctggttaaaaaagaacaaacatgtttttgtgaaagctactgaagtgccttgggaaatgagaaagttttaataagtaaaatgattttttaaatatcaaaaaaaaaaaaaaaaaactcga

SEQ ID NO: 1463 - DNA, 1066 bp, Homo sapiens
caccacccgccgcacgaccaccaggcgtccaacaaccacagtccgaaccactacgcggacaaccaccaccaccacccccaaacccaccactcccatccccacctgtccccctgggaccttggaacggcacgacgatgatggcaacctgataatgagctccaatgggatcccagagtgctacgctgaagaagatgagttctcaggcttggagactgacactgcagtacctacggaagaggcctacgttatatatgatgaagattatgaatttgagacgtcaaggccaccaaccaccactgagccttcgaccactgctaccacaccgagggtgatcccagaggaaggcgccatcagttcctttcctgaagaagaatttgatctggctggaaggaaacgatttgttgctccttacgtgacgtacctaaataaagacccatcagccccgtgctctctgactgatgcactggatcacttccaagtggacagcctggatgaaatcatccccaatgacctgaagaagagtgatctgcctccccagcatgctccccgcaacatcaccgtggtggccgtggaaggttgccactcatttgtcattgtggactgggacaaagccaccccaggagatgtggtcacaggttacttggtttacagtgcatcctatgaagacttcatcaggaacaagtggtccactcaagcttcatcagtaactcacttgcccattgagaacctaaagcccaacacgaggtattattttaaagtgcaagcacaaaatcctcatggctacggacctatcagcccttcggtctcatttgtcaccgaatcagataatcctctgcttgttgtgaggcccccaggcggtgagcctatctggatcccattcgctttcaaacatgatcccagctacacggactgccatggacggcaatatgtgaagcgcacgttggtatcgaaagttcgtgggagttggtctttgtaattcactgaggtataaaatctacctcagtgacaacctgaaagatcattctacagcattggagacagctgggggaagaagtgaagaccattg

SEQ ID NO: 1464 - DNA, 1668 bp, Homo sapiens
  misc_feature (1664)..(1664): n equals a,t,g, or c
ggcacgaggtctgccaagctatagaccatggctgtgaacacatttgtgtgaacagtgacgactcatacacgtgcgagtgcttggagggattccggctcgctgaggatgggaaacgctgccgaagaaggatgtctgcaaatcaacccaccatggctgcgaacacatttgtgttaataatgggaattcctacatctgcaaatgctcakagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtaytggactttaccttgatatatgtatatggatgtatgcataaaatcataggacatatgtacttgtggaacaagttggattttttatacaatattaaaattcaccacttcagagraaaaaaaaaaaaaaaaaaaaaaaaaaaaaaaaaaaaaaaaaaaaaanaaaa

SEQ ID NO: 1465 - DNA, 685 bp, Homo sapiens
ggcacgagcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgctgctgaatctgacagggaattgaacgaagatgacagtacagattgtgatgatgatgttcaaagagaaagaaatggagtgattcagcacacaggcgcagcagctggaagaatttaatgatgatactgactgatgaaaatagcatttattaatgattgaggtatttgtttaaaattcagttcatccaaaatggagtaatatccttcaccttcagtgtgtaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttatgacaaaaaaaaaaaaaaaaaa

SEQ ID NO: 1466 - DNA, 3541 bp, Homo sapiens
cctccagattctcatggagtgctaaatcttgactcttgctcctggaatttttcaggcccaaactagcttttctacaatgatttatttggcaaatttgtcttgattatgggtggctgatgaggaacgtgcttttgttaggaaccgaaagtgggcggcggtgagggcgtgtacgcaatgagtccaggttccaacaggatgacgcctgcgcagtaggtccaaagtctcacggcgcacagacgactgtctgagagagggggcgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaatgtatttttctcatttttttcaaactttttctaaagactctttctgtcaaactcatgaaaaatttctttctatggcttttattctagattgtcttattttctgttaaaaccaatgaccacatgaccacaatcttcactaactcatactgcagtgaaagtgttaacccttaggtagtttctctacaactctttgctatggtgatttttaaaaaagtttcctagggaagtatctctgagggaacaggcaatctgaaggaactgactatattctccatggctaagtccattaggccaaaag

SEQ ID NO: 1467 - DNA, 567 bp, Homo sapiens
gaattcggcacgagctggattccttttttgtctctaacaaaatatctaaagaaaaccgaaaacatgctccgtataaaaagttgtctcttattattttttattttttttccatttaacattaaagactctcaagtacctgccaattatattgccacattttctaggaaatgcagcttttagcaattctttgttgattcaaatgaaatcaacctagctcagctaatattaattgattagattgagaataaagtcctaataccaaaggctgaccaagagaaaatgcttgaaatcagatgttgactgattcaggccggttctatcagtttgggcaagttgctagggagtggacaggaagcttgaggacatcacaaaagaatccataaaggacccatgatgcattgagagacagatacataagaatggctgggcatagtagaacagatctggtatcattacagtaaatctccattatatggagttatctagaaacattatcttccttgctggctgaagaaacatagtacccctccaactaccctcaaacaaaaaaaaaaaaaaaaactcgta

SEQ ID NO: 1468 - DNA, 1311 bp, Homo sapiens
  misc_feature (1)..(1): n equals a,t,g, or c
nctccaaatggagcctcttgcagcttacccgctaaaatgttccgggcccagagcaaaggtatttgcagttttgctgtctatagttctatgcacagtaacgctatttcttctacaactaaaattcctcaaacctaaaatcaacagcttttatgcctttgaagtgaaggatgcaaaaggaagaactgtttctctggaaaagtataaaggcaaagtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaacctgcatttagatttcttgttgattcttcaaagaaggaaccaaggtggaatttttggaagtatcttgtcaaccctgagggtcaagttgtgaagttctggaggccagaggagcccattgaagtcatcaggcctgacatagcagctctggttagacaagtgatcataaaaaagaaagaggatctatgagaatgccattgcgtttctaatagaacagagaaatgtctccatgagggtttggtctcattttaaacattttttttttggagacagtgtctcactctgtcacccaggctggagtgcagtagtgcgttctcagctcattgcaacctctgcctttttaaacatgctattaaatgtggcaatgaaggatttttttttaatgttatcttgctattaagtggtaatgaatgttcccaggatgaggatgttacccaaagcaaaaatcaagagtagccaaagaatcaacatgaaatatattaactacttcctctgaccatactaaagaattcagaatacacagtgaccaatgtgcctcaatatcttattgttcaacttgacattttctaggactgtacttgatgaaaatgccaacacactagaccactctttggattcaagagcactgtgtatgactgaaatttctggaataactgtaaatggttatgttaatggaataaaacacaaatgttgaaaaatgtaaaatatatatacatagattcaaatccttatatatgtatgcttgttttgtgtacaggattttgttttttctttttaagtacaggttcctagtgttttactataactgtcactatgtatgtaactgacatatataaatagtcatttataaatgaccgtattat

SEQ ID NO: 1469 - DNA, 2399 bp, Homo sapiens
  misc_feature (73)..(73): n equals a,t,g, or c
  misc_feature (90)..(90): n equals a,t,g, or c
  misc_feature (128)..(128): n equals a,t,g, or c
  misc_feature (219)..(219): n equals a,t,g, or c
  misc_feature (255)..(255): n equals a,t,g, or c
  misc_feature (272)..(272): n equals a,t,g, or c
  misc_feature (2354)..(2354): n equals a,t,g, or c
  misc_feature (2364)..(2364): n equals a,t,g, or c
gaacttttccatctggcaaaccggaaactccatccccattaaaccaactcccccttttggtttcccccccagnggaatagaatttggacncccatataaatccaggaaaccacctaaattctttagtngtttgtgtttgcaagatctaaggtcatggtaaacattaagttcttaaaatttttgggagggaccagtgcacctctccctctgaattgttcnccaatttaaaattggagtaaggttttaaaatgtctnattccattggaagggtntgttatttcattttgagcccagaggggagaggcacattttaaatatcagaattagattagctttgagtttgtacaattgggaacataatagattttcataaattatgtgtgccttgttggaagtgtcaactgtctttatgtctgcttgtaaaagtttcaaaatatgttttccctcaaaaaggcaacgttacttcatttgcttgaatattatgataggaatgcttactgatattacttgatagtcatatatagcctaggaaatttaacatatatataactatagcagtattaataatgatagttgtacttctttaaaacattaaatttgaggaaactttaatgctgtctcgtgtacattgctttactacagtgagggggaatatcctttagattgagcctcaatttactggttagtagtatgtgaactctggtataaaaacgtaaactagacagtagagccgatgaattaaaattgtaaattgctacattggcattttctacctccttttctgtcagagtattactttttccagcatttattcttatttgtgagtaaagaggaaatgggaacctgaggttaaaattgacatttttgtttcattgagaatttaagcagtaggtacaggagaagtgacttgtcacattaatttggtgcctaaatctgtaactacaagttgtgatcgacatgtacaaaatgtctaagaaaggtcatatgctgaatattttacttttcctgtatagtctgcatgatttgtttcataaacccagcttatttcctccaaaaagcaaaatggtcctgtaatttttaaagtaaaataaacgtgccattttgtctgcaatctataatttcaggaagttattgraagttctgactcagggctttttaacagttcaagcaattgtcagttatattttggaaactccatctgtgtaattctccagtgccttgaaagaattattaacttggcaacactattaaaactttataaaagatggtctttagtgcacgtgtatcattatatacacgttttaaagtcatattgcttagcttgttaataatgattctgcatgtgtgctgggtttgggtaattctttaaaggaagttttctagatttgcacttgatgtttgttttttaaaaactgattatttatggccgtgacactgttaccagaaaagtaattctaattaagttattatgcaaagtcatctataagtagcatctgggaagaggagatsgaggccacagtttgctattttagtatgaaaggaggatctgtttgggaaacatagattgtcttcccctcaaatgaggggaaaaaaaaagaccctttgttcaaatggattctgttgtaaaaaattatttttaaaggaaatcacaaattgtatgtcattcttaatgctagtcttatagaataaatccataaaattgtttttatgttcagtatgtttatgtcattctaaatgcagcaaattcaatgatagcagttcaattgactcatagcagtgttttgtattttttctaattctttagctttcaatattggattaaagtcttgtttgtgaatatagtttccgtatggcaaatgatttcttgcttattagcttttgttaaagaatgcttagtaagagctaagcttttaaaagtaatgcaaacatttatcgttaataaaacctatggtgtaatatcatataatgcttttctttgatctttggagaattattcttttatagtagtatacatgaattttgatttttaaagcatttaaaaacaaatctcaatacattaaaaaacctgttattgttaaaarggaaattaccatgcctttaagaaacaaggatgtacatcttcaattcagcatragtgtccacatctagaaggctctcattgcagttgtttacagttaaggtacctctatctaaagggccaaagaagcatttcataytttaacacctcacattctttcaggattaagacatatgaaaatagtctgaataggataaatttggataggaagtaacttaaccagtctgggaagattcaggctttttctatkaaaaagcttattcctcttcacaactcnggtggtaggntttcatttttcaagagggtagatattttaaagcca

SEQ ID NO: 1470 - DNA, 1353 bp, Homo sapiens
  misc_feature (1322)..(1322): n equals a,t,g, or c
  misc_feature (1341)..(1341): n equals a,t,g, or c
gggtcgacccacgcgtccgcccacgcgtccggatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttgaaaaaaaaaaaaaaaacctnggggggggccccggacccnaattggccctat

SEQ ID NO: 1471 - DNA, 1395 bp, Homo sapiens
  misc_feature (922)..(922): n equals a,t,g, or c
  misc_feature (935)..(935): n equals a,t,g, or c
  misc_feature (1385)..(1385): n equals a,t,g, or c
gaattcggcacgaggcggcgcgggacctgcagtcgccagggattccctccaggtgacgatgctctggttctccggcgtcggggctctggctgagcgttactgccgccgctcgcctgggattacgtgctgcgtcttgctgctactcaattgctcgggggtccccatgtctctggcttcctccttcttgacaggttctgttgcaaaatgtgaaaatgaaggtgaagtcctccagattccatttatcacagacaacccttgcataatgtgtgtctgcttgaacaaggaagtgacatgtaagagagagaagtgccccgtgctgtcccgagactgtgccctggccatcaagcagaggggagcctgttgtgaacagtgcaaaggttgcacctatgaaggaaatacctataacagctccttcaaatggcagagcccggctgagccttgtgttctacgccagtgccaggagggtgttgtcacagagtctggggtgcgctgtgttgktcattgtaaaaaccctttggagcatctgggaatgtgctgccccacatgtccaggctgtgtgtttgagggtgtgcagtatcaagaaggggaggaatttcagccagaaggaagcaaatgtaccaagtgttcctgcactggaggcaggacacaatgtgtgagagaagtctgtcccattctctcctgtccccagcaccttagtcacatacccccaggacagtgctgccccaaatgtttgggtcagaggaaagtgtttgacctcccttttgggagctgcctctttcgaagtgatgtttatgacaatggatcctcatttctgtacgataactgcacagcttgtacctgcagggactctactgtggtttgcaagaggaagtgctcccaccctggtggctgtgaccaaggccaggagggctgttgtgaarantgcctcctacgantgcccccagaagacatcaaagtatgcaaatttggcaacaagattttccaggatggagagatgtggtcctctatcaattgtaccatctgtgcttgtgtgaaaggcaggacggagtgtcscaataagcagtgcattcccatcagtagctgcccacagggcaaaattctcaacagaaaaggatgctgtcctatttgcactgaaaagcccggcgtttgcacggtgtttggagatccccactacaacacttttgacggtcggacatttaactttcaggggacgtgtcagtacgttttgacaaaagactgctcctcccctgcctcgcccttccaggtgctggtgaagaacgacgcccgccggacacgctccttctcgtggaccaagtcggtggarctggtgctgggcgaracagggtcagcctgcagcagcacctcaccgtgcgctggtacggctngcgcatcgct

SEQ ID NO: 1472 - DNA, 2468 bp, Homo sapiens
ggcacgagatcacagtacagcgatgagaatatgatggaccctataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatgaatgtgagccaatagaagcaatagccaagtttgactatgttgggcggtccgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgccccacctccccagggtccaacagacaagtcatgcacaatgtaaaaaccagccaagcaaggccataaagggaggtgacttaaaaaagaaaatggattagtgacaaaagtcactgatccataactttccttagttttgtgcttataactggagatcttttggcttttctatgttgtcgaatgtaatgtctgagactagctaaattaacacgggcatttgtattttgtaatttttttaaataactggacatatgtcattttaaggacaatagaaacacttagacttacttgaaaatccaatgctgcaccacttgtaatgaaggcaacaccgctctccacattgtacagagcttcaggtttaatgtagcccagctgagtcagaaaggttgtgacctgaaggcagaagaacccgaatgccacacctcattggagtatagccagtgttggtctgtggcacttgggctgaaaggtgataatggcattgcgtggtagctgacaatgagcaccttcggttccatgtggagcggggtttagctcatgcaaaagacttgcaattgtctccatgggacgatcccagtgggactgtcagcccacagctcgagtgggttggatgcttgcctctttcctaacagttatttccccgggtccagcttaaagactcgatggaaggaggtagaacctctgctgttactgcttgaacttaacctgggaaaggagaggaagacaccatctccaaagctattaatgtcactccttttgcgagcatgattaggccccggagatttccaagtccccccatctacacttacaaacgattagaagggtttaattttaaagactttctggttacactactccacgaactcctccaaagatccgttattcaataactgcctagaaaatgtttccatctcctctaaatccctgtgttctcctctgtggaaatgaaggcagcaagaagcacctgaggccttggttcatgcagtgttctcttttgactaaatcacctaggttcctttaaacatgctacaaagcccaggcatggtggtgcacacctgtactcccagctactcgggtggtttacacaggaggatggctttgggcctagtagttcgagtccagcctgggcagcatagtgtgagaccctgtctcttaaaaaaaaaaaaaaaaa

SEQ ID NO: 1473 - DNA, 2276 bp, Homo sapiens
ccgcggcgtctgacctcatggcgtagagcctagcaacagcgcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccgccgctctatccagtgttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggagcatctgtggtccctcatccctcgcctactcctctgtctcaagaggaagctgataacaatgaagatcctagtatagaggaggaggatcttctcatgctgaacagttctccatccacagccaaagacactctagacaatggcgattatggagaaccagactatgactggaccacgggccccagggacgacgacgagtctgatgacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaagatcccaaacttgtaactaaattctgacatatctgttactgctgactcacattcattctccgccattcaaatactattttttatccacatttttttttgttcccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcaaattaaaattatacctgaatgaagttgtttgtatacataaaggatatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaatggcaaagatataaatctaaaaaaaaaaaaaaaaaaaaaaaaaaaaaaaaaaaaaaaaaaaaaaaaaaaaaaaaaaaaaaaaaaaa

SEQ ID NO: 1474 - DNA, 772 bp, Homo sapiens
gcaaccagtatgaaaaggctttctcatccaagtatctgcagaactggtctcccactaagccaacaaaagagagcatctcttctcatgaaggctacactcaaattattgccaacgatcgtggtcatctactgccttctgtgccccgttccaaggcaaatccttggggttccttcatgggcacctggcaaatgcctctgaagataccccctgctcgggtgaccctgacctcccgtacaactgctggtgctgcctccctcaccaaatggatacagaaaaatcctgatttactccaaggcctccaatgggctgtgtcctgaaatcttaggcaagccccatgatccagacagtcagaagaaactcagaaagaagtctatcacaaagactgtacaacaagcacgaagtccaaccatattccaagctccccagctgccaacctcaattccccagatgaactccaaagctcacamccctctgcaggtcatactccaggtccccaaagaccagccaaatyctaagagcccacctggragtccacgtatgctagaactctgggcagggcctaatctagctgaggtccagaaatacaaacctggaacttcatatggaccaagtggccacacactgaaaaacccgtatagcgactcagtgaaataaacaagagcccccagtcagaactgtgaaacagggaaattttggggtggsagtaaaagsaaatttggaaaataaacttttttttgttgaatcttttaaaaaaaaaaaaaaaaaactcgta

SEQ ID NO: 1475 - DNA, 1228 bp, Homo sapiens
ggcacgagatctcatgagaggaatggctagtgacccaactctccaaatgtctaagttagtagttacagctgattttttatgatgcataattggaatgtggagcctctgaggttgtgatagcttgtacatgaatttcaaatgtcattctaaagaatgaggggtgggagggatttatagttagaaacgacagtgcaggaaggggtattttcttgttgtcagggctggaatgaatcactgctgctcaagtcaaaggttcttgaatatccttagtttttgcatttcccctccttttcctttgacctttatttatttaattatgtatttatttatttatttatatacttttgctccattcagcacaaacacaaagcaaagcaaaaaaaaaaaatatatatatatatctgtatatgtgttgtaggcaaaacactgtgaatttcacaacaaccaccaccaagcaactattttgccatcttaacatacatctcaggagacgaaatgagaaaagatggggatgtcattttttagtctatgcgtttgaggccaggtccatgtttatttatttctttagtctatgcattaatgaaaatgatcctgagtggaggttagctgaacgttcaatgtactggagcaagcatcataaaagctgctagtagccatgtgtttgaacaggaaaaatattacagaaaatgaaatgtaaaggcctatatcttgcagcttgtatatcttactattgcttaaaaaatgtataaagcagctggaaatgttttaaatacaaggtctttgaattaaatgtggattttaaatatgtaatcccttgacaaatgaccaaattatggtgaactattgctccctgcgttctttgatcattacctatgacttacaaatctgcctggagatgtggacattctgcatttgcttctgtatctggagagatgtttgtatatatccaggccgtatacacacacatttccatatctctctacagatatatttccccttcaatcgtgacctggtatttggaactctccttttcatttggcttatcttccttttaatgtgatgtctctgtgctaatacttaccagttcttgttttgcaatctgttttgaggtccattgctttactaagacccactgcatcttggctgatttcaaagtgacacctgaatacagtgtttaaaaaaaaaaaaaaaaaaaaaaaaaaaaaaaaaaaaaaaaaaaaaaaaaaaa

SEQ ID NO: 1476 - DNA, 1341 bp, Homo sapiens
ggcacgagctggcctggacgaacgggaagccgggagctcggccacgggtggcgaggctgcggtgaggcctggtctccggctgccagaccatgctgagtggagcacgctgcaggctcgcctcagcgctgcggggaacgcgcgcgccgccgtccgcggtcgcccgtagtgcctgcacgcgtcggggtcgcggcctttggcaccggggcaagaagactgaggagccgccccgcgacttcgatccggcgctgctggagttcctggtgtgcccgctctccaagaagccgctcagatatgaagcatcaacaaacgaattgattaatgaagagttgggaatagcttatccaatcattgatgggatccctaatatgataccacaggcagctaggatgacacgtcaaagtaagaagcaagaagaagtggagcagcgctagttcataatttaaaaaaattaaaaaaacgcaacagccaacttttcttaataccatataccttttaaaacacagtggcaggtaataagtggaagagaagaatgtttctgtctcttcctacgttgactgttcttattccactggtttctttagcaggactgttctactcagcctctgtggaagaaaacttcccacagggctgcactagcacagccagcctttgcttttacagcctgctcttgcctattaccataccagtgtatgtattcttccacctttggacttggatgggtattaaactcttcaggcataattgatgcaactagagtcaatatgctgtatatattaatgatagctcttgggcatcgatctctgaaagctcaaatggatggaatttagtttgcgggaaagaggctttgctttgcgcatatcaggcttaggactgtgggaggcttaagttgcagatgcttcttttattgtactcttgttctgcccttgttttttgaaggctctgacttataactgctgtatcagaagaaacattttgacagtgtcttggttggagatgaacatccctaattgacatgtgatgactatttcttattccattcatctaagagtcattgaaattttgttttgcttgtttgtttagcttcaaggtctttggtaaagtcacatgttaaggatgactgaaataattccaaaggagtgatgttggaatagtccctctaagggagagaaatgcatttgaacgaatgtgatataaaaccacataatcaaatagaaacttcatgtacttacaaaaactgagtttgtaaaattaccttcatttctttgacattaaatgcttatattagcaataaacatgttgacactttcctataaaaaawaaaaaaaaaaaaaaaaaaaaatt

SEQ ID NO: 1477 - DNA, 1228 bp, Homo sapiens
ggcacgagctcgtgccgcttgcaactccacctcagcagtggtctctcagtcctctcaaagcaaggaaagagtactgtgtgctgagagaccatggcaaagaatcctccagagaattgtgaagactgtcacattctaaatgcagaagcttttaaatccaagaaaatatgtaaatcacttaagatttgtggactggtgtttggtatcctggccctaactctaattgtcctgttttgggggagcaagcacttctggccggaggtacccaaaaaagcctatgacatggagcacactttctacagcaatggagagaagaagaagatttacatggaaattgatcctgtgaccagaactgaaatattcagaagcggaaatggcactgatgaaacattggaagtgcacgactttaaaaacggatacactggcatctacttcgtgggtcttcaaaaatgttttatcaaaactcagattaaagtgattcctgaattttctgaaccagaagaggaaatagatgagaatgaagaaattaccacaactttctttgaacagtcagtgatttgggtcccagcagaaaagcctattgaaaaccgagattttcttaaaaattccaaaattctggagatttgtgataacgtgaccatgtattggatcaatcccactctaatatcagtttctgagttacaagactttgaggaggagggagaagatcttcactttcctgccaacgaaaaaaaagggattgaacaaaatgaacagtgggtggtccctcaagtgaaagtagagaagacccgtcacgccagacaagcaagtgaggaagaacttccaataaatgactatactgaaaatggaatagaatttgatcccatgctggatgagagaggttattgttgtatttactgccgtcgaggcaaccgctattgccgccgcgtctgtgaacctttactaggctactacccatatccatactgctaccaaggaggacgagtcatctgtcgtgtcatcatgccttgtaactggtgggtggcccgcatgctggggagggtctaataggaggtttgagctcaaatgcttaaactgctggcaacatataataaatgcatgctattcaatgaatttctgcctatgaggcatctggcccctggtagccagctctccagaattacttgtaggtaattcctctcttcatgttctaataaacttctacattatcaccaaaaaaaaaaaaaaaaaa

SEQ ID NO: 1478 - DNA, 921 bp, Homo sapiens
ggcacgagattatccattactgtttgttggatccaactacacagtatcaccaacttttggtcagtgtagaccagaaacacttgtttgaagcacgcagtggaatcctctcaatccttcatatgatcatgtcctctgtgacactgctttggagcatactgcatcaagctgattcttcagaaaagatgactattgccgcatccgcatctcttaccactattaatcttggagctacaaagaacttgagacaacagattcttgaattgttgggccccatttcaatgaatcatggtgttcactttatggctgccattgcatttgtgtggaatgaaagaagacagaataaaacaaccaccaggaccaaggtatgtatttagacatttggcactttttgtttttgcatttggtgagtacatgctaatttccacttctccatatattgcagtggggccggggtagattcgagtgtaaagcaaaagtctgtcgacagctttagataaattgttgccttaatttctttaagtattgattaaaatttgaggtcaaggctaggcacggtggctcacacctgtaatcccagcactttgggaggccgaggagggcggatcatgaggtcaggagatccagaccagcctggccaacatagtgaaaccccgtctctactaaaaatacaaaaattagccaggcatggtggcacacgcctgtagtcccaggtactcgggaggctgaggcaagagaattgcttgaacctgggaggcggaggttgtggtgagccaagatcatgccactgcactccagcctgggcaacagagcaagactcttcctcaaaaaataaataaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1479 - DNA, 1811 bp, Homo sapiens
ggcacgagcagaaatcctgcttttattatgttatatttatttgttcagtaagctttagtgtttagaattgtgttgcacagttcaaagttttatctctatattaactccaagaactacgggattgtgtaaaaagactgaaatgatgactgactatggggactttttcgttgatgctgttgttgctgccttctgttgtttgtttttcttttaaagtcaggcccctcttctgtagggctgctgtggtttgctcggggtccacttcagaccctattcacttgggcccctcccatacctggaggtgtcatcagtggaggctgcagaacagcaaagatggctgcctgctccttcctccgggatctccgtcgcagagggaaaccgacctgatgctagcaggaatgctcctgtaaaaggtatctggtgacccctgttggagagtctcacccagtcaggaggcataagatgcaggacctcttaacaaagcactctggctgccccttggtagaggaagtgcactgtgctgggggcactcccatacatctggactgcctagattcctcagagccaccaggaaggactaagtctgttgatccatggagaccacagccgtccctcccccaaagggcttaaccccagagagaccagagctctgtccctacactcctgcctgaagttgctgaaattcctgcagggaggccccatccagtgaggaaggatcagtcagggtccagcctaaagaggcagtctagacaggatctgccacagatcaagtggacctgatagatatcaatagaactctccacccacaaataacaggatatacattcttagcagagcatggcacttacattaaaattcatcacataattagaagtaacacactctttagcaaatgcagaatagctgaaatcataacaaacaatatctcatacaacagtgaactcatattcaaactcaagattaagaaattcactcaaaaccatacaactaaatggaaattgaacaacctgctcctgaatgacttttggataaatcatgaaatcaaggcagaaatcaagaagttctttaaaactaatgagaacaaagagaaaacataccagattctctgggacatagctgaagcagtgtcaagagggaaatttatagcactaaaggcccacatcaaaaagctagaaagatgtcaaattgacatcctaacatcacaactaagagaaatagaaaactaagagcaaacaaaccccaaagctaacataaaacaagaaataaccaagatcagagaggaactggagggagagacatgaaaaacacttcaaaaataaatccaggatttattattatttatttaaaaatgtagaccacctgctgaaataataaagaaaagagaagaatcaaatagacacaagaaaaatgataaaaaagatactgtcactgaccccacagaaatacaaacaaccatcagagaatactataaacacctctatgcaaataaactagaaaatctagaagaaatggataaattcctggacacataccccctcgcaagactgaaccaggaagaagttgaattcttgaacagaccaataacaagttctgaaattgaggcagtcataaatagcctctcaaggaaaaaaaccccagggccagacggatttatagctgaattctaccagaggtacaaagaggagctgatagcatttcttctgaaactattccaaacaattgaaaaggagggacttcaccctaactcattttatgaggccagcatcactgtgataccaaaacttgccagagatttaaaaaaaaaaaaaaaaaaa

SEQ ID NO: 1480 - DNA, 1517 bp, Homo sapiens
ggcacgagatgacatcttccatgtgttatggtaatttattgctgaaagaattaagcacatcctgggtgactccatggggagaagactcttagaaatttgtttggtttcctccaaactttgcccatgcgcaactttcagctttgcttattttgctttgtgttttttcgctgcaataaattttagttatgaagcagactgcatgctgagtcccatgagtcctcctagcaaatcactgaacctaggggtggtcttgggggacactaacacagggagttgattgtttggcaacacaagttgtttcagagcaaatgaattctttttccacaagctagcatattagtaaactatcagggagcataaaatcagttgactgagttctgtcgggaaacaaagggaaaatttttcttcaaaaagacatgatatcctccctgttaagcaaagcagtactttccctatggataagtgtattcagttggaatgtgcttggctgcaagaaactgaaaactattatattacaatgctttaaagaggctagtgacttgtttctgagggaaagatatctaggagtggtacagtcactcagtgatgattttttctttttgctccaccatccttagtgtatagtttttgtcttcatggtcacaaggcagctgctacagtgccatgtattgtttgatgtccaagtgatcaggaataggagaatgtgaagggcaaaacccaactctgccctctctagggacttcaatttctatataattgactagcactgtcccacaggagctgaaaattcaactacttcacttttcaatactggaaatgagtggtaagaaacttggactagatgatcgatggtccacataaattatctgtcacaattcttctgacactaatagaacagcaatacaagattgtcgttgattccctatgtgaagatcctgtatgtggataccttgattgtaaggctgagagattaaagaccatagtaacttttgttaagtggtctccttgtcactcacatacctttgctcctgagttcttccataggtgccactgaacagcttccttgaggtaaactcttctgaacttgtaacctacattaactgggatattaataatctcttttaatcttaatgctcttatgaaatgacataaaaagaagaaatgcattgcactgttgtatgagcagataagacaaaatactaattctctccttttccccccatcctatcttgttttctttctcagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaaa

SEQ ID NO: 1481 - DNA, 1025 bp, Homo sapiens
ggcacgagcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccattgtgaaagggtcatttttaatctctgtggtgaggattccgagaatcattgtcatgtacatgcaaaacgcactgaaagaacagcagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgctttggagacttcataatttttctaggaaaggtgttagtggtgtgtttcactgtttttggaggactcatggcttttaactacaatcgggcattccaggtgtgggcagtccctctgttattggtagctttttttgcctacttagtagcccatagttttttatctgtgtttgaaactgtgctggatgcacttttcctgtgttttgctgttgatctggaaacaaatgatggatcgtcagaaaagccctactttatggatcaagaatttctgagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaagacctaataaaccctattcttcctcaaaaaaaaaaaaaaaaaaa

SEQ ID NO: 1482 - DNA, 3059 bp, Homo sapiens
  misc_feature (19)..(19): n equals a,t,g, or c
  misc_feature (79)..(79): n equals a,t,g, or c
  misc_feature (1639)..(1639): n equals a,t,g, or c
  misc_feature (3047)..(3047): n equals a,t,g, or c
taactaccagggaacaaangctggagctccaccgcggtggcggccgctctagaactagtggatcccccgggctgcattntttcggcacgagggagatggtagcagcagaaccacagcacaccactgagcactggaaagagcaagagctgaaatcttaggttattggatatgcctagagtcagaaaagccttgggaaatttttggtgatcgatttttcctgtgaagggggaagctgctgatggagacttgtatctgcagtacttcaggttcccagctggctccccatccccaccctataacatgaccggcgtacagaaattaattggccgactgttaccaccactagtctgtccctggctagactagacagatgggtgtgcccctgggctcagtggtagcctacccggggtgatggtggggttgccagctgtagtccagctgttytggggcctgtgtttgtgcacctgtggtgctgtatcctgccccacagagctggctgtccagtggagaatacaaagtgacatctggtgctccctcagaaagaatgtggccccagaggcatgccagtggctttagactctctgggaggacatgtttgagagcaacagccccttccccatcttttcctttcttctcagcagttataaatctctctgcctgcagtaagtagagtgagtggctggtgaggaggtttgttgatgacactgacaatatctggtgactccctccagatgtgcactcagcagtgagctgggcagaggcgtgggaaggacgttggctgggagcagacggcctctgcaaatgaatctctagtttcctgcaacctgggagtgtccccatgagttttactttcctactttatgaagtgaacctgctttctttgggatttcatgtactcctaatgctttttctctccaggtatttctttcctgctacatattaggactcccaaggcaagagtgcacctttatttagacctgggagtaaagggaaagagttgcctgtctttcgtgtgttttcagctttggctctgtgggatcagttatgcctcattcctgaaaagggcctttttatccccccagaatgcttttgctttgccaataccaccttcctcagcctgccttttggaaaggttgagaagctaaaaagtcaggtaagagaaggcagagatggacttcagaacctgatttttaaattttaaggcaaggctggctgccactggtgagagtgatgcagcagcctagcgtgttcccagcagaggtctagtctttgccctaagaagtcaccgcgcttatgaggttgctatcacagtgcatgtggtaggttagatttgagaaatggttaggattgttctgttggataagtgcagacacctgcccagggaagcagctctttttttgtaagagttttcttggttactgaaatcaaatgggggaccagtttgttataggagacatctgtggccagcaaatctgaacagcttcctagagggaaagtacctcttttaaactaagttattatagacagtgaatgaatcctacccttaaaagagatgacggcagggtaagtgcaaagtaaaacctccttgctctagtctcttgggagagtattgtaatgaaagcagcgtttacttcgttgntgttgcattggggtgaaaaatctgagatgctggaatgatggcaatgtttgccttctctccttcccttcctgacagccagtgtgggccaggctccactctccatcttcacaccctgcccttgctccagtatttccattctgkttttctcctctgtctctttctgtctttctctcaaactccatcctgcttccacccctgcccgcttttcttctcctttcctggaagtaatcattaaacaaaagaaaaagttgaatgttctttggtgagtttccttcttctctgccttttccttctttagccagttcccctcaacccctgtgcactccataggaaggacaaacttacctgtctgctttcttcccatgtgcttctccccaaattttcatatagatatatacgtacactccttttggaataaacgaagaggtacattatatttgacacaaacttgggagtgttaagaggtcataagtgtttacctatcagataaccatctgtggctctgtgttggattttttttataccattaggaaaatgggaatttttttataggcctgccatacttctactttgccaaatagcactttattatcaagatacacccatggctcatttcagactcactgaactttttttatatgaatgcacagtcgtcatattttgggcagtctgtgagttcttggtaactcatccccttactacaaaagcactaagtgaacaatwcaaaagtataaaagcacaaatttgaacttacatagtttagtttaagtatgtttcactagaaaatcaaatatttagatttctcacattgaaaatgcttaggattgaggtttagctgcttcctttaaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgctatcagggcgatggcccactacgtgaaccatcaccctaatcaagttttttggggcgaggtgccgtaaagcactaaatcggaccctaaagggagcccccgatttaaagcttgacgggggaaagccggnaaacggtgggcc

SEQ ID NO: 1483 - DNA, 3386 bp, Homo sapiens
ggcacgagcggcacgagcacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctctactgcgtctaccagagcatggtgctcttcttcttcgagaattacaccggggtccagatattgctatatggagatttgccaaaaaataaagaaaatataatatatttagcaaatcatcaaagcacagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcatgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaaaaaaaaaaaaaaaaaaaa

SEQ ID NO: 1484 - DNA, 1239 bp, Homo sapiens
gaaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcagtggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtaggtatatgttacgagaacgcccttcagcactgctcaaaaattttcggcatgtatttcatctagtcatgtccttttggtcctctaaattagcagtggtttggcataatagtgttttgtgttttttttctcattgaaataaatcttgggtttgtttttttcccgagcctgctagggcgaggggggtgaatggttgatgagtttaaaaataatgcagcccttgtttttcacctgtagaatatgagaacattttaacagcacctctcttatcttgcagatatattccaagatgctacatgcagcagacagctgtgagcttgcatacacacacacacaaatatacatgcacatacatacacagaatgcagtactagttaagtatttccttcctatctttaataagtaagagaatatttagaccattaaaaaaaaaaaaaaaaaaa

SEQ ID NO: 1485 - DNA, 1672 bp, Homo sapiens
ggcacgagttttttctcactctaatgacttcctattggaaaggcattgacagccagggacaggagccagggtgggggtagttttgtgggaaagcagaactgaagttagcttaagcataaaaacaaagaaaaatcttcgcttttcatgtatgtggaatccaagaataaccataggctctaccagaccaggagggtaaggatggacactaaaatgaaacaaataccaaggtattccttctgctgcagcctggagaccaccgagagtcgagctggggcacacacacacctggccgggacccggcagggacaaggcgggccgtggcctcctccaccaagtctctctagacaattcagggcctgctttccccagctccatgcatggctggactggtgattccagggtgcagaagggattcatattcccagaacgctttaagtgtacacctgcaggataaagagataccggttacattattaaatgattctagggattcactgggggatatttttgttgcttttactttcatggttagagctacaaagaacagtgattttttttttttctcccttccccattcagaaacattatacattgggccatttttctttctcccaaagaagattcatggatagtcagactgaactgtgtgcaacaggaaaagtcaaaagggaaaaggcagctgatgaggttacatggttacatgttctacatcatgcagagtagcttgaaatctagtctggagaaaactggatcaagattctagcccactggagttgcaaggaatgagaggcaaaaattctaaagatttgggttatattttcaacttgggggacagagagaaatggagagcaggaattacagttccaacaaacatcatgatagtctggtagtcaagacagagattaagtaaaacaggttttactgtttagctgagttcagttaatacaaaatgtacataaaacgttagtcctttgagactgacatgattaatgatcagtgtggtgggaaatgatgtagttattgtacacaagcacttgcaaactctttatccctatttctttaaaacaaaataaggtgaaatacgaagtccttggtctgatataaagcccctattggattcttcggatgcgtaaaagaaattgcctgtttcagccagaagactggtgaaaacacatacatcagactatgttgtgagccaggttgattttttattttattatatgcaggtgagtgttgaaactgttaaaattccaatttgttttcattcagtattagtttagttctaaatatagcaaaccccatccaggtgctatcagatgaccagttactgcttagttaactaggtgtaaagttttacatatacattaatgtcaatagtttattacaagttgtgtaaaatggactctagtttaataatgggggaaaaaagattaggttgctcctgaaactgactgtagagcatgtaaaatgattttactggattctgttcaactgtaatcaatgaaaaagatgtacgttgtagacaaagttgcagaattaaaaaaagaaatctgcttttaatttattctttttgtattaagaatttgtatagtatctttacattttgcaaaacagtgttgtcaacacttattaaagcattttcaaaatgaaaaaaaaaaaaaaaaaaaaaaaa

SEQ ID NO: 1486 - DNA, 2438 bp, Homo sapiens
cccccgggctgcaggaattcggcacgagaaaccccctgtatgtgaaccttagattgtaaggcaagccagtgcactgtgtaatatgcaaagggagtggtgcaaaagagaaggcacccgtcccagctctccatgccctttccctggcaggcgctgactgagatggcgctgagtgaatgtggaaggtgctaagacccagtctcttcactgcagggctgtttacagccagtttcttttactctgaccttaaggtttccactgagctcatgaaacttcaacatatggtgtttaaaagtttcccactcaaatgcacacttgaaaattgggtccctcagcctcaattactgaactaaataagtgaagaagttgtatctttggggtaaaactttccagggccacttaattttttaaccagttaagtacgcatcttcctggtggttcagactttttaagtcagtgctaaagctgaaaagcgccttctaaatatgactgtgagtttagtttgtatcttacatttagtaactgttctgttgggccaggactatgactttaattactatgtacttattcatcccacactctgcactaaatacaccatagctactatagcattgtggcaggcactcatttttgtggactcattccatacttctgctggcatatttcgtttaaaatctagctaaagattttcatagtactgtgttaactagccagggctgaaaagtgtgacaggatatcaaattgactttccttggggaaaatgttgctttggcaatagtgaagtccaactccttcatttacagaattagtgattactcatcaatttttgaaagttgtagattaagtagttttatttactaaattcttaaccactttgaagatttaagccagttgaaatgaaacattggctggatgcagttggctagcacctgtaatcccaacactttgggaggccaaggtgggaggattgcttgaggccaggagctcaagaccagcctgggaaacatagatttgaaatcttttcaaaaatgtataaaaatttaataaataaataaatgaatccttactcaaccataattatggctttaaaacccaaccaacagtaaacacttacttgaagccaaaacagtaaattttgaatgaaatttgaattatgcttttggaagctgccatgtcttaattcttgctggattttgattttcaattttggaagtttttatcaaaactgtccagtcatgatatatcaggtagcagcctttaaggatctaagtttcattcctataaagaacaggaggtgctggtatttcttgtcttagcaagtgatctgatgcaggtctaaatgggggttagcatctatactatggcttaaaagtttcctccttggtcaccatttgggaggtgatggcttcaaagctaagctttgctctcatgtgacccttctttatcttaatacccaataagatataaacctctcagagtcaacccagtgtagactcaaagggtcttagcttcatctatcagataagatctatctgatttatacaaagaatggtgctgtttttatatacatactaaaaaaatctaattctcaaacaattttcttaatatttatgccagcaaggtcaggaaagactattttgtcctgtttaactttagtagtgaacaaactgctagagacatctgtcatccttaacaggccactgtggtccttatatactgaccctcctttccaattaacgtcctttaatcccatactagttccataagagacttggcacataaaagcagtattttttttaatgcctagtaaactggccagaaaaaaatattgccatggtggacctgtttctatccacctctttctatggctatataagtctatacatgccagttccgtacatactccatttccaaagagcccccaaaccctggacagtagcactaccatgaattttagggtcacaaaacatttccttctgaaggaagcagctgcctcagcagtgtcactttagtgaccactgcccaggcttacttcactttgcctccccctacacatcactgccctctttctgccaccaaacctcactattccagcaatgatgcctccctggtgtctggaaaacccatctggtgcactaaaatgctatgcaacaccaaatggcttcttcccctaatattgctcaacaatgtaaattcttcaagaataaacttcatgctatgttaacatcaatgtatggttacagcttccttttttttttttttcccttttaaaatgaagcaaaccacctccattaaaatccatgttttggggcttgtttttgtctctcaagtgtgaaatataaatcatgtttttatgatttttgtaaatctttttacaccttgtttttgtaagcaaaagtttcttattaaaagaataaaatgacaaaaaaaaaaaaaaaaaa

SEQ ID NO: 1487 - DNA, 1859 bp, Homo sapiens
  misc_feature (1807)..(1807): n equals a,t,g, or c
  misc_feature (1841)..(1841): n equals a,t,g, or c
ccagatgtgaggccacctcccaggaaggagagcacaggaaaagattcctggtgcaatgtgtgagacattttgctgtcagytggaagagctgatctgctggctgtataatgttgcagatgttactgaccacgggactgcagccaggtccaatcttacaagtctcaagtcttctctgcagctttaccggcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggcatcttctcaggcagaggtgcaacctgtcggccaaacactggctagtgagaaaaaaawccttcaagaagtccttgcaagagccattcaacactgaagtcaagggggaaaccttcaatatactagctttaaaatgcctttctcctccctgaatggagggctgagttactatttttatttacaatgaatccttccaaactaaggttttccttttggtgcttctccacaaagagcgtgtagctttgcaatttttgataaaataagacgtgttgccttcccctctatcccattaaaaaagagcagataaagctcaaactattccacctggtagggtcatttaccaagggctggtaggagattccgaatactcaatattctcaggcatgcaagaggacctaagagactgaaaaaagtgaattgttggccagaaaccttgggtcttttcataaaaggaaatttgggcttgtcaatccctctttaaagatataggtagaaagaagagatttttaaccctttgtctgcaaaagaaaaagggttaaatgaagcatctatacagatgactttgggagattatgacaccttttgccatcttcagggcttacgtctttactttcttggctaaccagtttcttagaagaaaatgtgtcagggacttggggatctacagtcatgctttagcatggctatggagctaattatcaagcttaaagggtaactttgggaggactcctcccttcactcctagtctcccttggaagagcagtccaggctcagggaagggaatggataggatgacacagtaagtacagaaactgaagctgtcaatagtgaaggaaaaaggggaattcttcgttgctttggcattgacacataagtactttgattaaaaaaaaaaaaaaaactatggatcaaccattcaaagcatcaattctatagctttttgcagcaagatgatcagttattgctggtaactgcagattctacagaaaagcacttttaaagttctgttgggccatgaatgaacctggaaggaggaaagcacagtaacaatggaaactaaagtcctattattaatgtgacttttctgcttcagaatttctgagactttatagtcactggaaaatagccattaaattctttaaagattagctcttcaacagtagctacacataaaatgcagtatttcaagtgcctgatgctgctgtggtatgctttatcataatgcttaagggcatgatcmaaattwaaatggcttawgaktttgccatattaatcatcttagttccatacacactgagactttaaaagggaaaaaccactctagcaaataattggcaattataaacctgnatgtaaaacattcttgaaaacctagagttgggtnaaaaggtagaagaatgtc

SEQ ID NO: 1488 - DNA, 3798 bp, Homo sapiens
ggcacgagtgcaggaagtttggggagagctcggcgattagcacagcgacccgggccagcgcagggcgagcgcaggcggcgagagcgcagggcggcgcggcgtcggtcccgggagcagaacccggctttttcttggagcgacgctgtctctagtcgctgatcccaaatgcaccggctcatctttgtctacactctaatctgcgcaaacttttgcagctgtcgggacacttctgcaaccccgcagagcgcatccatcaaagctttgcgcaacgccaacctcaggcgagatgagagcaatcacctcacagacttgtaccgaagagatgagaccatccaggtgaaaggaaacggctacgtgcagagtcctagattcccgaacagctaccccaggaacctgctcctgacatggcggcttcactctcaggagaatacacggatacagctagtgtttgacaatcagtttggattagaggaagcagaaaatgatatctgtaggtatgattttgtggaagttgaagatatatccgaaaccagtaccattattagaggacgatggtgtggacacaaggaagttcctccaaggataaaatcaagaacgaaccaaattaaaatcacattcaagtccgatgactactttgtggctaaacctggattcaagatttattattctttgctggaagatttccaacccgcagcagcttcagagaccaactgggaatctgtcacaagctctatttcaggggtatcctataactctccatcagtaacggatcccactctgattgcggatgctctggacaaaaaaattgcagaatttgatacagtggaagatctgctcaagtacttcaatccagagtcatggcaagaagatcttgagaatatgtatctggacacccctcggtatcgaggcaggtcataccatgaccggaagtcaaaagttgacctggataggctcaatgatgatgccaagcgttacagttgcactcccaggaattactcggtcaatataagagaagagctgaagttggccaatgtggtcttctttccacgttgcctcctcgtgcagcgctgtggaggaaattgtggctgtggaactgtcaactggaggtcctgcacatgcaattcagggaaaaccgtgaaaaagtatcatgaggtattacagtttgagcctggccacatcaagaggaggggtagagctaagaccatggctctagttgacatccagttggatcaccatgaacgatgtgattgtatctgcagctcaagaccacctcgataagagaatgtgcacatccttacattaagcctgaaagaacctttagtttaaggagggtgagataagagacccttttcctaccagcaaccaaacttactactagcctgcaatgcaatgaacacaagtggttgctgagtctcagccttgctttgttaatgccatggcaagtagaaaggtatatcatcaacttctatacctaagaatataggattgcatttaataatagtgtttgaggttatatatgcacaaacacacacagaaatatattcatgtctatgtgtatatagatcaaatgttttttttggtatatataaccaggtacaccagagcttacatatgtttgagttagactcttaaaatcctttgccaaaataagggatggtcaaatatatgaaacatgtctttagaaaatttaggagataaatttatttttaaattttgaaacacaaaacaattttgaatcttgctctcttaaagaaagcatcttgtatattaaaaatcaaaagatgaggctttcttacatatacatcttagttgattattaaaaaaggaaaaatatggtttccagagaaaaggccaatacctaagcattttttccatgagaagcactgcatacttacctatgtggactataataacctgtctccaaaaccatgccataataatataagtgctttagaaattaaatcattgtgttttttatgcattttgctgaggcatgcttattcatttaacacctatctcaaaaacttacttagaaggttttttattatagtcctacaaaagacaatgtataagctgtaacagaattttgaattgtttttctttgcaaaacccctccacaaaagcaaatcctttcaagaatggcatgggcattctgtatgaacctttccagatggtgttcagtgaaagatgtgggtagttgagaacttaaaaagtgaacattgaaacatcgacgtaactggaaattaggtgggatatttgataggatccatatctaataatggattcgaactctccaaactacaccaattaatttaatgtatcttgctcttgtgttcccgtctttttgaaatatagacatggatttataatggcattttatatttggcaggccatcatagattatttacaacctaaaagcttttgtgtatcaaaaaaatcacattttattaatgtaaatttctaatcgtatacttgctcactgttctgatttcctgtttctgaaccaagtaaaatcagtcctagaggctatggttcttaatctatggagcttgctttaagaagccagttgtcaattgtggtaacacaagtttggccctgctgtcctactgtttaatagaaaactgttttacattggttaatggtatttagagtaattttttctctctgcctcctttgtgtctgttttaaaggagactaactccaggagtaggaaatgattcatcatcctccaaagcaagaggcttaagagagaaacaccgaaattcagatagctcagggactgctaacagagaactacatttttcttattgccttgaaagttaaaaggaaagcagatttcttcagtgactttgtggtcctactaactacaaccagtttgggtgacagggctggtaaagtcccagtgttagatgagtgacctaaatatacttagatttctaagtatggtgctctcaggtccaagttcaactattcttaagcagtgcaattcttcccagttatttgagatgaaagatctctgcttattgaagatgtaccttctaaaactttcctaaaagtgtctgatgtttttactcaagaggggagtggtaaaattaaatactctattgttcaattctctaaaatcccagaacacaatcagaaatagctcaggcagacactaataattaagaacgctcttcctcttcataactgctttgcaagtttcctgtgaaaacatcagtttcctgtaccaaagtcaaaatgaacgttacatcactctaacctgaacagctcacaatgtagctgtaaatataaaaaatgagagtgttctacccagttttcaataaaccttccaggctgcaataaccagcaaggttttcagttaaagccctatctgcactttttatttattagctgaaatgtaagcaggcatattcactcacttttctttgcctttcctgagagttttattaaaacttctcccttggttacctgttatcttttgcacttctaacatgtagccaataaatctatttgatagccatcaaaggaataaaaagctggccgtacaaattacatttcaaaacaaaccctaataaatccacatttccgcatggctcattcacctggaataatgccttttattgaatatgttcttatagggcaaaacactttcataagtagagttttttatgttttttgtcatatcggtaacatgcagctttttcctctcatagcattttctatagcgaatgtaatatgcctcttatcttcatgaaaaataaatattgcttttgaacaaaaaaaaaaaaaaaaaaa

SEQ ID NO: 1489 - DNA, 2034 bp, Homo sapiens
  misc_feature (1911)..(1911): n equals a,t,g, or c
  misc_feature (1956)..(1956): n equals a,t,g, or c
agctcactaaagggaacaaaagctggagctccaccgcggtggcggccgctctagaactagtggatccccckggctgcaggaattcggcacgagctctgtggtgcctaccctacgcctctccgccgtcctcccccgaactggtggttacgcgggccgcgagttaccgtcccagcaggcagctgattgtttagatggagagaccacaggggagagttacctgttgctgtgggagcaatgaggagttatggaggaaaggagaggtaccaagaccagatgaggactgaacattagacttcccatgattgcagaactgtccttcgctgcagctgtaaaatcgcggcaaggcaggattcatcctggtggtgggtgcaggccctgattcccgtcactgagcagggatacagcaggaagctccacctctgagcacagcaaggggattgttctgattctgagtgtgtctgtttgctagagcggtggccacacttccccggttctgcaattgtggataatttagcatgacttgttgggcattgcaaatatcatgtcgtggagagtctgggctctgttattttttccagctgtgtgtgtgtgtgtgtgtgtgtgtgtgtgtgcatgcacgcgcacgcgtgtgtgtgatgagaccattaagttggtttgacagactgcaaactgcctgttgaacagcagctgaattcttaatttggttcttttatccttcttgtgtttcgtggagtttgcctcacacattcagcgttcggatgtcaactggagttctggatggaagttatacacagaatttggggttctccatctctgattctctccttccttctcaatttttagcaggcatattcccaatttcttcaggagggaaagaccaagggtttcctgttggtgttttggcaactccgcatggcatggcgtcagactcaccctaagctaaaaaccataaaagccctctttccctttgtttcttccacacatcacactcccctcccataatccatgcttttcatctccactcactttttatatttgctcattgtctagatattccctgcaggagagtgacattagacgggctcacttggccaccatgggaagcagaaatccagagatggacacattccctaaatgcttctatgctgccctgtaggagaggtgttactctactcacattgccgtgaggaaactgaggctcagaagtagcatcctttgtctgaaaggacatagctcgtgagcgctggaagcatagtttggtgtctgacttggccaattccaaagcttgtgtgatttgcaccagcactcagatgcattcttccctctccctycctacccaagaaaaatgctatccctcccttttcctctaattagaaaattcttttgtatagtaggagattattaggaaataatcatttctctccaaaagtaacacactgaggaggcagtatctgagggttttgcccaaatatggcctttcaacctctgaattcatgcctacagaaattccaagatgtttgtcatagcatttttattctaaccctccttaatgagtgatacagtttgcctgtgtccccacccaaatctcatcttgaattgtagctcccataatccccatgtgtcatgggagggaccccatgggtggtagtttattcatgggggcagttaccctcatgctgttttgctaatagtgagtgagttctcatgagatctgatggttttataaggggcttttcccccttttgctgggcacttctccttgctgccgccacgtgaagaaggatgtgtttgcttccccttctgccatgattgtaagtttcctgtggcctccccatccctgaggaactgtgagtcaattaaagctcttttctttataaaaaaaaaaaraaaaaactcgagggggggcccggnacccaattcgccctatagtgagtcgtattacaattcactggccgncgttttacaacgtcgagactgggaaaaccctggcgttacccaacttaatcgccttgcagcacatccccctttcgccag

SEQ ID NO: 1490 - DNA, 2340 bp, Homo sapiens
ggcacgaggaaaatcccccttcatcccccaggactgtcctttactctttgatagtatccctctattttcttcccaattctctaaatgctttatcattttttcctgagatgcttctgagggatgctgacctcccactatggggaaaagggttgcttggaggacctggggtggcagccccccgaccagaagcaccctattttatagatagcagtctgaatggtagagagtcctgtgtgtgggttgttagaaggttggttcttcctgttattctctctggctttcctttcaacccacttattttcagaggcctctccccttagcatcctttaaaaggttttctgatgaatgtgtgaaagagttgattatttcaacagtattggttaagtcacaacgacgaagtgctgagaaggttatgggtaccaggaagaaacaaacagaagtcttaagattagaatgagaaccaaagagaatttaaccctgccatttttttttttttaacaccaagatcctaagtaattccaaatgccttagatatcaatgaaagctacacaccattgagatgggcaaaattctttctctacaaagggagtaatcaagtaaatacctgttctctttcaatggactgttgcctattgagcattgtggatgatgtgttttcagatttccaggtgaagttctgaccctacctgtttggccaaagacgtaaattgagaggaaaggccttggtcttcctgatcaaccagcatttaacgaacagtggcttaatgcagatcactcaagaggcagcatagcaatgtaaaaggaatataagtaggtgttggatgcctttttcctagaccaggaatggggaatatataacacctgtgccaccgctcttttaaggaggcattatgaatgagtgcagcattcctgtcctctgtgccaggatttggtcttagaatccatgtcagattggtgcttccagacatctattcccagtccatcagagtgaaatgaaggctatttgccatccctgccttagacagaggagtgaaagaattaagtgggtagacaccaaccaaaatgactttgaaagcagtgagctgattgagctccagttctgtggttaccagaaatactgagtgtctgtcatgtgcaagacaatgctaagaacagaatacagacataaataagtcacggcccatgaccttgaagagcttacggccttataaagaggttcactgtaattgtcttcaccagggcgtccttctcaaagatgcccacttttgtctggcacattggggctcggtggtctggtggtcccttcggtcttggccctatctgtcctttgtttttgtgatttactaacaatcatcacgaaccagttttgtttttcttttaaatttgaacatcacatcttgtgttttagttttttgctcttatgatttttttctcactgcttttcagtcttctctgtacttcatttttgtgaaaaagtgaaaatcacatataatctttatttaaaaatgctcaccaagcactgcagactttggagttagggattcagcagcttgttccagtgaaaaggaggagtgaagctggggaagttagtatctaagaggggcaagctgattgcatgtgcatttatacctatgcctttaaaacattcccataaaaagtattaataaagaaatttccattccacactagtactgatgaaaaggtggttgattttgccttgtgataattatcaaaggatagtttttcatccttagattttattcacatgagagattttttttattttctctgttgacttaggaacacatcataaattcacaccaactgacacgttgctgacgtctgtacttgacataaccatttttattcatacaggaagcattaaatataaaagatggtcagttttgaagagcaaagggtgctgaaatgacttgtacggttggctggtgctttctcaaatggattgccatagttcattactagtaaagaaaaggaaaatgtgatttacgttgtcatttttcctattaaaaaaaacccttaagaatggggcacttgagctgtccctgcaatgttttcatatctagtagtcattttagggaaagtgataatctgtagaatgaatagttatgttttgatatgactgatactttctttgttaaaaggttgtattaagtcttcaatttcaagtgtagcttaaaagtgtaaacattatgtgattcatttgaatacaagaatgcctatgaaatacccactataacagcattccttttgtgtttagaactattgaagaaaatgtcttcaaataaagtagttttcagtcaaaaaaaaaaaaaaaaaaaa

SEQ ID NO: 1491 - DNA, 1105 bp, Homo sapiens
gaattcggcacgagtggcaacacaagcacctagctcagagatcttgaagaatgaaatgagattatgtaaataacaacttaccacagtgcttggcacatagtaagtgctcaatgtcagctatgattattattattcccttcttaacacacaaagaaggaggggatccaaaaataacagtgtgccacagtttgaaaggcatttatttgatcttgtctctaaatttccattttacatgtagcacttacccggtggaagtgaaaatacagtgaacgctaaaaagccctgtgtctctcggtggtgtctggacaaccctggcaactcggaacatgaaggagagaacaagaattccctgtgcttttccttttcttcttttccaaacacgtgtgcagacttcccctgcatttcagccccaccctctttattttactgcctaatctataaaggaggattaacagcagcacgctgctttggcatagagcagattctgggtgaggacctgtaggtagagtttaatgaatacaattttctaggactgtgagtgcatatttttagctccatgctgggcttcagcgttggctcttgagacagatgaacagactctttgatcagacttgggtgttgctccaagaagaacttttctcagaaagtcgttaggaaaaaaaattgtcttctgttgcccttattcctaatgtgcactctatagattcagattccagataacttgtcctgatctcagtaaattaattgcattgcaacattgagttacaccactgtggaaagaaaaagtacttctgggcaggaacagatccactttctcacaaaagagaatggctggtgttcaagtgtgtggttgccatcctttcccttttgagagtagggtagaggtagttaaccttcctgggggaggtttggcctagacaacatcatagacactatatcccccctggagttaccaaacaataaaactgcttcctttgccaaacacaaagaatggtctggagttggatattagcaaacagcaaaccacataaagaagacaaaaaaaaaaaaaaaaaaaaaactcgagggggggcccgtacccaatcgcctgtgatgtatcgtatac

SEQ ID NO: 1492 - DNA, 2457 bp, Homo sapiens
  misc_feature (1622)..(1622): n equals a,t,g, or c
  misc_feature (1713)..(1713): n equals a,t,g, or c
gtcgacccacgcgtccgcccacgcgtccgattataataaaaagtattattaggacaggtaaactcatccatctactgtgagctgctggcttggagaacgacttttgaggagccagtttcctgaggagaaatgcttttataaagcactcattgctttgtaaaaggagacaaaactgatcctaaatgaccactccagggttgctgattttgtttctggctcatgtctgcctagtaaaccaccagcaagctgctgaaccaggctggaaacaacattgttgcaactgggagggacatagagtactgtgaaagcagcgttccaacacatcttcacttttacaaagggataggcagagacttccaacatagaggttcttaaacttcgaggggttacaatccccttgcaaatatttttatagctatggaccctctcctcagatctacagccaacattttcagtgcaccttaggaggtcattttagtccacgcctctgaaaaagctgcactccaacggctgaagagcaagccatacggccgagaatggggctccctttgccttcatgaaagctacttcccccaacactaagactcagctgtacgtttgcttagctcagtcacatttacattcttctgggtgaactgtaccttttgagtacctgccttcattttctagaatcagacctaacaaggtcagtagaagcctgggcagcagcgggcctggaaagacgaggcagccagcatgaactgctgttctctccctgaccacaaggcgtcgtcttcctccagggtcaagtaattgttcttgttccgcctcacaggaatgtggggaggaaggacgttaacactataaaatgctgcgtcctaccttaaacttgtactgtgagaaagctggaaacttccacctgtacagtgggtctggtttgcatgtttagtttcatttgtgggaactgcttgtccaagagtgagctcaggtcagggcagtttgtgcctatgagaattagctcagctatcaggcaggtttttagacacctttttaaaatgtgctcgtgtttggtttgttttgcttactgtcagtcctgggtcaatcaaaggtttgtaagggtgagaatttttatgcactgctatatcgcaagtgcttaaaacagagactggcccagatgaggcattcttcaaatgtttgttgaaatgaatggacaaactcttaggataaatcctaatttgttggcaactgttatttgattttagaaggcaaactgattttattttagagaggggaaggggaggggaggctcattagcctcttggtagaaagaggactatttctgcaaatgaataggtttccaccttaagtagtgacagtccttaacttcttattatggagtgagtcttgaccgctttccaagttcaatagaagttcaagattgcctctcagtgattagggaaattgaagcttttaaagctcctggtctcagtaattcctcagaataaacctctttaaaagggatattgatggaaatgtacaattaccagtaattgaggttttatctgaggggatggagatgatgaaatggttccttcttggaagttgttggcattttggctttatttttcacaaataaagtgaanccatttaaaacgattgacaacgattatatagtgccatgtggaatacaatagatattaatttgtggttggtttttctgcctgctttaaatgnaatgtattatgtttctgggttccttttttagctgtaaaaatacttcgtcactaaagcatgaaatttaatcagcagttgttcttcaagttcctgaaagctatarragtttctcatgacttgagtggttttttccctgcccaccagaggagaaagcccttgtagaattctgcagtgttacaagtgttccctacaaaaactgaaaccatcagctcctctttaacaagttggctttttaaaagcacgtaattacaatttaatggtattctgtaaagtggtgctctaggcataatttaaattctttttaatgactatatttcttcaaaactttgaaagaaaaatgtgttctttttgctgcatcctttgtaagaagactgccaacagaggaaaaaggactttacaaattaagaccatcttggtttcatttccacaaagatgagaacaaatcatggtgttaggaaaggatccttagaagaacacaagaatttgaaagcccttggtggttatcactactatatttcatatttccacagaagtgacttagccaagctctgcattttgagcctgctgactttcatttaaaaggaatgaaaggctgaaaatccaggctgctgtgtctgtagataaaggtcaaaccatgtttgagttcttcactgttgtgtccacctaaataaaactgagtaagtaatgaaaaaaaaaaaaaaaaaactcgaggtcgacggtatcgataagcttgatatcgaaatt

SEQ ID NO: 1493 - DNA, 3374 bp, Homo sapiens
ggcggcagtgtccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattgaagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgtaaaaaaaaaaaaaaaaaaaaaaaaaaaacccccggggggggcccc

SEQ ID NO: 1494 - DNA, 1441 bp, Homo sapiens
  misc_feature (1362)..(1362): n equals a,t,g, or c
  misc_feature (1364)..(1364): n equals a,t,g, or c
  misc_feature (1421)..(1421): n equals a,t,g, or c
aagttggtttcggctgcagaggggaaggcggctaccagtgtaaagccagagctgaggttcttgatagtccacaatgggtgaaccacagcaagtgagtgcacttccaccacctccaatgcaatatatcaaggaatatacggatgaaaatattcaagaaggcttagctcccaagcctccccctccaataaaagacagttacatgatgtttggcaatcagttccaatgtgatgatcttatcatccgccctttggaaagtcagggcatcgaacggcttcatcctatgcagtttgatcacaagaaagaactgagaaaacttaatatgtctatccttattaatttcttggaccttttagatattttaataaggagccctgggagtataaaacgagaagagaaactagaagatcttaagctgctttttgtacacgtgcatcatcttataaatgaataccgaccccaccaagcaagagagaccttgagagtcatgatggaggtccagaaacgtcaacggcttgaaacagctgagagatttcaaaagcacctggaacgagtaattgaaatgattcagaattgcttggcttctttgcctgatgatttgcctcattcagaagcaggaatgcagagtaaaaactgaaccaatggatgctgatgatagcaacaattgtactggacagaatgaacatcaaagagaaaattcaggtcataggagagatcagattatagagaaagatgctgccttgtgtgtcctaattgatgagatgaatgaaagaccatgaaagatgtttctttttctttttttccttttgataatagcatcatatattagttcattttcttttggacagtcttaagagaagtttcactaaaaatgtaaacagctttaatcttgactccaaatttttcaattatgagatgtcataggcagtaatttcgctgtataacaagcatagacaaatgagtgtccctgcactaagaagaatcactttaaaaagcaaagtgttagctgctgttgtatgggacattcctatgttttagagttgcagtaaaactttgatgataacctcaataatagcaaagttttcgtctttgaaaaggggatttagcatttgctttaagaatgatagataaatggatattaagctctctacatgtaaaactatgaaatctttagacttattccattaaaaattttgcttaagctccaaaaagtagcataacatgttgatagagaggagcccagtagagttataaaatagaaacttcattttttcctcatgactgcttctgtaaacccactagctcagtcttttctccctatcctgaatggactcttgcagggaagtccccataaatgttgttttntngccagtcactccaggggaataagtcctttggggcactttaaagttacagacattaantttaagtaattaagatggcc

SEQ ID NO: 1495 - DNA, 889 bp, Homo sapiens
  misc_feature (117)..(117): n equals a,t,g, or c
  misc_feature (292)..(292): n equals a,t,g, or c
  misc_feature (341)..(341): n equals a,t,g, or c
tgttaggttaattattgcttcacatgtggtcacggtttgaaaacttattttggggggagtataaagtagaatacagagattccttgctcatagctcctactgctatcggggaacaanccttgagggtgagaacgtggattgattcttgattgatagtggggattccattatctgtatttggcagttatggcctgctgcggtgtatagaagcttctttccattcattttcccgaattttcatactgctcaaggaacagttgggggggaatgggcagaaggttgggcacttgangtatttgagctatcggtaataactgactttttagggcgcacagatttgnagtagagccatggtagtagttagtaccaatgggtttttgctgcttctactctttcttaacagaaaaagtggattgtgttcatataggaaagcagttcacagactgtcttcctgcccctcccgccaccaagctggacctagaatcaagtgtgactttaaatggggaaagctgtgttacagttgtgcttaagccactgctgtggcttaacctcacctatgcataagaatttgctcgtggctggccgggcgcggtggctcgagcctgtaatcccagcactttgggaggctgaggcgggcggatcacgaggtcaggagattgggaccatcgtggctaacacggtgaagccccgtctctactaaaaatacaaaaaaaattagccgggcgtggtggcgggcgccgctagtcccactactgagtcccaggctgaagcaggagaatggtgtgaacccaggaggcggasttgcarcgagccgagatcctgtcactgcactccagcctgggcgaagcgagactctgtctcaaaaaaaaaaaaaaaaaaaaaaactcga

SEQ ID NO: 1496 - DNA, 971 bp, Homo sapiens
gccaccgagccgcagttcctgggtcgcgcggcagctgtgagcgccgagggcaaggcggtgcagaccgccatcctgggcggcgccatgagcgtggtgtcggcctgcgtgctcctgacccagtgcctcagggatctggcgcaaccccgacggggcgccaagatgtcggaccacagggagaggctgaggaactcggcctgcgccgtgtctgaaggctgcaccctgctatctcaggctttaagggagaggtcttcgcccaggactttaccgccagtgaattccaattctgtgaattagcaccccacccccataccccttcttccacccccagactaaaggaagatacttactctctgcccctctccatttataccaaagaaatcataggtgaaaccccctaccctccccaacgttaaatgctcgagaggaatcttccacaaggcagggccatgcacgcaacctgcacacgcacttggagggcccaggtgtctctccaccagcccccatgcagtagggactggaagatatgtcatctgctggttgtgttatcactcccaccccctaccccagcccgtsttccggaatttctcaactaaatttsattattgggcaggaaggaggtcatgggttcatttcatttttgttttttgtgtttttaattaaaagaaaggttacctcagttttcactccttagacatggatgtagctacctttttttgtatgtctttttttttttaagcaatcgtgttgaattaggagtatacttggtgtggaaagagtatgaatttgccatgtgatttgcaaatggggggaagctactgtgagcgtgtgtttttttaatttacactatagagtgatttttttttcccccaacgtcaagtttttaccttgcatgtactggagtatttatttcatctattaaaatgttatgtttctcagaaaaaaaaaaaaaaaaaaaaaaaaaaaaaactcga

SEQ ID NO: 1497 - DNA, 2483 bp, Homo sapiens
agcaggcggtgcgctgggggcgggagcagcgcgkagcccggctcggccacaccgatcgcccgccgccatgggctcctcgcaaagcgtcgagatcccgggcgggggcaccgagggctaccacgttctgcgggtacaagaaaattccccaggacacagagctggtttggagcctttctttgattttattgtttctattaatggttcaagattaaataaagacaatgacactcttaaggatctgctgaaascaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctctgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataaaaaaaaaaaaaaaaaaaaaaaaaaaaaaaaaaaaaaaaaaaaaaaaaaaaaaaaaaaaa

SEQ ID NO: 1498 - DNA, 569 bp, Homo sapiens
  misc_feature (1)..(1): n equals a,t,g, or c
ntaaggtgttgattctggatcacgggataccattcctgtcmacaccccgaccaggggctagaaaatttgtttgagatttttatatcatcttgtcaaattgcttcagttgtaaatgtgaaaaatgggctggggaaaggaggtggtgtccctaattgttttacttgttaacttgttcttgtgcccctgggcacttggcctttgtctgctctcagtgtcttccctttgacatgggaaaggagttgtggccaaaatccccatcttcttgcacctcaacgtctgtggctcagggctggggtggcagagggaggccttcaccttatatctgtgttgttatccagggctccagacttcctcctctgcctgccccactgcaccctctcccccttatctatctccttctcggctccccagcccagtcttggcttcttgtcccctcctggggtcatccctccactctgactctgactatggcagcagaacaccaggcctggcccagtggatttcatggtgatcattaaaaaagaaaaatcgcaaccaaaaaaaaaaaaaaaaaaaaaaaaaaaactcga

SEQ ID NO: 1499 - DNA, 1060 bp, Homo sapiens
gaattcggcacgagggtggaggacaaccgtttacctccrccccgctggaaatcctgttctttctgaacgggtggtataatgctacctatttcctgctggaacttttcatatttctgtataaaggtgtcctgctaccatatccaacagctaacctagtactggatgtggtgatgctcctcctttatcttggaattgaagtaattcgcctgttttttggtacaaagggaaacctctgccagcgaaagatgccactcagtattagcgtggccttgaccttcccatctgccatgatggcctcctattacctgctgctgcagacctacgtactccgcctggaagccatcatgaatggcatcttgctcttcttctgtggctcagagcttttacttgaggtgctcaccttggctgctttctccagtatggacasgatttgaagtacagaatttcagccagcagcccatcaggctgacaccacacatattgcttctggtactttagccacaccagtgagaattggtggggcaagttgtcctgagaaaggctgtgtggcttttcttcagcacagacatttgggcaagcaactcagcataaggccagtgggtaccatcttctaaaccaggaccatcagcccaagagactcttctacactccagtatagggaggggcaaggttattcccatcctgccccttctcagaaccagtcccctgctgacctcaagttctcctccttgatcaccgtggccagagcatctcgtgtggaccatctaggctccttgggcttcaagcaggacctgagccacatgctccctgtacgagctgtgctatacctgtcccacatgagcacggagagcctcatgttggtgggtttccagagtgatgtgaaagcctctcaccccaatcctcggagactgagttccacaacttttttagtagctcatagtgttatttttctactctcttcatgaaactaactttattttataataaatatrtattttctgttgtgggggaaaaaaaaaaaaaaaaacttcgagggggggcaccggtacccaatcgaccc

SEQ ID NO: 1500 - DNA, 1060 bp, Homo sapiens
gaattcggcacgagaatcaatctacaccctcaagcagtttgtagtctgctggaatgacagacttaaaaatgcttataactaaaatattttatgtgcaggactagggtttttaagctaaaaggctgctttttaaattgtgaaatataaagtacatgtagaacaatgcataaaacatgtcaacagttaaacagatagttatgggattatactttgtgtatwtttatgtttgcttcttttattcaacattctgtggttcatctgtgttgcttgtagcatcatcattactgtagcatactttatttgttctactgttggtggacattactgttgcttccagtttttggctatcattaacaatgatgctaagagtgttcttgattatttgtcttggtatgtttgtgcacgcaccaataatatatatctaggaatggaatcgttgggtcatagagaatatacgtagcttttaagtttactagataagtgattttccaatttaaaaagacctttgaaacgtttttctacattggtggtttttaaagttatctattttctcatggaatttggttttctcatgagaataaggtaggaatggttgtatgttgctaatatgtagttcaagtgccctttctacctaatctggattgccaggaatatgcttgaaatgccaaatcatgacttagtattttmctgtggtaattggagtagtctttgacacatcaggaagtatgggaatatgggaaagatctttgagagtggaaactataccacagttttgtttagtgctaggtaggaaaggtgaaaaaaaaagcgcgagagtatattaagtatacaaaaagcttagtggttttaaaatgttaagctcacatttggaagtgtaattctattttaatctctttcctaatggaggaagaaagatgactgatgtggtagggtaatcttgtttgaaaaattgacaactctggcatacggcccagatctcttttcagattttgtgtgaaaaagaaaaatggcagcctcttagtgctattcattggtgtaaaaaaaaaaaaaaaaaactcga

SEQ ID NO: 1501 - DNA, 1170 bp, Homo sapiens
ggttaacatttgtggatgactgaagattgatggaatgctactatgccaaaccttaattgtgatattattttcataactgaattattttagaaatgtatcaattgactgctgctcagcagtaactaaaattcctcaagtatttgattaaacagaataatgtcaaaatttaaaccttcccttaaaactttatacataagacatttatgattgttcaatttttataatctatttgtggattttgttaaaagatttcacatgaagatttattagttgccatttaaaatttttatatgtttagttaaaagatttgacatgaaaatttattagataccatttaaaaattttatgtgttatgtgtttattctttgagaatgttaccttactgtttgtaatagtgctacatttttctgctttcaggcctctgtattttcacaaaacaccaaaaacagcatttaattatattatcatgagtgtgtttctggacacaaacttctgcagtagaatgacctaacatgtcgttttcattgcagtcattataggattgaaatacgttcaaaataacctctctaggaaagtcttctgctagaatttctcccctctattcattataatattctttgtttttaaagccagtcaaatataatagtcttaataagatcagaaactctccaggagagtgagtctaccctcacgtccttgtaggatgatcttgattatagtcttattataggactataactgtattctcaacatttctccagaaaggaccttgtaaaaaggtcttttgtaccacagtattggttttttcccctctctcttcacttaaaaaaaaaaatagcaaggcagaaatagtgtattgaaaagttgttcatctattatgaagtccttgagtggtgaaaaatccgttgtacatgagaacatttctatgcatttaagccagaaacgaggtacatggctgtgtgctcttctgtcaaccaatgaaatgtgttttcacatgtgtggcagtgcaagtaaataacacattatttgactgaatcaggcatgatactgcaccaaagtgttggtacatattcacggtagtaaatcagtacccctgttaaaggatttatcccattgcttcatattaataaaatggttacaatatatcaaaaaaaaaaaaaaaaaactcga

SEQ ID NO: 1502 - DNA, 872 bp, Homo sapiens
  misc_feature (2)..(2): n equals a,t,g, or c
tngcagttctccacaccgaagaggacggtgggcgccaacagacaggcgattaatgcggctcttacccaggcaaccaggactacagtatacattgtggacattcaggacatagattctgcagctcgggcccgacctcactcctacctcgatgcctactttgtcttccccaatgggtcagccctgaccyttgatgagctgagtgtgatgatccggaatgatcaggactcgctgatgcagctgctgcagctggggctggtggtgctgggctcccaggagagccaggagtcagacctgtcgaaacagctcatcagtgtcatcataggattgggagtggctttgctgctggtccttgtgatcatgaccatggccttcgtgtgtgtgcggaagagctacaaccggaagcttcaagctatgaaggctgccaaggaggccaggaagacagcagcaggggtgatgccctcagcccctgccatcccagggactaacatgtacaacactgagcgagccaaccccatgctgaacctccccaacaaagacctgggcttggagtacctctctccctccaatgacytggactctgtcagcgtcaactccctggacgacaactctgtggatgtggacaagaacagtcaggaaatcaaggagcacaggccaccacacacaccaccagagccagatccagagcccctgagcgtggtcctgttaggacggcaggcaggcgcaagtggacagctggaggggccatcctacaccaacgctggcctggacaccacggacctgtgacaggggcccccactcttctggaccccttgaagaggccctaccacaccctaactgcacctgtctccctggagatgaaaatatatgacgct

SEQ ID NO: 1503 - DNA, 536 bp, Homo sapiens
gagaaatggagctttgttagataaaaattttttcaacgcaaacagtcattttccagtgaaaggagagcgtatccgccgtaggatggacttagatcgtgtaaaagctgaggccaccgaggatataacctccggggtcctttgcctccttttccttagactccctccaaactcgtgtatctttccttcagcagtactgggctccacgcgaacctagtcctttgtctttaccctattacctttcataacatcctagttgaaaagtarttattcaaccgcgtttgaaaatgagaacaggttcacagargctaggttacttgcgaaggtcgttcaattagtaaccagtaacgccaggactgccagtttcttgcttccgaattctcatggtagctttcaccargctccccgtcmaatgctaacgtcaactactgaactagattagcaaaaaggtcttttaacagaattcctggttttcagagagagtttctttcatgaagcgccccatttctacagaggaaaataaactccaagcagccagt

SEQ ID NO: 1504 - DNA, 1255 bp, Homo sapiens
ttcccaactttctgccacacttaaattacgttcctccatttcagttttgtcttttctgtctaaagttcagtcaaagagtatcaaaaaattatgtttcagctagactggtgtaatgtataagtttttgtatcttgtattagaggatttcgtagcttttattagaggctcatttccacctcagcatacaagatcgttagtcttttggcatgtgtgccaattagaatactaaagcaagtccaagcacatttttctcttctcacgtttctaataagtgttagggactttgcctcttttacttaccacgtccccaaaagtgtcaggtagacatgtcacaaatggctctgtagagagccatgggaagagagaggaggtggatgtggaacataaagggttcagaaactccagaagaggagtgggttttggatagaagcatttgaggacagctgctccaaagccttatgtgtatgatgaaacttaaccacggggaagagactcttcagtagcctgttctgtctggtgatttttattttaagtgaacctttggatctatctttaactctctttattgtgagtctaaattccaattctgcagcagatcagtaaactcacagtatttttcctgtggaaatctattcaataaggaaaccaagacaggataataaaatttaaaaaaaaaacaactttgaattcccctgcctaggtcttccagttgttttccagcacatacctcaggtatgactttgctagcyggggacaaaattagcaccttccgawtctctagtccaaatgaactttgtgctaaataaaaaattattatactacataataaagttacagayagcaggaaatgcaagagctaggagattcctagattatatctgccaagcaaataccttaaacatccacctgaaatcctactaccccctcttctgagataatttgcccagcccttctcttcccacacactcactcaatgtcacccccttctaatccccaaaactgtttttgtggtctttgtagcctatagtagttttctcacatctttccccctagacttttctgtttttcagtttcagacaaaaaaactcttcagctttttccagtgtgtctccttaacagtaactttaccacttgaaatcttatttcatagaaaaactaaattggtgtggaaaggctgcacacaataaagttatattattatccatgaaaaaaaaaaaaaaaaaaaaaaaaaaaaaaaaaaaaaaaaaaaactcga

SEQ ID NO: 1505 - DNA, 734 bp, Homo sapiens
ggcacgagttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcccattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaagatctcttttgtttaaaaaaaaaaaaaaaaaaaaaaa

SEQ ID NO: 1506 - DNA, 2506 bp, Homo sapiens
ggcacgaggaggaaccaagatggcggctctggcctacaacctgggcaagcgggagatcaaccactacttcagcgtgaggagcgccaaggtgctggcgctggtggccgtgctgctgctcgcagcgtgccacctcgcctcccgccgctaccgaggcaatgattcgtgtgaataccttctctcaagtggcagatttcttggagagaaagtttggcaacctcacagttgtatgatgcataaatacaaaatcagtgaagcaaagaactgccttgtagataaacatattgcatttattggagattccagaattcgtcaattgttttattcttttgtaaaaataattaatccccaattcaaagaagaaggaaataagcatgaaaacattccttttgaagacaagactgcatcagttaaagtggattttctgtggcatcctgaagttaatggttctatgaaacagtgtatcaaagtgtggactgaggattccattgcaaagccacatgtgattgtagcaggagctgccacatggtccatcaagattcacaatggtagcagtgaagcgctttctcaatataaaatgaacatcacctccatagcaccacttttagaaaaattggcaaagactagtgatgtttattgggtcttacaagatcctgtttatgaagatctattaagtgaaaataggaagatgatcactaatgagaagatagatgcttacaatgaagctgcagtcagtattttgaatagtagcaccagaaattctaaatcaaatgttaagatgttcagtgtttccaaattaattgctcaagaaaccatcatggaatctttggatggcttacatcttcctgaatcgagcagagaaactgtgagaaatttttacatatgtcagtagatggagactataatatcaattgctttaagccataagtcattataacatggttataaataatttgttttattgcagtcttagtaacttgtagttattgtgtataaagatacatctagaaattattttgctttctatcatctagttgaatatatacgtaagagttttggtatactctaagagagaaagaagttagggaagaggggaaattaaacttcatttactgagtgctaatcactgttaatatacattgtctcctcagaagcatatatgttctcagcacactcacatgtaaaaactactgcttctatgttccccttaccttaaaccttaagctttcaagattaagcttcaatgaagaatacacttcttaatgctgaaaatattttttattatttccctatagctcttctggccaggcgcagtggctcatgcctgtaatcccagcactttgggaggccgaggcaggtagatcacttgaggtcaggagttcgagactagcctggctaacatggggaaaccccatctctactaaaaatacaaaaattagctgggtgtggtggcacacgcttgtaatcccagctactcgggaggctgaggcagaagaattgcttgaacccaggaggcagaggttgcagtgagccaagatcccgccactgcactccagcctgggtgacagagagagactccatctcaagaaaagaaaaaaagaattcttatagctcttctatcctaagcattattcaagatacagagtacatactgaacaaatccaagttgacctatggaaagggatttaggttaagtatgaaggagaactatgtaactacaaattttcacaaacagtggaacaaattattttaagtttttttctcttattaagcagtggttcttaacctttgtgagagttgcataagccctttgagtatctgatacaagacaatggttttgttcttctcctgcagaataatgtgtatgtttgcatgtacatatggttctccatatacataaaagggcttgatgaaccccctaaaaactggttaagaaccttgcagtggaatttgcaggctagtatctgcaagagtgccaggcataaaaccacctgcagtctcagggctaaaaggatgagattttctcaaatcttgattattttgaatgtttaggcttaaataactaatcatctagagttccacagatgcctaaactatgaagtttttataaaactagagtttgactgaatcttcaactagacagactcaactttcccagaataattttattataatcaaaccatgttgaaggttctaaattttatttaacattagatatcttaaaacttgtagaatcctaaatggcctataaactgtaatccaaatgaaaggcatattacaaatattgctagctaaaaattaataattttttagtggcagttattttgtgctttttttcccccacatttaaacagtagactttatcttaagtggcctggtatcttctgttttgaaagtcttctaattaaaattctttggtccttgatgtctgtcagcattttttaactaaaggtcacaacccattaacaaccatgaaattggtgttgggaagaaaaaaaaaaaaaaaaaa

SEQ ID NO: 1507 - DNA, 675 bp, Homo sapiens
ggcacgagagatggcggcctccgtgtgcagcgggttgctggggccacgggtgctgtcctggagccgagagctgccttgcgcttggcgcgccctgcacacctccccggtctgcgccaagaaccgggcggcccgagtacgcgtaagcaagggggacaagccggtgacctacgaggaggcacacgcgccgcactacatcgcccaccgtaaaggctggctgtcgctgcacacaggtaacctggatggagaggaccatgccgcagagcgaacggtggaggatgttttccttcgcaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctatcttgaaaaaaaaaaaaaaaaaaaa

SEQ ID NO: 1508 - DNA, 3189 bp, Homo sapiens
ggcacgagctgccgtggtaccagcctccagcctgcccccaggactgcccctgacccaggcgcgcccgctgctcggtggcaggagggccggcggagcgccatggcctgcatcctgaagagaaagtctgtgattgctgtgagcttcatagcagcgttccttttcctgctggttgtgcgtcttgtaaatgaagtgaatttcccattgctactaaactgctttggacaacctggtacaaagtggataccattctcctacacatacaggcggccccttcgaactcactatggatacataaatgtgaagacacaagagcctttgcaactggactgtgacctttgtgccatagtgtcaaactcaggtcagatggttggccagaaggtgggaaatgagatagatcgatcctcctgcatttggagaatgaacaatgcccccaccaaaggttatgaagaagatgtcggccgcatgaccatgattcgagttgtgtcccataccagcgttcctcttttgctaaaaaaccctgattattttttcaaggaagcgaatactactatttatgttatttggggacctttccgcaatatgaggaaagatggcaatggcatcgtttacaacatgttgaaaaagacagttggtatctatccgaatgcccaaatatacgtgaccacagagaagcgcatgagttactgtgatggagtttttaagaaggaaactgggaaggacagagtccagtctggctcatatctcagcacagggtggtttaccttcattctggccatggacgcctgttatggcattcacgtctacgggatgataaatgacacctactgcaagacagaagggtatagaaaagtcccctaccattattatgaacaaggaagagatgagtgtgatgaatattttcttcatgaacatgccccatatgggggtcataggtttatcactgaaaagaaagtgtttgctaaatgggccaagaagcacaggataatatttacacatccaaactggacattgtcttgataatggttttcctgatcttgccgcatcacttaatgtgatccccatactgcaactgtgatgctgatgatgctaatggagatgatggtaatgataaagacaacaacaatgattatcaagttcctgtacactctcagatgtggatggtgactctgctagtaatttaaacttggcatttcatggaggatggttgtgctcatgatgttctttctggaggttcaacactacgtaccgcactttataatttaactggaattgagatgaaggccagtgacatgacaactgtgacctaagaaatgggaagattatctttcaagatagctgcctagaattgttcgacagtgagtaacttccagaagccaaaagagtttggcttcatgaggcaaggtgattgactcaatggcttgttgaatctcagcagttccgccatcttgaagaatgattgattgtcaaacactgacccaagaactgctatcagggtgcaagtatcttactagttagcctaaggatgggaaaatatctcttcctaatataccatctttctacagtatttcctacagctaaagcctcaggccattgcctaattaacaatgaagatttcatggacatcctacacttcaggattacttgactatctcaaacacataaatcaaaatgggccaagtagcaaatcttgatgaatttccactcttaccatccattcttactaccaacagtataactgaacatgtgattagaatgatctatattaatgtttagttatttttggttgagtgctaaatatttcagaaggctacttaacatgtaagataccaacttcaacactgtaataacatatactgtgaaaacattcctaaaaagtaaccaaagggtttgctaactctgcttcaacatccaacaacacaaaactatatgatttttaaaatcatgaaatagagacagcaaagcatatttttacatcaatttgtatcctatcatacttcataatatatatttgtatattcaaatttctattttataggcccaaggtgtgtttctccaaacattacattctcattgccaagtgccagctgttacacatggagaggaaatgattccttatattaaacctgaccagagctttttgccttctagggatttatttttcccatagtgtatcagttgttatgccacaataacaacaataataatgttcttaatgtccaaagtgctttgtcatttagagtcctttaacatctgttataccatgtgatgcccttgaacaccccattgggctattgtctgtgtattctgctctctttagcagatgatctgtaatttggtcattgttctgttatattccagattgctctacttgctaatatttgtatagaatagaatttatgtaaactagtaaccagttgatctctgtgccaaatacattatatcaggattacacaaaaagtatcacaaaggatggtcttggccatatgctagggcccctgtgaaaataagtagttttgagaagtttttctatatacgtatatatacacgtgtggttctatttaggtggggaaaaaatgaaaaagcagggacaacaggaggaaatgaaggcagagaaatatagtttcctttcctaggattgagacaattctatttttcatatactcgttgctcattaaatagtaaagggttgatttgctgcaagagtagctgagaattcaaaaacatccttgcagaatgattcaaaagacaaaagccaggctcaacttatagaatgttttggaaactggaagtaatgatacatttcacttcagaagcacttgtaggtctttactagtgctaagtattatggtgagctatcattaaagtgtgccatcttggataaaggccttttgcctactctcttctgcaattttgacacctcaatattcacacccataaacattactaagccccagttctatcgttggaaggagttgttattcttttgttgttcccttatgcaatttttaattctatgaatgttaagtttttttgagctaatgatagatagaaatgcccactcaaagaaaaataaacagagacaaatgttaaaattgccatacagactgtttttccccctgttgtttcactttaaaataaaaagaaatccttgattaatcaaaaaaaaaaaaaaaaaaaaaaaaaaaaaaa

SEQ ID NO: 1509 - DNA, 3335 bp, Homo sapiens
ggcacgagagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcaccggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaaaaaaaaaaaaaaaaa

SEQ ID NO: 1510 - DNA, 847 bp, Homo sapiens
  misc_feature (651)..(651): n equals a,t,g, or c
gggaaaatgaaggcatatatgataaaaaagaatgaacatactctgtacatgtttgctgtgtgtgttacagcatcagagcgcctctgcctcatatgccctggggaatacccccaggcacagacagtcactcccgaggccctctgggcaaacatctgtcactacttcatgttgcaatctgcttacagaactaaggcacccatcttccgctgactttggacatcagagctccaggttctctctcctagaactgagacacccatctgctgctgcctgtggacatcagaactccaggttctctctgttagaactgagacgcccatcttctgatgcttttggacatcagagttccagattatctctcctagacctcagacatacatctgctgctgcctttggacatcagaactccaggttctctctcgtagaactgagacacccatcttctgatgcctttggacatcagaactccagattctgttttctagacctgagacacccatctgctgctgcctttggacatcagaactccaggttctctcacgtagaaccgaggcacccatcttctgctgcctttggacatcagaactccagattctcaggcctttgtactctaggatgtgtagcagcaacccctgccccaggttttcaggnctttggcctcagacttcaagctacacctckgrcttctctggttctgaggcttttggacttggactgagccatgytgcaggcatccctgggtytccagcttgcatatggcctgttgtaggacttctcagcctccataatcatgtgagccaattcccttaataaatagcttctcacttatctaaaaaaaaaaaaaaaa

SEQ ID NO: 1511 - DNA, 1940 bp, Homo sapiens
ggcacgagggaagatggccgtgccctgtttttcggtgtaaggcagcgacggcggctgcgacggcgagactgagatcctggtgtcgtgggcacctgagttctagcttcccccagcgagcgcgcgtcccttcgtgcctaggcgagagccggctcttccccgggagatgcgtttgtcccaggctcgggggctcagtgggagttcatgctgcgctggaggctcttggccaccgctctaatcgccttgtgccgccgcagcgccagctccgtcgccagcggtgagcctcccgattcccccccttgcccctggcggcggcgatgaccggggagaagatccgctcactgcggagggaccacaagcccagcaaagaagaaggggacctgctggagcccggggatgaggaagcggcggctgccctcggcggtacctttaccagaagcaggattggcaagggcggcaaagcttgtcataagatcttcagtaaccatcaccaccggctacagctgaaggcagctccggcctcctccaatccccccggcgccccggctctgccgctgcacaattcctccgtgactgccaactcccagtccccggcccttctggccggcaccaaccccgttgctgtcgtcgcggatggaggcagttgccccgcacactacccggtgcacgagtgcgtcttcaagggggatgtgaggagactctcctctctcatccgcacgcacaatatcgggcagaaagataatcacggtgaggagtgctagcccctctccacctctctccttccccgagcctagggtgtgcctccccaggcttctggaatcctaggccccctccagcagactcttctttttgcccatcatccgggccgttcggtaaatcatgatcgactcagtaatagcgtgccagtggtcaaggggttggttcttgtgggtgcaaaggaatgtatcctccttgcccacttcaaagtttgtcgtgagaagctgttttgtttgagacaggccttcgatttgctgattctggactgtcagaaattttaggttgcctcccacccaacatggttttctccctttgtttatggagctatatatctttatttctctctcttccccctaccttggcattttaaattttgaacgcataaattgccctcctcccttcattgctcacatacagatcccatcttgactgcaactggttgtgattttgcctgccaccaggttgtttcttttttgtctgctttcagtaaacttagaatgttagatttctgaaagccacacagtagaaatttgttggtatttgatacgtagaacagttaaagtgacttctcaacagccgatttttgtttgagtagagatttgattttttgcttgttttaagtagataattgctaatagtaatgtctcatcttgatgactgtgactaaaaatagtattatgatttttatggtaattttatcttagtcaatattgaccatttctttttgccttgtcagctgaattttttgtttaattctaaaaaataatgtgactgagttgacttttaagcaacagtaaatttattattgaagactaatgtgaacactgacattttaacatttaatagccgttttaaactgggtagttggcaaatattgttgatcgctctgctattaatatgaaattgtatacattcagttagaacacactgaaccaactttgtgctcaaaatgatatacgtatcaatgaaatatttgcctgtgaaataagctcacttaattccattggatcgtaggctttttaggacaaaaattcagataaaaaaaacgagtaagatttctcttggctgtataattatctaacaactgcatttgttttcagaatttacaatgttgtaattgtaataaaatcaccacctatcatttatcataaatccccaaaaaagtaaaaaaaaaaaaaaaaaaaaaa

SEQ ID NO: 1512 - DNA, 2322 bp, Homo sapiens
ggcacgagctcgtgccgaattcggcacgagcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaat

SEQ ID NO: 1513 - DNA, 2737 bp, Homo sapiens
ggcacgagatccctaaacaagtctttgtgtggacatatgcttttacttctcttgagtaaatacctaggagtggaattgctgggtatttttaactttttaagaaacaagctgtttctcaaagtggttgtatcacttgaaatcctaccagcactgtatgaactccagtttcttcatatccttgccagccttgatatggtcagtctgtttaattttaggctggtggcaggtgtctagtggtaaagtagctcattgtggttttatcttctgtttccctaataactagtgatgttgagcctgttctcacgtgcttatttgccacctgtatttttatttatttatttgcttattttgagacggagtctcactctgtcgcccaggctggagtgccgtggcgcaatcttggcttactgcaacccctgccttctgggttcaagcgattctcccacctcagcctcccgagtagctgtgtctacaggcatgcgtgaccatgtctggctaatttttgtatttttagtagagatggggtttcgccatgttggccaggctggtctcaaactcctggcctcaagggattcgtctgccttggtctcccaaagtgctgggactgcagatatgagccactgggcctggtggccccctgtatattttttaaatgtcttcatattgtttactcatttttcaatttggttgtttggcattactgaattgtcctttatcctagattcatgtatatattttgagagtgtcttttgaagagcacacttaacttttgctttttgtgtgatagttaaaaaaatcattaccaaacccaagaacactaagattttctcatagctttacctttagaaggtttataattttagctcttatattaagtacttggatccatttcgaggtaatatttgaatacatatttctaagggtgaggtaagttcatttttttttttaaacgtactgctatctaattgtcctggcaccatttattgaaaaaaattacccttattgaagtgcctttgtatctttgaaaatcaatgggctgtatatgtgtgagtctcttcattttgtttcattgatctttctttacaccagtactattacttaaataatgtagctttataagtcttgaaaattaggagaagtgtaagaccttcaattctttttagagttattttggatattctacatcctttgcatctcctttaaaatgttataattagcttgtcaatttcgacataaaagggatgctgctggcatttctattaggatgcattgcagatatagatacatttgggaaaaactgaaaatccaaaacattggactcagtattccaatccgtgaacttaggtatctctgcatttatttaggttttccttcagcagtgttttgtagttttcagtctcatttgttagatttatcactatttcatattttcgatactgtgtaaatgttactattaaaatgccaatttctggttgtttccaggtagtttatatacagattatttttgtatatcttgtttcctgtaacttggctaaacttaataggttctaggaactttttttttgtagattctgtagaattttctccatagacaattttgtctttgaattgagacaatttttactttccttccaatgtggacaccttttatttctttcgcttgcctgttgtgctagctaaaacttccaatacagtgttgaatggaagttttgagagtggacgttcttgtattagtaagtgtaatgttagctgtagtaaacatttaaataggtttagggaattcctttctgtattaatttgctgagggttttttttccttagtctgggtcttgctctgtggcccaggctggtgtgcagtggtgcagtcacaggtcactgtggcctcaaactcctgggctcaacctgtcctcctgcctcagcctcttgagtggctgggactaatgcaccactatgcctggctaattgtttggggggccaggggggtggagatgggatctcactgtattgactacactggtctggaactggcctcaagccatcatgccatctggcttcggcctctcaacgtgctggcattacaggtgggagccatcgtgcccagcccactgagcgtatttattaaggaacagaagttggattttgtcaaatatctttttctcctgcatttagtaagacagtcatacagttttccatataatgctggattacattggttgatttttgattgtaggaatcctagaccaacttggcattcccagattaaatcttactttgtcatgatgtattttcatgatgaataatccatgttggattattttgttaagaaaatttgcatctgtcgtcatgaatgacattggtctgtacttattttttaccttctaggctatttgtctggttttggattcacggtaatgtgggtctcatagaatgagttggaaaatgtactgccctcttcacttttctggaagagtgtgtgaagaattgaaattttttttttccttttttttttttttgagacggagtctcactccagcccaggcgacagcgggagactccgtctcaaaaaaacaaagagaggaaagaaagaaagaaaagaaggaaggaaggagaaaggaaggaaggaacgaaggaacaaaggaaggaaggaagaggaaggaaggaaggaagaaagagagagagagagaaagaaagaaagaaagaaagaaagaaagaaagaaagaaaaaaaaaaaaaaaaaa

SEQ ID NO: 1514 - DNA, 2907 bp, Homo sapiens
attatggcccgctaacactgaaggttatagaacactcccaagaaacagcaagacaaggcctgaaagtatctgcagtgtaaccccttccactcatgacaagacattaggacccggagccgaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcrgggrtactcccctcaacgaacttacagatcggaagtgtcttcaccaattcagagaggagatgtgacaatagaccgcagacacagggyccatcaccctaagcatgtctatgtgcctgacagaaggtcatgccagctggcctgactttacagtstgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccmagagatagaaatgcatgcagatacccagcagcattcagacagtggtgttmcaaagggatgatttacaaaatggactgcttartacgtgtcgagaactttctygagccactgscgaattggaacgaagcatggagagaatatgataagttagaatacgatgtaactgktaccaggaaccagatgcaagarcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagassatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatgrcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttcttttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttacygcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttcttaaaaaaaaaaaaaaaaaaaaaaaaaa

SEQ ID NO: 1515 - DNA, 1629 bp, Homo sapiens
  misc_feature (1)..(1): n equals a,t,g, or c
ngacagggattaagtgccttgcccaaggtcaggcttatctccagagggaggtgccctggactggggcccagatgttcagggaccctgcctacacctcatttccagtgtgggctgccttagttagttatgagaacagggaagggctgggaagagacagcctccaaggtcaacacttggagagggtttcacttgctctgaagaccctggtccaggattcgccctctcccatgccttcaagtcagcatcaggcttagggcaaagaccaggcctctgaagctgcctcttgtaattcatgcaggaagatgtcaaagtcagccccatcttggctgatcagggtgttcagccttaaccccacctgtgttctgaagtctcttaccctacctgctcaggactgagacagttattcactgaacatatttattaagcacttgctgtaggccaacagttaagaatccaataatgaaatggacagattcatggaacttagagtccaataggaaagtgagacccagacaatgacaatgagataaatgttaggaagggggaggtatggggtgacttccctgcagtcctgggggcctagatgggcccaagactgggtgagagtcttggcagagcctttgcaacaccttaagtggacaggactgggaggtcttggtggttggagccaacgtgggttccctgcggctccttagtcacctctgatagcagattgagggaggaaaacaggtaaggcatgaggaaatggccaggttgggttaacccactggtttcaaccagttcaggaatgaggttatttggccatgactggctgatcttgagctcaaggatctgcttcaaatgcacacaggcctagttgaagtttaaaccccagcaaaacattcctccctgtaaatggaaaatcctacttctacccccaccctgccctgttttttgttttttttttccccaagatcattagatgtcctcacccctcctcactgcctctcctctctgggacaggctgggacctttgaggaagataaagccttccttgactacccatcatattcagtgtccctgttcctcactcagagaggaaggcagaaccagtcaggcttatttcagtaagttccacagttctacaagactgcaggaattctccttaagggaggagagcaagcaggtgtggccccagcttctggaaatggcagaagagagggttttctcattgaatgggggtgggggctcgtgtgtcctgggaaaccccatcagtcccttcatttcttgagactcaactcctgggaggagagggtctcaagagttgtccctggaaggagggcgggggcagtctgcatctatttcaggttgtggctcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaacttaccaacgtcttgattggtgtattt

SEQ ID NO: 1516 - DNA, 706 bp, Homo sapiens
ggaaagaaatccctactgtgtggcaccaggacctgtgtgacctgcaaggcgcctgttttcctcaacaaagcctcttttataccacttgctccccacaccaccctggccccttccacttgctcaaaaacactgagctccttttcactgtggggccattgaatatgctgttttccctccctagaaccttttcctctcattcttcacctgcccaactcatatttatccatgcagcctcagttttaatggcatttcctcccaggccttccaagaccactctccctcaggcagctttcctgacatctttagcctgcccgctcatgctctctaccttttttctgtatcaaaatgcctttgtttgcaagtaacagaaggcctgacttaacctgcctttaaacagtaaggacacaagtatgcctatgttattagaggtctgcaggtaaggcacgtaaagggtcatctttttccagtgtcttcaactccatttctctgaggttccatcagctacattctgtgccatgactttatcctcagtgcatttttcagatggtaatcaaatggctgtaacatgttcacctctagctcagcatgatactcagaggaagaatagagttgcttctaggagttttgtgatgagaatgagggaatttctttccctggagcctccagcaagcttgtcattaagtacctcctcaggtttctggctcga

SEQ ID NO: 1517 - DNA, 643 bp, Homo sapiens
  misc_feature (115)..(115): n equals a,t,g, or c
gaattcggcacgagaaactatctacaaggatgatgtttccacaaagaacttctcacaagcagaaatgggaggccaagacacacatctaaacagacctttcagaagcacttgcaangcacacaggacatgttgccgtacagcctgccttttcacatttcctgtacttcttctctgagccaccatcttcaycctcatctgttgtctctgttgctttctttttcgcctaagggagtcacagctgatgttaaaatttcactgatgatggcaaaatgactaaggatgaaggttcactactgaaatcacagctgagttctaaacatgaaggtcaaaaacwtcatggcagtaggttagggatgacaatacagcaatttcctggtgactgcattgtgcaagtaatttactaacttgctagagatatagaaatagcattttaacaacagatgtctaagccaagaactaaattcatatgagtctttcttagaaaaaagtgacatcagctgggtgtggtggctcatgcctgtaatccccagcactttgggtggctgaggtggaaggatcacttaagctcaggagtccaagaccagcctgggcaacataccgagacctcctctctactaaaaaaaaaaaaaaaaaaaaaactcga

SEQ ID NO: 1518 - DNA, 3042 bp, Homo sapiens
ggcacgaggcatgcctaagattttcaggacagaagtcaagtgtaaatgatgatatattttgctcttctattagcatcccttttttttctgcttaaagttaaaagtcactttggatgtaaaaatgtaactaccacatcagccaggatttttttaaagccattgtgtactccaaagtctattttccctctgagtagatatggaagaatgagctcctaagagactagcctaatcaaatttaaaagcaaatgtaaatttaaatcaaccatgcagccctgctgtgtggcaattaacatttcaaggtaaaatgaaatgtgatgatagtaaataccagttctacgcagaatcggaaacattctgttccatggtatatttgggcagagaatggaaagttgaaaggaaaaccattattaacacaccaactttgacatttcaagatataattcaaacttgattagaacttccactaaaaataaagtcttctattaaaaaaatcacagtttcccccacctcataggctacatcacagcctctcaaccttggcactctggacattttggactatctaattcttaggggctttcttgtgcattgtgggacgtttaactgcatccctggccctacatactagatgccagtagtaactcaccttcttccatcattgacagctatgaaaatcaaaaatgtctccatataatactgattgaagaatttagggaactgggttactactcactaggcttaccagtccctaactgtgtgttttgtttgtttgtttgttttgggttttttgtggtttcttattcctcccgtatcatatttcaacttaaatatatgaggatttatagtagttttattaagctctaaaatgatctggttgaatcttcctattacttttttaaagggaaaaaacactatttcagagacagaaagtcctcgagggatggtctttgggggataagcagaaggaagtatgatatgaaaaaagggtttaaaattgtttgcagcaaaagcaaaactaccagagccatgcatattttttataagtgtcatccaagagtcggaatttttacagttgttgttggttaccatggatattagtttgaaggacttggaaaagtggaagaggagggttgtgggtagtgggatgatggccataatacatttcctaggagtgttcaagaagtaaaatttacgttctatgtaatttgtataatttttctgaaaagaaaaacttttcaggtaaaacaggtattattatttataccttactgatcaggagctgtatagttctgagttaagtgactcacctaaaattatgatctagcaattacgttggctcaagcttcttttcttctacttagaaagtggaggaaagcatttgccttctgaaggcggaaggctcattgctaattttcagtgttcacaaaatctgctgctgtggtatttctggggcttctgacaaggacaggaagccacacattggtgaagcatccatgcattggcagcactattgctggataatggagattctaatttaatcagcctgagttagggaaagcacaatacaaatgaacactttgtaaagatgcttgatttgtcatgatcagaacagaatatccaggtagacctggtgcttcttcctttattgtgtttgttcatcctggtccttttctaagacatcagttgctcattgcccctttccccagatcatctgatgtgattgtgacatgtacacttggtgtgattgtgattaacaatagctggccagtgggcactgctgctggttgcggcaaactcatcctttcttcctgatgagaaatcacttttattggacgttatccttaatcaccagtcaaatgagcctctcttgaaatctggcttctctgtaacctgctgctaccacatttactctattggcatcaaacagggtcgtatatcaatgcaagttaatttcttgaaatctgttaaagaggatgatcttttgctctgtagcatgcagattatgttggtaaacttagtaatacatagtaatacattggagttagcacaggaatagggcaattctgttctttttcttgttgcaaagctaggggacaggtaatttattatacacgtattcaccctgaataggtcagaaccatgaaatttaagaatccttcattggaggctatcaagtcattggggagattaaatctacattgtactttaatctgccggatggccattgccatcagtaaaatgtcggatctgtcggcattgttaatgtaaggggcaccgtctgggtaatcatcaactgaatgcagtgacaagtaattttattgaagtaccaagtaagaacttaaccctcttgatttttttcccttgaacccattttcttacttttgatggaatgaggacatttttagaaaatacagtgagttctatgtcagttttaaacaaaatgtttctcacccttacacctaaatttagttcatctgagaggatatgccaagaagaaaagaagaattaacagattaccaaaaaaaaaaagtaattttacaaaatttaaagcactctctttttctatctttgataagtcactatttttatagtaatcctttggagtatttacattttgcttctgaacagagagacaaattcttctcccaccacgtatgtactggagtcgtattaatccttgatattgctggaactaacttttcataatagaatatgttctctttcccttttagactgagaatttagtaggtaaaagaagaaatacagattaaactttgagcttcttaaataattcaagatgataggattttacaaaagcttagaagtcagatattaaaaatggaatctgtattctgcagttgttgtataccagtataagcttgatcacaaatttttctgtttataaaatataaaatcacaatttgatacatacgtgtataggcactctattcatgcttaggaaaatataactgtgaagtgaattgtaagtaattttgtaagtacttactatactgatatcagaaaaaaaaaaaaaaaaaaaaa

SEQ ID NO: 1519 - DNA, 622 bp, Homo sapiens
gcaattcggcacgaggggccctctcctctgctgactcttgccatttttccaggcctcccctcagtgaggagaccaggcgatgggagacaggcatggtgctgcttctgctgctccagagaaaccctgggacacctttgttctgcttggttttctgggctgggctcaggaaacctgcccagttcaggcctatattgggtccaagctgcccctgtgctgcttctgtcaagcgaggtgtggacattccaagttcgtaagcatgaacaaaagaaaagaggaacccagcagatgtaacagaactgactccagttgtgtagagttttgctaaactgtttatccccttttgctgtggtttacattaatggcaatagttagccaggtgtggggaatgagagtgcattgctcgatagggtctgatgaactgggagtaacccaccattgcaattggggattgttttgcaaggaaatagtatttttatgtgggggaccagcaaaatctctacattagtgtaaaatttcaaatagttgttttatcgttggtttggtttaccaacaaaaaaaaaaaaaaaaaaaaaaaaaaaaactcgagggggggcccgtacccaatagccctctcatgtatcgt

SEQ ID NO: 1520 - DNA, 574 bp, Homo sapiens
ggggggcgaattcccctggcacgaggctgacgcatgcgcatagctaaccgcacccggttcagctcgcctttcttggccagaggcgccggttggactcacgggcggggcatgatggtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgtaaaaaaaaaaaaaaaaaaaaa

SEQ ID NO: 1521 - DNA, 3285 bp, Homo sapiens
cccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaaacagttagtctggagcctgtggcccaggcccttctgtccccaggcatcatcccaacagctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgaaaaaaaaaaaaaaaaaagggcggcccgctctagaggatccaaggcttacgtacgcgtgcatgccgacgtcata

SEQ ID NO: 1522 - DNA, 3043 bp, Homo sapiens
ggcacgaggcatgcctaagattttcaggacagaagtcaagtgtaaatgatgatatattttgctcttctattagcatcccttttttttctgcttaaagttaaaagtcactttggatgtaaaaatgtaactaccacatcagccaggatttttttaaagccattgtgtactccaaagtctattttccctctgagtagatatggaagaatgagctcctaagagactagcctaatcaaatttaaaagcaaatgtaaatttaaatcaaccatgcagccctgctgtgtggcaattaacatttcaaggtaaaatgaaatgtgatgatagtaaataccagttctacgcagaatcggaaacattctgttccatggtatatttgggcagagaatggaaagttgaaaggaaaaccattattaacacaccaactttgacatttcaagatataattcaaacttgattagaacttccactaaaaataaagtcttctattaaaaaaatcacagtttcccccacctcataggctacatcacagcctctcaaccttggcactctggacattttggactatctaattcttaggggctttcttgtgcattgtgggacgtttaactgcatccctggccctacatactagatgccagtagtaactcaccttcttccatcattgacagctatgaaaatcaaaaatgtctccatataatactgattgaagaatttagggaactgggttactactcactaggcttaccagtccctaactgtgtgttttgtttgtttgtttgttttgggttttttgtggtttcttattcctcccgtatcatatttcaacttaaatatatgaggatttatagtagttttattaagctctaaaatgatctggttgaatcttcctattacttttttaaagggaaaaaacactatttcagagacagaaagtcctcgagggatggtctttgggggataagcagaaggaagtatgatatgaaaaaagggtttaaaattgtttgcagcaaaagcaaaactaccagagccatgcatattttttataagtgtcatccaagagtcggaatttttacagttgttgttggttaccatggatattagtttgaaggacttggaaaagtggaagaggagggttgtgggtagtgggatgatggccataatacatttcctaggagtgttcaagaagtaaaatttacgttctatgtaatttgtataatttttctgaaaagaaaaacttttcaggtaaaacaggtattattatttataccttactgatcaggagctgtatagttctgagttaagtgactcacctaaaattatgatctagcaattacgttggctcaagcttcttttcttctacttagaaagtggaggaaagcatttgccttctgaaggcggaaggctcattgctaattttcagtgttcacaaaatctgctgctgtggtatttctggggcttctgacaaggacaggaagccacacattggtgaagcatccatgcattggcagcactattgctggataatggagattctaatttaatcagcctgagttagggaaagcacaatacaaatgaacactttgtaaagatgcttgatttgtcatgatcagaacagaatatccaggtagacctggtgcttcttcctttattgtgtttgttcatcctggtccttttctaagacatcagttgctcattgcccctttccccagatcatctgatgtgattgtgacatgtacacttggtgtgattgtgattaacaatagctggccagtgggcactgctgctgtttgcggcaaactcatcctttcttcctgatgagaaatcacttttattggacgttatccttaatcaccagtcaaatgagcctctcttgaaatctggcttctctgtaacctgctgctaccacatttactctattggcatcaaacagggtcgtatatcaatgcaagttaatttcttgaaatctgttaaagaggatgatcttttgctctgtagcatgcagattatgttggtaaacttagtaatacatagtaatacattggagttagcacaggaatagggcaattctgttctttttcttgttgcaaagctaggggacaggtaatttattatacacgtattcaccctgaataggtcagaaccatgaaatttaagaatccttcattggaggctatcaagtcattggggagattaaatctacattgtactttaatctgccggatggccattgccatcagtaaaatgtcggatctgtcggcattgttaatgtaaggggcaccgtctgggtaatcatcaactgaatgcagtgacaagtaattttattgaagtaccaagtaagaacttaaccctcttgatttttttcccttgaacccattttcttacttttgatggaatgaggacatttttagaaaatacagtgagttctatgtcagttttaaacaaaatgtttctcacccttacacctaaatttagttcatctgagaggatatgccaagaagaaaagaagaattaacagattaccaaaaaaaaaaagtaattttacaaaatttaaagcactctctttttctatctttgctaagtcactatttttatagtaatcctttggagtatttacattttgcttctgaacagagagacaaattcttctcccaccacgtatgtactggagtcgtattaatccttgatattgctggaactaacttttcataatagaatatgttctctttcccttttagactgagaatttagtaggtaaaagaagaaatacagattaaactttgagcttcttaaataattcaagatgataggattttacaaaagcttagaagtcagatattaaaaatggaatctgtattctgcagttgttgtataccagtataagcttgatcacaaatttttctgtttataaaatataaaatcacaatttgatacatacgtgtataggcactctattcatgcttaggaaaatataactgtgaagtgaattgtaagtaattttgtaagtacttactatactgatatcagaaaaaaaaaaaaaaaaaaaaaa

SEQ ID NO: 1523 - DNA, 1185 bp, Homo sapiens
ggcacgagcttatgtctatgttttgagatagaatccttctattttatagcagggatgggcaaaccacaagcaaggggccaaatccagcctgctgcctgtttttgctaaaaaagttttattggaacacagccatggccattcacttccatatcatccaatggctgcttttgtgctacaattgccaccatgcccagtggggcctgtggcacacaactgcagaagtgagtggttgtggcagaaatcacttagccttcaaagcctaaagcacttactatctgaccctttccagaaaaagtttgctgacctctgttttagagatacaaactaacatacttacagataagtgatctgaatatgaagcaaattttcaacataatctgggttgatggggaaccgtgttacatataaacaaatccagagctaatcattgccaggtgagggctgtgcagacgatcacgacactattctcttttgcatatgttttccataataaaaagtcttttgaaaaaatcaatgatttaggggtttaaatatactgtagtcactttggaaaacagtttggcagttcctcaaaagttagacatagaattaccctatgacccagcagttccctttctagatatacccccaagagaattaaaaacacacattcacacaaaaacctgcacacaaatgttcacaggagcattgccttaatagcaaaacaagcgaaacaacccaaatgcccatcaggtgacgggtggataaacacagtgcggtctgtccatacatggaatgtgactcagccacaggcakgaatgaagcgctgacacacgcagcaacacggatgaaccgtgaggtcacggagtggagtgaaagataccagtcatgaagtcacacaccgtatgatgccattgacatgaagtgttcagagcaagtaaatccttacagatggaaggcagagcggtgactgccagggactaggagtggggggccagggggtgactgctaatgggtatgggatttcatttcggggctggtggaaacgttccggagccagagagtagtgatagctgcacaactctatgtatatgctatgaatcaccaccgaatggtatatttttaaaggacgaatttatggtatgtaaattgtgtctcaataaagctgctatcttaaaattcaaaaaaaaaaaaaaaaactcgtag

SEQ ID NO: 1524 - DNA, 334 bp, Homo sapiens
  misc_feature (321)..(321): n equals a,t,g, or c
agaaaatgaacaaactagtgagaaacattgtaaacatatagtgtagatgataactctgaacttaagtacaagataatgatgaatattctgctgcttaagtatatcttagaaatattaattcttagtgaaaatcttaacctattcaacatcacttatggtaagtataacttatttttcctatacaggtattaaatatataatttatatgccagtcacatttcctcacactaaataaggcagcagacacatatatttaatatcatgggtatgcattttaggttctaaaacctaaggtatgtggatttcttaaagccatatctnaaatattttcacc

SEQ ID NO: 1525 - DNA, 406 bp, Homo sapiens
  misc_feature (34)..(34): n equals a,t,g, or c
  misc_feature (46)..(46): n equals a,t,g, or c
  misc_feature (100)..(100): n equals a,t,g, or c
  misc_feature (378)..(378): n equals a,t,g, or c
  misc_feature (388)..(388): n equals a,t,g, or c
ccctgggtgggggctggcccctgaaagtaaaccnagtctgacctcnttcctccgggaaggcctaaaagagacacagatagcctcctcttttaccctggcnttaaggaaaagcccattttattaacaaaagtattagacacgactgccataagaaatttgctgtgtgagaataaagaacaagggagtaggagggtgggacagagaagggtgagaagttggccttccgtgagggccacctgtcagttgtcctttgtgccttgtgacatcaaaactgaaatgtttgtattactgttgtcccatgactttttttttctgtgtcagacatacaaattgaatttggttgtaatgttttaaacgtaataaagaattcttacctanaaaaaaaaangagggggggcccggtacc

SEQ ID NO: 1526 - DNA, 1011 bp, Homo sapiens
  misc_feature (951)..(952): n equals a,t,g, or c
cggaagaaagcagccatccagacatttcagaacacgtaccaggtgttagctgtgaccttcaatgacacaagtgatcagattatttctggtggaatagacaatgatatcaaggtctgggactgcgccagaacaagctaacctacaccatgagaggccatgcagattcagtgactggcctgagtttaagttctgaaggctcttatcttttgtccaatgcaatggacaatacagttcgtgtctgggatgtccggccatttgcccccaaagagagatgtgtaaagatatttcaaggaaatgtgcacaactttgaaaagaaccttctgagatgttcttggtcacctgatggaagcaaaatagcagctggctcagccgacaggtttgtttatgtgtgggataccacaagcaggagaatattgtataagctgcccggccatgctggctccatcaatgaagtggctttccaccctgatgagcccatcattatctcagcatcgagtgacaagagactgtatatgggagagattcagtgaagatatggactggaagactccaaggccgcttgtctttgagacctcagactgcataagtgatgccaaatgttggatgtccaggytagcaccctcccttcagatgaccattgctagcaagaaacaggaggcggtggccatattccaaaaaccacttctgtcccatttcaccaggatgactaaggcaagctccctgtggcctctaaaaaccacctgccagatttcagggactgtttttttttttctttttcttttttcctgttttctaatgcaggcccaatgtgacaaatttgttggttgggatttttttttttttttgtaactggcttgtatgatattttctttctgtatttctctatatcattttgtattaaaagccaaatagatgcctttttacaagarmaaaaaaaaaaaaaaaaaaaannaaaaaaaactgggagggggggcccggtacccaaatcgccggatatgatcgtaaacaatc

SEQ ID NO: 1527 - DNA, 1844 bp, Homo sapiens
ggcacgaggccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacgtaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgcctactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaaa

SEQ ID NO: 1528 - DNA, 1672 bp, Homo sapiens
gaattcggcacgagtgaacctgtggggcaagggggtcttccctgggccccaagagtgcagagatgcctgggtccgcagcctggcagggcagctgcagctttccccagggagcttccgccctgccaactctgagagggtggggctcctacttgttgctggctcccactggttctgtggagcatgcagcaccagctgcacctcctcatatgctggggcaagggctctaagtccaacacatcatgcctgggcccagtgctaagctgctccaacatgtggagtctggctctgctggtagtggctggctctatgggggtagcatacagctctgtggtgatgtacgttttgctctgggtgccgctcccacttccttcccacttccttccttcaggggcccctgaagcacagcccacaacttgggcccagtccccacactccgtgtgcaagtgtggcaccamcttgggcccagctaaacctcagggcccctctttgcctamtcctccatgcctgatcatgttgctgtcctgccgcaggcagctaggtctggccccatcawggtggctgccggggktgggttcccatggtggcgaactccggggatgctcccaggggtgggctccagggattgcccacctcaatatctgcacctgatgacccttggtctgtccctgttccccactgcagctgacatcatggtastgatcacttcamacaggctgccgctgtcctcacatacaatttataatttaaattagaaagaaacataaataaacgacataagattttgaatataatctatgtaagtaatttcaaaatatgttttattatcttctccatgctagagaacattttattagtttatattttaactaattttaaaaacgtaaacataaaattacatgtgttgtcaagctaactcaatcgatgtttgagataaaaattaacctaagaccaaagtatattattttgatttccttagaggaaaagttatgcagtaattacttgaagagtaattctctctacmattagcattgcagatgcatccattataccactaaagtacacttaataaataatacttaagarryyaccagacaccatakggaaaaataaaaataaaaagtcattttgaaaaaagtttagaaagtaaatcattcctagaatgcttggaaaagtatgtgcctgtgtgccagtatttctgatcctaagagttatgaatatcttatgaatagttatgaatatcactgatagtgaacctgagtgtaaatgcttgggcttgggktgcagatggactacagatacaaatctaaagtagtgtwcctagtagcactgtaactcagttaagtacttactttttcatgccctcagtatttttatctgcaaaataggaataaaatagctaatcatgttatcataagggttaagttatgagatataataactatgaagtacttaatgggtaaaggaaaaaataagcttagcagttgttgttgttgttgttgttgacgaccttatttcaccatatacacttgttagtaactcaaaggggttctccaaagtgaaatatttaaaaaacgaatgagataaattattattttgttattagaaaatatatttagcaatttgtctcactggatcataaaactaattgtggtatgagaacatttataaaaca

SEQ ID NO: 1529 - DNA, 647 bp, Homo sapiens
  misc_feature (1)..(1): n equals a,t,g, or c
  misc_feature (69)..(69): n equals a,t,g, or c
  misc_feature (614)..(614): n equals a,t,g, or c
  misc_feature (632)..(632): n equals a,t,g, or c
nccaaagttcgaaattacccctcactaaagggaaccaaaagctggagctccaccgcgttggcggccgcntctagaactagtggatcccccgggctgcaggaattcggcacgagagctgccttggctcggcttggtctgcggcctgtcaaacaggttcgggttcagttctgtcccttcgagaaaaacgtggaatcgacgaggaccttcctgcagacggtgagcagtgagaaggtccgctccactaatctcaactgctcagtgattgcggacgtgaggcatgacggctccgagccctgcgtggacgtgctgttcggagacgggcatcgcctgattatgcgcggcgctcatctcaccgctctggaaatgctcaccgccttcgcctcccacatccgggccagggacgcggcgggcagcggggacaagccgggcgctgatactggtcgctgacagcgccaaagagaccaacaagatgattttagcgtggactaggacacttaacctaagaagagtttcacttaatcattcaaatcactatctgaagggtcacggagcgcaaaataaagtttaaaaccctgctaccaaaaaaaaaaaaaaaaaaaactcgaggggggggnccggtaccccaatttcgncctatagtggagtcg

SEQ ID NO: 1530 - DNA, 1839 bp, Homo sapiens
ggcacgagctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggcgcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcaggtacaggtctttgagtgtgtggggaggcccttctcccagcacactgccctattccagtgggaggggggcctggggctttccccttctctccaccatctgtgaaccagctcttgaaaggggtcacttccaacccacctgccatatcctgacctcccgcacagaggcaggtgagaggctgtgcgtcccagcctcttccaactcctcaacagggatggctgaaggggcaggaggaggagtccccattccaaaccccgggtttgtccatcctccatccatctcactcacaccttagcagggccagttttcatttatttcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcacctggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatggtaaggctcctgcaggggtgccttccccacatcccccacctgatggctggaggtgtcataggaggggggcaggctgtcacctgaagctatctctgtctcccgaaggaccctccccgggcctctcgtgcccaccaggtccagaccctgctcagcttacgccaggactcacacacaggtgcccacaacctgacgaccaagggtgatatttcactcacagatgttggaattttaaaaattaattagtatcattttaaaattgggagatttcacatcacaatcttatttttggattttctttaaaaatgcacattccaggctgggcgcagtggctcacgtgtgtaatcccagtactttgggaggctgagggcggatcacaaagccaggagttcaagaccaacctgggcaatatggtgaaaccccatctctactaaaaatataaaaagttagccaggtatggtggcacaagcctgtagtcccagccacttgggaggctgaggcagaagaatcacttgaacccgggaggcggaggttgcagtgagccgagatcgtgccactgcactcaagcctaggcaacagagtaagactctgtctcaaaaaaaaaaaaaaaaaaaaaa

SEQ ID NO: 1531 - DNA, 776 bp, Homo sapiens
ggcacgagggaagagagaggggagggtgagcagaggacaggccgggagttttccgggaacggaggaagagcagtggaggctgccaggatgaggctgctgtgtggcctgtggctgtggctctccttgctgaaagtcctgcaggcccagaccccaacccccctgccactcccgcccccgatgcagagcttccaaggaaaccagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcgaggccagcactgtgacacatggtcttatgtgctgataccggcagcccagcctgggcagttcactgtggaccacggtgtgggcaggagctggttgctgcctcccgggacgctggaccagttcatctgcctgggcagagctcagggcctctcggatgacaacattgtcttcccagatgtgactggaggtgccctggacctcagcagcctgccctgggtggcagccccagcctgaccactcagacagccgcggcccccaaggcctgactcttcttgtgggagggcgaggctggtcaccccaggccagcgtctgttgaaggatgaagcagctcctgtccggcccagccctgcctcacagctgtgcgagctctgccctcctcagctctcaaacctgaataaatgcaccaagcccagaaaaaaaaaaaaaaaaaaaaaaaaaaa

SEQ ID NO: 1532 - DNA, 2521 bp, Homo sapiens
ggcacgagctgaggtccagccctcgtgaactgatctgcggctgcactcaaccttctcgccagtctcaggatgaggtggccttgccccacctcaaagcctgctcctccacctgtgctctggagccacctctgccagcatcgctggggcctcaccccagcctctaccttgctctgctggctcttgctcttcaacctaggaacgtgcctgagcttttctcatcttaaacaaaacaacaataacagcaacacaagcaaaatctcctttgaccctgcatccctctgttgggttatcatcagcttatcattcccacccttcccatcaaaacatctcaaaagagtagtctacactcaacactctccatttcctcactaccctcttactcctcaacctgctgcaatttgacattcacccccagagttgctttgacctcctaattaccaaatcagtgggcccttgtcagtctctgtgtctgctgcattgatgctgtttaccaccccctcctcaaaaaatgcctgtgcttattactagttcctataaagtgctgaaacccaaatctgtctagccctggcccctcccccaagattcagcctcctgtactcgactacatgtcagacatctccccttggatggcccacaggcaccttactgtgaccaaaagagaattggtcgtctcagtccccatctcaactctaaagtgatcttcctcctctgttccctatctcacttggtggcggcaccatctaccctgtcctgttgactctcgaatacttcccaaatctgaggttttgtgttgccgtgtctacttcccttagtgtctccttccctctatcagactaagcttttcaagggcaaggactctacatcagctgtccgtgccctagcacaccacacaagtctaggcaccaaacaggcctcagtaaatgtcgttgaattgaaccgtgctctgctctctcattcccagcagtgctgtccttggtgggagctgacccagtgcctggggaatgaatgaagtgggagtctggatgccaagaccctcttagtccctgatccccctattgagtccaaaagtctttctttaaccctgatggcatttgggacacagaggtatttgtaaggttttaaaagtggctttgtagacaaagtcagtcaaggcaagacttccaggagttggaactgaacagccacattgccagatgtgtgctccagactagaagtgatgtggatgggtgggcaattgggaggagaaccaaaagggcctggatgagtcagagtttcaagaggaggcatttgaacaattcaagcaggagaaagaataaagcaagtttcaaagtccagaaggaacatggcatgtgtatataatgggagggagggagtgacaagagcagcatggagaggtttggataggtggccttcaaggtactttccaatcctaagtgcctgcagagtggaagctgctggtctcggagaagtctggaccacagagatcttctcccaacccaagcataccagagggatgcgacacatgccggcagtaacagcggctcacttggcatcttcaaagccatggggcagggcctgccagacgaggagcaggagaagctgctgcgcatctgttccatttatacccagagtggagaaagcagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgtaaaaaaaaaaaaaaaaaaaaaa

SEQ ID NO: 1533 - DNA, 894 bp, Homo sapiens
ggcacgaggtactgccgggctgccgggtccctgctctgggtacttctctgctttcgggcgtctcgtctagaagctgcagcttggcctgtctcacctctacacagaggggctgctggcgcctgacggaaaaaggtccacacacccgatggccggcccggggtggacgctgctgctactgctgctgctgctgctgctgctggggtccatggcagggtatgggccacagaagaagttgaacctgtcccataagggcatcggggagccatgcgggagacacgaggagtgccagagcaactgctgtaccatcaacagcctggccccacacacgctctgcacccctaagaccatcttcctgcagtgcctgccctggaggaagcccaatgggtacagatgctcgcacgactcagagtgccagagcagctgctgcgtccgcaacaacagcccgcaggagttgtgcacgccccaaagcgtcttcctgcagtgtgtgccctggcgcaagcccaacggcgacttctgcagcagccatcaggagtgtcacagccagtgctgcatccagctgagggagtacagccccttccgctgcattccccggaccgggatcctggcccagtgcctgcccctgtgatgtgagctcgaacctgggcgcgagggaccggcctgggccctgggatgttcacgcaggaccgcgttgcgcgggggctggttccagcggaagcttcccttacggtttgtgctgctgtttctggggctctgaaaatctgtgggaactgaaaggctgtgaccagcctggtggcgcgaagtgtctgtgagaacaaatcccaggcactggggtgtagcctgattgttaaacatcaataaaggctcctggccgactgaaaaaaaaaaaaaaaaaaa

SEQ ID NO: 1534 - DNA, 825 bp, Homo sapiens
gaattcggcacgagattacacagcagtatgtgtttattgtagaaatgattgaaatcgaaatgttaaaattaaaaaataatttctgttctaactcccaatttgataaatagctctctatccatatctctatatttatctatttctctgtatctatttgtggtttttgtccagttagatcatgctatttaaactgttttttagcttgattcttttttcatttgttgtctcgtgcatcttttctgtatcaataaatattcccctgtaaggacatttgaaaaggttttatagcattctgtttatggacataccataatttattgaatctaatttcttttgccaaacacttaagttgttccaaatttctggttattataaacagggcttcacaactctccttgtgcatcattttgacattcatttctgattattttcttatgaaaatttcccaattttggttttactgagtcagagtgtttccctagaatatttaaaaatatgtggctgaaaaatgaacttattgctgggtgcagtggcttatgcctgtgatactggcaccttgggaggctgaggtgggcaggtggcttgaagtcaggagttcgagaccagcctggccaacatggtgaaacccgtctctactaaaaatacaaaaagtagtcaggtgtggtggcgcatgcctgtagtcccagctactcaggaggctgaggcacgtgaatcacttgagctagggagacggaggttgcagtgagctgagatcgtgccactgcattccagcctgggtgacagagtgagactctgtttaaaaaaaaaaaaaaaaaaaaaactcga

SEQ ID NO: 1535 - DNA, 1904 bp, Homo sapiens
ggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactarmaaaaaa

SEQ ID NO: 1536 - DNA, 2601 bp, Homo sapiens
ggcacgagggcaatccgggcttgcagacgaggtaaggtcgattccatttggcccggggatggtcacacgcgcgggggccggaactgccgtcgccggcgcggtcgttgtcgcattgctctcggccgcactcgcgctgtacgggccgccactggacgcagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgggcgcagacttgtcccacgtgttctgtgccagtgcggccgcacctgtgattaaggcctacagcccggagctgatcgtccacccagttcttgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccacgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagctcttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccgacgcccttcattccccccgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagctgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcgtctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaaaaaaaaaaaaaaaaaaaaaaaaaaaaa

SEQ ID NO: 1537 - DNA, 2623 bp, Homo sapiens
ggcacgagggcaatccgggcttgcagacgaggtaaggtcgattccatttggcccggggatggtcacacgcgcgggggccggaactgccgtcgccggcgcggtcgttgtcgcattgctctcggccgcactcgcgctgtacgggccgccactggacgcagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgggcgcagacttgtcccacgtgttctgtgccagtgcggccgcacctgtgattaaggcctacagcccggagctgatcgtccacccagttcttgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccacgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagctcttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccgacgcccttcattccccccgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagctgtgtccttagggatgttcgcgtccagtaaagacactggtaactgcggtttcagccaacactcttcatggcagtgtcgacctcgggttagcttctgttgtcctttgtggatggttttcctggagcggcctgacgttgacgtgttctctggtcccatgtcttagcggggcatggtacggtttcgtgcctgacgcgtgcattagggtgttctcttatactttcagtagcgtctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaaaaaaaaaaaaaaaaaaaaaaaaaaaaattcctggggccgcgaattctt

SEQ ID NO: 1538 - DNA, 1406 bp, Homo sapiens
ggagcctcgtcgagtctccatgcaggtggtgcgcatggctggccgagagctgcaggccctcctgggagaaccagaggctgcagtgagccccctgctgtgcctgtcacagagcggtccccccagcttcctccaaccggtcaccgtgcagctgcctctgccctctggcatcacaggcctcagtctggaccgctcccgcctgcacctgttgtactgggcccctcctgcagccacctgggatgacatcacagctcaggtggtcctggagctcacccacctgtacgcacgcttccaggtactggctctggtacaccaccaagaactgtgtgggaggcctggctcggaaggcctgggagcggctgcggctgcaccgtgtgaacctcatcgctctgcagcggcgccgggaccctgagcaggtcctgctgcagtgcctgccccgaaacaaggtggacgccacccttcggcggctgctggagcggtaccggggccccgagccctctgacacggtggagatgttcgagggcgaagagttctttgcggccttcgagcgcggcatygacgtggatgctgaccgccctgactgtgtggagggcagaatctgctttgtcttctactcgcacctgaagaatgtgaaggaggtatacgtgaccaccactctggaccgggaggctcaggctgtgcggggccaggtgtccttctaccgtggcgcggtgcctgtgcgggtgcccgaggaggctgaggctgcccggcagaggaagggcgcagacgccctgtggatggccactctgcccatcaagctgccgagacttcgagggtccgaggggccacggcggggggctggcctctccttggcacccttgaatctgggagatgccgagaccggctttctgacgcagagcarcctgctgartgtggctgggcgtctgggtctggactggccagccgtggccctgcacctgggggtgtcctaccgggaggtgcagcgcatccggcacgagttccgggatgatctggatgagcagatccgtcacatgctcttctcctgggctgagcgccaggctgggcagccaggggctgtggggctcctggtgcaggccctggagcagagtgaccggcaggacgtggctgaagaggtgcgcgcagtcttggagctcggccgccgcaagtaccaggacagcatccgacgcatgggcttggcccccaaggaccccgctctgcctggctcctcggctccacagcccccagagcctgcccaggcctaggccccacagacttttaggctggcccagatattccccagtggatgggcagagcccccaccttcaagtctctccagtgtgtggggacgggtccctgtgagcaacaaaactgcactgtttctttcaaaaaaaaaaaaaaaaaaaaactcc

SEQ ID NO: 1539 - DNA, 569 bp, Homo sapiens
  misc_feature (353)..(353): n equals a,t,g, or c
  misc_feature (444)..(444): n equals a,t,g, or c
  misc_feature (480)..(480): n equals a,t,g, or c
tcgacccacgcgtccggtggcagcgggggctgatggaagtgcagtgggggctggagagggcaccctactgtatccagcatgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgnctacttggctgacctcctgatgcctcacttgggtgcagcagaagacccccagacggccctggcamtgaacttcggctctacgttgatgaanaagaagtctgatcctgagggtcccgcgctgctcttncctgagagtgaacttttcatccggataggtagactggcttctttcagcagctctttgctgcaacactgactgagtcaggccattatgac

SEQ ID NO: 1540 - DNA, 616 bp, Homo sapiens
  misc_feature (2)..(2): n equals a,t,g, or c
gncccaacgcaattaatgggrgttagctmacycattaggcacccaaggctttaaactttatgcttccggctcgtatgttgtgtggaattgtgagcggataacaatttcacacaggaaacagctatgaccatgattacgccaagctcgaaattaaccctcactaaagggaacaaaagctggagctccaccgcggtggcggccgctctagaactagtggatcccccgggctgcaggaattcccccccccccccccacacccccttcagctatgcttttggagtcctggatgggaatctggggggagagaggaaggacaggtcaggtctcccccagccccttctgctcctgtctcctcgtgtccgcattgctggagctccacctccctcttggtttctccgcacccgcccattttccttctgyctttacctgcttcgtatcctttccctgctgatgtggctgacccctctcccacccctccctgcaggcggctggccaggtgggcaggtgccagccggagctgtaaatagascgtgcgcttttgtgctggtttgtgcgtgtgctgtatttctgtgttttgatagaagtcacacaaaaaaaaaaaaaaaggatccctcga

SEQ ID NO: 1541 - DNA, 5278 bp, Homo sapiens
  misc_feature (11)..(11): n equals a,t,g, or c
  misc_feature (17)..(17): n equals a,t,g, or c
  misc_feature (1322)..(1322): n equals a,t,g, or c
  misc_feature (5275)..(5275): n equals a,t,g, or c
ggcacaggganaacganctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggtcctttccakkctcagaaaaagaacttrttccrcaaaattgtcagcaaatrtaagcacaaaaaggagaagcccaatgttccggaaaaaggaagtggggrtaaatggtcmaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagwactccagaaatgcctgccgtgtctgcgttctttagcctcgctgcgctggctgaagtggcagccatggaaaatgtgcacagaggtcagaggtcaactccgctcacccatgatggacagccaaaagaaatgccgcagctgcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaanaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgktgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggktttcaaactggcggaattttgacagtgctagttcgagkttgaagcttttgaattagatctctwaatggkgacagkttacatggttttawctagctttcttawttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattrarrraaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgyaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggaccttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaatctgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagaggaacaatgtattgctgaaratggggcagtaggaaggcaaatgctgttgttacatttggacctattaaaggtatttcagagtgactgctagggtaggaatttaaaacttaggctttccccaataggctccttatttttggcaccttattaaaaggtntta

SEQ ID NO: 1542 - DNA, 541 bp, Homo sapiens
  misc_feature (11)..(12): n equals a,t,g, or c
ggacccccggnncaggaatcccccccccccccccccatctgtctctccagatcttacccatcttgtccttccacacgtccccgatgcctctgaagatgccattcatgtttctctcccttccccgggacacattcctaatgttggagttggtgttaggtactttcacttgcaatgggagtttctttattcacaaagcctcttgagtgttgctctcatactattttgtgtgtccttccagggcagtgaccttgacagttatttgtcttgttctcccaagcgcgggtgctaaggacatagtctgtgggcatgcagatgtgtgtgacttgttcacacgaactgtgaggatgaggacttggtgaatggtggaaattcagatccaaactgtatctccagggcatgatggcgcctgtctgtagtgcagttacttgagaacttgggagggtgagttgggaggatttcttgaggttccaggagttcgagaccaacttgggcaacatagcaagatcctgtctctataaaaaaaaaaaaaaggatccctcga

SEQ ID NO: 1543 - DNA, 2511 bp, Homo sapiens
ctgcaggaattcggcacgagcattttcaggcctcagtatggtggcttattctgtccaggttctagccgtatttatcagctgtgcaatattaacccttgcaatgaaaatagcttggattttcgggctcaacagtgtgcagaatataacagcaaacctttccgtggatggttctaccagtggaaaccctatacaaaagtggaaggtaatttggtctctatgacattcaaataagtctctatgtggataataatgtgattgaccaatacagaagaaattgctgcttgtatcaaagagtttgaatgtgtacctttcactccccagacccatcctggctcagtgtttcattccatgggttttgtttatttttccactgttgtttttttttttccccctataagatacctcttgtctcccacatctgtaaacccaaggtttcatatgtttggaatgaactcatgtttctcaacttacctttgacatttgggcaattaagtctcccagggatcttaattgaaattggtatgaactgtccagaccaaaaactcatgaaaccatatataccccatagaggcaccgtacacagtaactgacatgtcagttgattacaagcatgggaaggcctgtgtgtagagtgtgtgcatgcacgcagacacacacacagaatcataaataaaaattatactaggttcttggtacttactatacttaaagttatggcttatattttactttttaaattaatgtgtctttattttgactgaataataaaacattagttacagcagaagagtttaatgtagttgctcttacctatgtagaataagctgtcatcatcctagttgtttcattacttccatccattagatttatcaaaactgttacgctgtcttgaaacagggttatatgtgaatcccaactgcccatgtgtagaatggaaagagactaagtttaatgacaatccatgggctgttctgtgcaaaagcgcaacatgaacctatattaatcagtgatcataaaggaagctaatataattacaggcatcactataacaagtagagcctccaaatcgaaagagaggattgtgcagctttgctcagtatcagcctagccatttcaggagcactgatgtggttttgggtcatgactgtttgccaggaagtatagatagagacagacatgacaattccaaagctgtgtcttaggaggaagtaatgaggtacctatagaggtttactgtacatgagaaacgacttacattcaaaacttcaaagagctattgaataggaaggatgttcaatttatttcaaattgctttagataacagaattaattcaagggctgagaacattctagccatattgtctcctcagagagaccttccttaacagcctgtcaacatattcttccttcatattgttttctgaaccctttaccccgttttattcttcatagctcttctcagtgcatggatgtatttttatgtggtcatttatctgttatcttcctccccacaagaatttaggttccacaaggactaagcctttgtctatcttgagcttgcttatatctccagcatccaagaacagcacttggtatatatttatgtaatggttataacttttgaaatgaatgaataagtaaataaatattaactgtccaaaatgaaaatatactccctctgtaagtaacaaggtccccatcactagaggcattctaccaggagctgagtgatttcgtaggaagcatgctgcacagcaggtcccagcggatgctgcagttgcttcctattccagacttggaagatttcctttctgttggttgtatactcttgaggtcccatgcttcctacctgtggttctttctccatgactctgttgtccctccttttacttcctcttctgttctttgcttttggtttggcttcgtggatattccttggcctttatcacattacatctttcattcaaacatagtgtttatgaaatcagtcctgttatcgcccttaaagaaattctgtgttgaagatataaggagaaagttaaacaaataaattttgcaatttagaaaatgcttgctggtgtcaaagttctttcactaattttattgcagtttccactgagtagggagcatgcaatttcattcatgcatgcaacagatgtttactgaactctttttgtgtaggagacactttgctagatgcagagcagaatgcactgaatcaaacatagactccctgccttaggatcttacctctcagtggagggagacagaaacgttaaggctttctagtctctccttgtctccttttgatacttatatcagaggagactgaccatgacttgaatgtcttgtgacattcctgcaatttagaagaacaagggaagactttttcataaatgtggacaatctctgtgctacaggagtgaggttttttcccgtctttcctctgtgtttttaatggactcataaactcacccaggaatctgtgcttttaaaaaaaaaaaaaaaaaa

SEQ ID NO: 1544 - DNA, 1099 bp, Homo sapiens
  misc_feature (1030)..(1030): n equals a,t,g, or c
ggcacgagccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaagtcctgaatcaccagcccagccttctggctcatcacttcctgcttggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctcccaagctatccaccagtttgaggagcgtcccagatggaacagaggaaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtncacaagttcaagcagttgctaaataaatctccccactccagaagcattaaaaaaaaaaaaaaaaaaaaa

SEQ ID NO: 1545 - DNA, 2780 bp, Homo sapiens
  misc_feature (2760)..(2760): n equals a,t,g, or c
ggcgccgcgggcggggggtcccggggccacgtggacgccgacggctctggtctgcggcgtgtggacactgccagcggctgcagccgacttggaatgacctgggagacaaatacaacagcatggaagakgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaaaaaaaaaaaaaaaaaaaaaaaaaaaaaaggggggggggggggnggggcccccccccccccaaa

SEQ ID NO: 1546 - DNA, 1073 bp, Homo sapiens
  misc_feature (495)..(495): n equals a,t,g, or c
tgaatctattctttgaacattctacaacaagaattacattatactgttataccagagtacttctgcagtgtgaaatagattggtttggaaaatgaacctggctttgctataaattacattcacaggcctttttgcaaatgtgtaacttgcctatcaaagtagtttgtagggcaaatgcagaatatatgtctccatctggtaaagtaccttwtaytcatgtgggaaatcaagtagtatcagaacttggtccaatagtccaatttgttaaagccaagggccattctcttagtgatgggctggaggaagtccaaaaagcagaaatgaaagcttacatggaattagtcaacaatatgctgttgactgcagagctgtatcttcagtggtgtgatgaagctacagtagggrmgatcactcatgmtaggtatggwtctccttacccttggcctctgwwtcatattttggcctatcaaaaacagtgggaagtcaaacgtaagntgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataatgtatcttatgtatgtgctttatattgttatttgtgtatacattaaaataattctgaattatttaatctgatatgttgtattctgtatcttgaaatttttgtttccttgaaacatgcatgcatttaaaaataaagcttaaacaactgtaaaaaaaaaaaaaaaaaactc

SEQ ID NO: 1547 - DNA, 756 bp, Homo sapiens
ggcacgaggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacttgctggtctcttgggatttggccttggaaaggtatcatacataggagtatgccagagtaaattccatttttttgaagatcagctccgtggggctggttttggtccacagcataacaggcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaaaaaaaaaaaaaaaaaaaaaaaaactcga

SEQ ID NO: 1548 - DNA, 1305 bp, Homo sapiens
  misc_feature (1046)..(1046): n equals a,t,g, or c
  misc_feature (1048)..(1048): n equals a,t,g, or c
  misc_feature (1207)..(1207): n equals a,t,g, or c
ctcaaggatccatttgccagttgccctgtggtcttatgggatccaggcacactcatggcagagcaggcccctgctgcaggtttgctcatctaaagctacaagatgagcaggcccaccttcgcttcatttataaagtatatttggtcacaacattgtatgagaagctgcacagagggggcaagttggatcagatttcattataaacatgccttacaatattggttatttwacattttattttattttattttattttattttattttatttagagacaaggtcttgctctgttacccaggctagagggtagtggcatgatcatagctcactgcagccttgaactcctggactctagcgatcctcccacttcaacctcctgagtagctaggactataggcatgtgccaccacacctagctaattttttttgttttgtggatacggggtctcattatgttgcccatgctagtctcgaactcctggcctcaagcggttctcccacctyagcctcccaaagcactgggcattacttscaggagccaccttgcctagcttcaatattggttattaataaggaacagttaagccccattgctttacaataatgctgtagaaatgcttcatatttaaaatgtattatttaaggaatgtaccacttacctgtaattcctttggataaagatactgtttttactagtcaggccttagagaaactgttgtttaagtgaaggaaaaccctgggtcactctgagggcaagattagagctacagctgcagttaaattagtcacacaatgttcctggagcacttacttcagtcagcttaatcttggtttaagtccgccttcccagccttgggccaaggaacaggcaggccaaagcccacccagaaattggagacactgagtgtgtctcctctgccctctttgtcactgggctcatggccccctggcatcatggscccagttccattcccacctgtgtgtgcagagcaacagagtccagatcgtgaggaacgtggtggagaargcagaattctgggcatgtntntgcccagcttacaacaatccctgtctccccctggcgcccttcacaagtccccttttccacccttgcttgtcctgccattcttgccgtcccctcctgccccagggagtcctgctgccccggcctgttcttacactcaaacagtcccgccttctcccactntgcccactgccagcagcagcctggggctccatgctcacttccaactcttgcggatcctcggtctgagccagagtcacctctggcagggatgggcactc

SEQ ID NO: 1549 - DNA, 1422 bp, Homo sapiens
  misc_feature (1397)..(1397): n equals a,t,g, or c
gtttctcttaggttttgaaggtataagtgtaaagtgaagcatctctcgatgattctttccaagataggtttaaaaactatgaatccattttcagtatttycttctctctgtttgaaacagtttgaggatgtgtytctttttcttggcttgatgtttggtasgtccttgaatgggcaagagggcacatgaagtacggcgtcctccacattcacggcctctacacgggacccctgcggggtgggtgctggacccatcggggtataaagacgtcactcaagacgcagaagtcatggaagtcctccagaacttataccgcaccaagtcctttctgtttgtgggctgtggggagacccttcgtgatcagatattccaggccctctttctttactccgtgccgaataaggtggatttggagcactacatgcttgtgctgaaggagaatgaagaccatttctttaagcatcaggcagatatgcttctgcacggaatcaaagttgtatcctacggggactgttttgaccactttccaggatatgtgcaagaccttgccactcagatctgcaaacagcaaagcccaggacatttgtactcgaattcatggagtgccactcctgatgggagaggaggcccatgacagtgacagtcatgctagtgatcgcggacaccacaccatgctgcctttgccagctggctccttcagcgagtcctcgcaccaagcctgggaggtagagatgctgatcgcgtggacagcaccacattattgggtaatgcatgccaggactgtgcaaagaggaagttagaagagaatggaattgaagtttcaaaaaaacgcacacaatcagatactggtgtctgtgccatcctcatgctcgcgggagttttggcatgggattctccgttgtgattcccccggactccactgtctgaagaccaggtttcctatgaagagggtctgatgggaacctgttcccagtgatttgaagatgatgctggagggtcttgaaatctttacagtaaaacctgcaacttgaaaactagcctttctgtaaccacagtgcccaaacgaagaggaatgtatggagaactccacgtggatctctgattgggaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtccaaggtggtatttttcgtaataaaaggggaagagtaaaramwrwmmaarmaamagtagctgccaaagagaaaatangaaatagacactttttttttttggg

SEQ ID NO: 1550 - DNA, 1123 bp, Homo sapiens
cgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagaaagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttatttggacattcacaaacttgttcaaagtggaataaaggttggctttttaaattttatttatttttgtgctggctacgttaattttattttagtgttaccttcctcactgaaggtatttctttgtaataaaagaaagaatcttgcaggagaaaataagggggcaacataagaaacaataattatggcacctgaattaggacagtgacattaaatttctgttatttgttaaaaaaaaaaaaaaaaaaaaaaaaaaaaaaaaaaaaaaaaaaaaaaaaaaaaaaaaaaaaaaaaaaaaaaa

SEQ ID NO: 1551 - DNA, 932 bp, Homo sapiens
  misc_feature (884)..(884): n equals a,t,g, or c
tcatcatatacaaagtttttcgtcacactgcagggttgaaaccagaagttagttgctttgagaacataaggtcttgtgcaagaggagccctcgctcttctgttccttctcggcaccacctggatctttggggttctccatgttgtgcacgcatcagtggttacagcttacctcttcacagtcagcaatgctttccaggggatgttcatttttttattcctgtgtgttttatctagaaagattcaagaagaatattacagattgttcaaaaatgtcccctgttgttttggatgtttaaggtaaacatagagaatggtggataattacaactgcacaaaaataaaaattccaagctgtggatgaccaatgtataaaaatgactcatcaaattatccaattattaactactagacaaaaagtattttaaatcagtttttctgtttatgctataggaactgtagataataaggtaaaattatgtatcatatagatatactatgtttttctatgtgaaatagttctgtcaaaaatagtattgcagatatttggaaagtaattggtttctcaggagtgatatcactgcacccaaggaaagattttctttctaacacgagaagtatatgaatgtcctgaaggaaaccactggcttgatatttctgtgactcgtgttgcctttgaaactagtcccctaccacctcggtaatgagctccattacagaaagtggaacataagagaatgaaggggcagaatatcaaacagtgaaaagggaatgataagatgtattttgaatgaactgttttttctgtagactagctgagaaattgttgacataaaataaagaattgaagaaacacattttaccatttaaaaaaaaaaaaaaactngaggggggcccggtacccaaatcgccgcatagtgatcgtaaacaatct

SEQ ID NO: 1552 - DNA, 1107 bp, Homo sapiens
ctaaactatttagttcaaaagtaacccaactaattaaagtgaaaaaaaattgttgaatcacaatgaacaaacataaaacaatacttaaatgagaattctgtgtcttttttggttttatctgtgatttattttgtccagtattaaggaatggttatctttatcattcttctaacatgttttggtttctctaatggttcattttcctttagcttgtgaaaattagggcagtttgtccagagccttactcgcaggagacaccagacccaacccatgcttagatttctgttaataaaagggagaagggtatttgaataggtagtaaaggcaggtacaagtttaagggagcagggctatcatatgtactaggtgagattactataaatgtctgaaaagttacatgcatagtcattggctcaggtaatttctctgaatttgaacttatttgatttatttaaccaagttattataatatgcagttctctttaatcaatcttctattattcaatcatctatccatttattaattcaacaaatatttattaaagtgcctaccatgattatgtgctgtagaaaagacaaggacatttactaggggggattgtgggcccaatcggcatcataagcatgttctgaaagccaaagacaataatcacatccaacggcaccagttcagctcaactttagaattcagcagtaacagtacagatggcctaaagtacatctgtgtgtatctgtacgtgtgcacacacccatgtatatatatttatctatctgcacacacactacatatgtatacacactatctatgtaaaatataatatatgtataatgcatataaattctaacaagtgtatttgtgttatctttaaaatagaacaattgtatcttgaagtggtaaatgcagagaattggttttattgttgatctgtggatttaatgatttctaggtgaaaaggacgtttaagtgtacaatttcttttcttaatttaatatatttatgtaaatgcatgcctgaaatttggttagattggctgtgttttgtgtcttttaacatgatcaaatgattaaactttatgcttatgacttgaaaaaaaaaaaaaaaaaaaa

SEQ ID NO: 1553 - DNA, 796 bp, Homo sapiens
  misc_feature (398)..(398): n equals a,t,g, or c
  misc_feature (780)..(780): n equals a,t,g, or c
  misc_feature (787)..(787): n equals a,t,g, or c
gaattcggcacgagctcgtgccgaattcggcacgagtcagattgaaggtggttggtttttattattatttagtgtgattgatagtatctagaatggcaggtggtgcataaaagttaaagagaggggaaagattacttagtttggttatacagttataaacaccatgcagtgtattcggtggactgtgctatttctgtttatcctttgggttttggtttttgtttttttttttgccttcacagtgagactgcaaatgattgttctcataacgtatattattaataaatgtggtcctataatttatactgaaattaccttaggatatttttgcataatactctcttactgcttacattctataaatttttcacgtgataattgtctttgcgtaactgggnaaaaatgccgaataacttcctttattatctggaaaaattaaatttgttcatttatattttctacttactaaattgagtttttaaaaagacttagtgtgacatttgacagtgtctttcaaacgaacttctctaacaagtttatagttattttcctgtttcaacactattagaagtcttataaattatgctaattagcatggcagtcatgttacacactcttaacattgccaaagaactgttgatttcgtttgagaaaaccctgggactgtgtgtgtgtaggttttgttttgattttaacaaccaaaaatagaaataaaattagaactgcgttttaagttctaaaaaaaaaatttaaaaaaaaaaaatttaaaaatttgggacnaaggcgngggggtccc

SEQ ID NO: 1554 - DNA, 1852 bp, Homo sapiens
ggcacgagtgccctcccctgcgcactcccctcgctgcccgggcccggagcgcagcgcggccgcacaggtatttttgctgtgctgtgcaaggaactctgctagctcaagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaaaaaaaaaaaaaaaaaaaaaaaaaaaaaaaa

SEQ ID NO: 1555 - DNA, 1906 bp, Homo sapiens
ccgcaacgcagtgagctcgcggccgcgagcaacaggccgtgccgrgtttgcatttccttactgctttgtcttgaagacagaacgatgccaaagaaagcaaagcctacagggagtgggaaggaagaggggccggctccctgtaagcagatgaagttagaagcagctggggggccttcagctttaaactttgacagtcccagtagtctctttgaaagtttaatctcgcccatcaagacagagacttttttcaaggaattctgggagcagaagccccttctcattcagagagatgaccctgcactggccacatactatgggtccctgttcaagctaacagatctgaagagtctgtgcagccgggggatgtactatggaagagatgtgaatgtctgccggtgtgtcaatgggaagaagaaggttttaaataaagatggcaaagcacactttcttcagctgagaaaagattttgatcagaaaagggcaacgattcagtttcaccaacctcagagatttaaggatgagctttggaggatccaggagaagctggaatgttactttggctccttggttggctcgaatgtgtacataactcccgcagatctcagggcctgccgccccattatgatgatgtcgaggttttcatcctgcagctggagggagagaaacactggcgcctctaccaccccactgtgcccctggcacgagagtacagcgtggaggccgaggaaaggatcggcaggccggtgcatgagtttatgctgaagccgggtgatttgttgtactttcccagaggaaccattcatcaagcggacactcctgcggggctggcccactcgactcacgtgaccatcagcacctaccagaacaattcatggggagatttccttttggataccatctcggggcttgtatttgatactgcaaaggaagacgtggagttacggaccggcataccccggcagctgctcctgcwggtggaatccacaactgttgctacaagacgattaagtggcttcctgaggacacttgcagaccggctggagggcaccaaagaactgctttcctcagacatgaagaaggattttattatgcacagactccccccttactctgcgggagatggggcagagctgtcaacaccaggtggaaagttaccgaggctggacagtgtagtgagactgcagtttaaagaccacattgtcctcacagtactgccggatcaagatcaatctgatgaagctcaagaaaagatggtgtacatctatcattccttaaagaatagtagagagacacacatgatgggaaatgaggaggaaacagagtttcatggacttcgcttccctttgtcacatttggatgcactgaagcaaatttggaatagtccagctatttctgtcaaggacctgaaacttactacagatgaggaaaaggaaagcctggtattatccctctggacagaatgtttaattcaagtagtctagtgcctttgcagaatcaaatgcctactattttatatgcatatattaaaagaaaagcaaagacctgagccgaggagaggatgaattcaagtttccttacctgcgtatctactaacaaacatgagacctccctgttacaggtggtcagttggccaaatgtactaacgggcacatgaaagaaagaacagcaaattaccaagtgtctcagaaaatgacaaaaccatattttgacaagtttatttaatccagtgtggtagaaaaggcacaattccaatgtatcatttagaattgaatgtcattaacctggctttgttctttggaagaaacaacttctttaaagagcttctttggctctagaaaaatttcaaacaattaaaataagaaaaaattttaaaaaaaaaaaaaaaaaaaaaaaaaaaaaactcgag

SEQ ID NO: 1556 - DNA, 4739 bp, Homo sapiens
ctttatattaaatatgttgtaacttattgttgttattcttttgaatgctcaaattgtccagatttgaccaatgcagtctttgttattttttaactccacaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaattaaactactaatcactgtcacccaattctaatcccaaccatctttattctaggcataccatactcactgccatgcttacccttcagttgggcacctttgtcctccttcctattggccttctggttcctacccaactgtccagtccacaggcctcagtaacacctttttgcccagccctgtggtagcgttggcctgcctcctttacctactcaagtaaccgctttaccactatttattgttttgtgttttcatctataggatcttacctagccatatggcctgctgcctctgccaatttaaaaatagcattgaggctgtctgcaagacagtcaagctgcattgcaacagtgcatgtctgacaaacaccacacattgtcgtgagtccaaattgcctggtgataaattgttacattattttaagtatttgtttttaaatttatttttaattgatgataaaattttaagctaatgacataattgctttatttttatttactcattcagagttaaactccctcaatttctgaactactcccttgctgagagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgaggtctcaagtactctctgccttataggacagatgtagatacggttttggtttttctgtttttacagttttataagagtacaagtgatgctgttttatttgaagcctgagagcttctggttccataaccagaaattgctacctggctcttctaatggaatggagggcttttccattcttagaccatccaactctgaacttgctctgaatctcaaacctttctattcacagaacaaacgctcaagggctttcaagagtgtttctgtagattaggcttattagcaccaacttcatgacttctaaaatgtgactgcttttatgtccacatagcttgaatacaggtatctaccagtgatatggggtggataattaataatgcttggctacttatataaagacagagttgcttattattcaaaagttttttttttaccaactaaattattcccttctccccaagaggtgggcagaaaagcattgttaatctccttttacggatgaggaaaaacaagatcagaggtgctaagtgctgtagcctagtgccaggtcttctggccccaattctgggttctccccaagcccatgtttcttccctttctcacaatctttacttcttcctctgaccctcaccaccacccaaaatacttttaattctggaaaagaaacccagctgcacactggcacacttgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagagattcactgtgtatttaacaacataggcatgcaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcaagaacacaggtgcaccgaggacgaggagagcaggagccttgtgctctctctgcatctgaggcaggacagcacagggtatggagcagtctgcagagaggccagctcacagctcatcagggaagcacttgtcttccaccttgggctttgactgagcactgggcaattggaccctggggatcaacgaaataatcctaagcagagttactctatgtcacactatggaatgttccaagtaggtggccgtgttttcaaaagatatattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgatgttatcagtacactaagttacatcttgccttatttctcagccgtaaacctagatgtgaaatcactgttactaccgttcattaaactgccaaccacaggaaacagcctggcaaagattcaaactgtaggcaaaaaccggcagagactgaatagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggagctggaacagcctcacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagactgagaactacattaatgagagcacagaagcccagagtgaacagaaagagaagtcgcttgagctcacaaaagaagttccaggatatggctatactgacaaactcatcttggcattaattgtgactgaaatactaatgattttgattatacttttctgcctcattgtggtaaggacaataattaattcaggttgtcagaatgcagtcctgtttctgtgtggattcagagctcacaaactgaaaaccaaagccactttcccacctgctgctacttgacatacttcttcagtcatttaaggctgaggtgtatgctttgttcttttattgcagtgtatatttcaggatttttaaaagatcctcgcttccagatctctgtgaattgaaaccaagttaatcccactagactattttaagaagtcgatataatagcaaaatttctccacccaaaactatgtcaacaattggatgtactcatcaagtcacccttactctgccactaatttatttccttggtgctgaaatgatgagagaggtataatctccaccctcacggatttgtcatcaccctggagaggaaggagagagccaaaagacagaagtattgtcttgtagacttattagatttacacagtatcgtcctccagtgtgtaaggcattgtctaaataggtc

SEQ ID NO: 1557 - DNA, 4739 bp, Homo sapiens; identical to SEQ ID NO: 1556

SEQ ID NO: 1558 - DNA, 1092 bp, Homo sapiens
ggccgctctagaactagtggatcccccgggctgcaggattcggcacgagcgcctggcaccatgaggacgcctgggcctctgcccgtgctgctgctgctcctggcgggagcccccgccgcgcggcccactcccccgacctgctactcccgcatgcgggccctgagccaggagatcacccgcgacttcaacctcctgcaggtctcggagccctcggagccatgtgtgagatacctgcccaggctgtacctggacatacacaattactgtgtgctggacaagctgcgggactttgtggcctcgcccccgtgttggaaagtggcccaggtagattccttgaaggacaaagcacggaagctgtacaccatcatgaactcgttctgcaggagagatttggtattcctgttggatgactgcaatgccttggaatacccaatcccagtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacatgagaaaaaaaaaaaaaaaaaaaaaaaaaaaaaaaaaaaaactcgagggggggcccggtaccc

SEQ ID NO: 1559 - DNA, 1000 bp, Homo sapiens; identical to SEQ ID NO: 217

SEQ ID NO: 1560 - DNA, 736 bp, Homo sapiens
  misc_feature (1)..(1): n equals a,t,g, or c
  misc_feature (541)..(541): n equals a,t,g, or c
  misc_feature (594)..(594): n equals a,t,g, or c
ncgcagcagccaccgccgcgtccctctctccacgaggctgccggcttaggacccccagctccgaccatcgcctggtcccacagatgtcgccctctggtcgcctgtgtcttctcaccatcgttggcctgattctccccaccagaggacagacgttgaaagataccacgtccagttcttcagcagacgcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacatatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgcntgttcatcacagggcttattattcttcaccagttggcaagtgcagggcagctnttcccggttattgccggaattcgtttgcaggttgagttccattcaggaaacagggagctttacaaacctgttggggcacccgaaggaaccaggccccttggccaggtttaacgtggcccagtcttcctggcattcccttcga

SEQ ID NO: 1561 - DNA, 678 bp, Homo sapiens
ggcacgaggcagcttgtgctttaaaggaggtgttcaaagcatgtctgagcagagacttttgggctctgttttaattaatactttaaaataattcatatttaaaatatcagatgtttccataaagaggaggatgtttaaatgcctccagactacattcctttttattcttgattttacctgggagtccaaagttcaattccataaagcaagcgtttatttgtcactttcaatatacatcgattgccatgcttaagatgcaatatgggctgcggaaataggttaacccacaggctcccagggcccagtgtagaaggtgagagattcgtgtaaaatgattcaaataaaaggaagaccctggccgggtgccgtagctcacgcctgtaatcccagcactttgggaggccgaagcgagtggatgacgaggttaggagttggagaccagcctggccaacatcgtgaaaccccgtctctactaaaaatacaaaaattagccgggcatggtggcaggcacctgtaatcctagctagttgggaggctgaggcaggagaatcgtttgaatctgggagttggaggttgcagtgagctgagatcgcgccacagcactccagcctgggtgacagggtgagactctgtctcaaaaaaaaaaataaataaataaagtaaaaaaaaaaaaaaaaa

SEQ ID NO: 1562 - DNA, 985 bp, Homo sapiens
ggcacgagcggcgccacgaggcggccggacccgcagccccgatgctgctgacgctggccgggggcgcgctcttcttcccggggctcttcgcgctctgcacctgggcgctgcgccgctcccagcccggatggagccgcaccgactgcgtgatgatcagcaccaggctggtttcctcggtgcacgccgtgctggccaccggctcggggatcgtcatcattcgctcctgcgacgacgtgatcaccggcaggcactggcttgcccgggaatatgtgtggtttctgattccatacatgatctatgactcgtacgccatgtacctctgtgaatggtgccgaaccagagaccagaaccgtgcgccctccctcactcttcgaaacttcctaagtcgaaaccgcctcatgatcacacatcatgcggtcattctctttgtccttgtgccagtcgcacagaggctccggggagaccttggggacttctttgtcggctgcatcttcacggcagaactgagcactccgtttgtgtcgctgggcagggttctgattcagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttaaaaaaaaaaaaaaaaaaa

SEQ ID NO: 1563 - DNA, 1047 bp, Homo sapiens
gaattcggcacgagccactatggacagagcctccactgagctgctgcctgcccgccacatacccagctgacatgggcaccgcaggagccatgcagctgtgctgggtgatcctgggcttcctcctgttccgaggccacaactcccagcccacaatgacccagacctctagctctcagggaggccttggcggtctaagtctgaccacagagccagtttcttccaacccaggatacatcccttcctcagaggctaacaggccaagccatctgtccagcactggtaccccaggcgcaggtgtccccagcagtggaagagacggaggcacaagcagagacacatttcaaactgttccccccaattcaaccaccatgagcctgagcatgagggaagatgcgaccatcctgcccagccccacgtcagagactgtgctcactgtggctgcatttggtgttatcagcttcattgtcatcctggtggttgtggtgatcatcctagttggtgtggtcagcctgaggttcaagtgtcggaagagcaaggagtctgaagatccccagaaacctgggagttcagggctgtctgaaagctgctccacagccaatggagagaaagacagcatcacccttatctccatgaagaacatcaacatgaataatggcaaacaaagtctctcagcagagaaggttctttaaaagcaactttgggtccccatgagtccaaggatgatgcagctgccctgtgactacaaggaggaagagatggaattagtagaggcaatgaaccacatgtaaattattttattgtttcatgtctgcttctagatctaaaggacactagcattgccccagatctgggagcaagctaccaacaggggagactctttcctgtatggacagctgctgtggaaatactgcctgcttctcccacctcctcagagccacaggaaagaggaggtgacagagagagagcaaggaaagtgatgaggtggattgatactttctactttgcattaaaattattttctagcctgcaaaaaaaaaaaaaaaaaaa

SEQ ID NO: 1564 - DNA, 1125 bp, Homo sapiens
  misc_feature (105)..(105): n equals a,t,g, or c
tcgacccacgcgtccggaacgtgctccgcgggctcagtccgcccgccgctgcgtccgcggagtgcaagtgagcttctcggctgccccgcgggccggggtgcgganccgacatgcgcccgcttctcggcctccttctggtcttcgccggctgcaccttcgccttgtacttgctgtcgacgcgactgccccgcgggcggagactgggctccaccgaggaggctggaggcaggtcgctgtggttcccctccgacctggcagagctgcgggagctctctgaggtccttcgagagtaccggaaggagcaccaggcctacgtgttcctgctcttctgcggcgcctacctctacaaacagggctttgccatccccggctccagcttcctgaatgttttagctggtgccttgtttgggccatggctggggcttctgctgtgctgtgtgttgacctcggtgggtgccacatgctgctacctgctctccagtatttttggcaaacagttggtggtgtcctactttcctgataaagtggccctgctgcagagaaaggtggaggagaacagaaacagcttgttttttttcttattgtttttgagacttttccccatgacaccaaactggttcttgaacctctcggccccaattctgaacattcccatcgtgcagttcttcttctcagttcttatcggtttgatcccatataatttcatctgtgtgcagacagggtccatcctgtcaaccctaacctctctggatgctcttttctcctgggacactgtctttaagctgttggccattgccatggtggcattaattcctggaaccctcattaaaaaatttagtcagaaacatctgcaattgaatgaaacaagtactgctaatcatatacacagtagaaaagacacatgatctggattttctgtttgccacatccctggactcagttgcttatttgtgtaatggatgtggtcctctaaagcccctcattgtttttgattgccttctataggtgatgtggacactgtgcatcaatgtgcagtgtcttttcagaaaggacactctgctcttgaaggtgtattacatcaggttttcaaaccagccctggtgtagcagacactgcaacagatgc

SEQ ID NO: 1565 - DNA, 3465 bp, Homo sapiens
agaaaatgaaagcaccaaagagccttctttgctacaatatctttgtgtgcagtctcctgcaggattaaatggtttcaatgtacttttatctggcagtcaaaccccccctactgtgggcccgtcctcaggtcagctgccgtctttcagtgtcccttgcatggtcttaccatctccacctctgggcccttttcctgttctctattctcctgcaatgccgggcccggtttcttctactcttggtgctctcccaaacacaggacctgtgaatttcagcttgcctggccttggatcaatagcccagcttctcgtcggccccacagctgtggttaatccaaagtcgtccacactcccttctgcagaccctcagcttcagagtcagccctcactaaacctaagtccagtgatgtcaaggtcacacagtgtcgtccaacaacctgagtcccccgtttacgtgggacatccagtctcagtagtaaaattacatcagtcaccagttccagtgacccccaagagcatccaacgcacacatcgtgagacgtttttcaagacacccggcagccttggagaccctgtcctgaagagaagagaaaggaacaatcacgaaacaccagctcggcccagaggagactagaaatccccagcggcggcgctgactaacctgccgctttgccaggtgggggtgggatcaaacgccctgagagtcccggatgtccgaggcgggatgcaaaccatcccgtcctgagcacgggtccttcctctctctttcatccacacttctgttaacttcccaccaccatcaatcatctgatttcctgaaagtaattaattgtgcatttaataccagttagagttccgactctgcatggtgtcacagtgaaagcgccgactgacttatggttttgattcaagaatcgtcttattgctggaagtagatctgaataggataccggagccttgtttttctaaaggggggcgctgtctagcacttaactagggtaagcattcttaacatgtatttccacttgccctgagtaaatctgtggtgagagaagcttcctttctgcagtttaaaaaagctactgcttccttaggcttcatcaggaagccatcttcagttgtgaatcctatggtgttatttattttgttcctgaaatgggatttagtgcaaaaagtttacaactacagtctttaacacatttttttcagggtatgacgacttgaatgtttatacttttattctataatttgccctgcacttattttacaacctagtaataatgtggataaatgtatctacatgacacatgtcaagaccaaaataactgtgaatgacacaccttgctgtaaatgaactgtgctaaccctgactgtgggcttgagaacaaagatgaactctagaactctagcagcctaactgctgcttctcaaataactgtgtgaacagtgagatattactgtttgtttctaaaaatcctactgtgcccagtttccttcactacatgccctgcattttttatttaaatatttagctgtagcgccatcagatatggatgccttctaacaattgctgtttgtaaaataaatcaggatggtagaaagtgattttatggaaaattggaacctggatgagaccttttcgttgaattctgaagagtaatgatgcgaaaattgatacagggcaagagatgattcttttgtttttcttctacttcatgtccagaagagtaagagggaaaatggacatatgtttcatatccaagggtattcaaactgtagttagttggtacctctgaaaaatgagaatggtgagcgcacgggttggttgttctagcatgaatacaattctggaaactgttatgcaatttcccttttttaacccacattactttaggggtgcattaagtcgccaaactatactagttctttgtattcctagacttgctgatatttacctctctcttgtctcttcagagtaaatggttcccttctttccttcctactttccttcattctctcttccttccctccttcctacttcttttcttccttcctcttcctctcttaaaactatcttagatgtagaatcctggtgtagggttttattttatttttattttttgacccaataaaatgttatatgaaagaatgaaaatattaatttaagagactctgggagtctgaataaagtagctttatattaactacaggataatattagccttattacccccacaagattttttaaaacttgaggtaggtagctacattaaataaatttgctacttatataaaaatttttatcaacactaaacttttaaagtttacaagttttttttttcttttttacagtcttctatagagttaggttaaaaatgtggttctaaccatcaacaattgcatggttaaatgaccctgaactaaaactgatgggttccctatcaaaacaaataaaaatatacctttttcaggtttcaatctgtgcagggtatatgcatgttaattctaccatgcttaagaacttccacaaaatatttcatggagaggtctgcatttagacggaaacagaaattgcttttcccctcactgttcctgaatgctctatacttgttttaacatttttgctatctttttttattattctgatcatgatatgaccatttaacctcagaattcataattcctgaggggtgttaagaagcagtcccattggtgaggatattatgacttggtgaccattcttaggagtagaaaaccaaggacaattgcttctgtattcagtatccacttcttaatgtggctttatatgtaaaaataataatgcagtggttgtttctgtcaggaaaataaatcttacagaacaactggtggaattgaagctgctgcgctagacttggatattttgggtagtgaagaagcaatggcaatcttgagtctattattgtataatttagtaaaagaaaaaaataatcgttggtggtcctactaagagaatgcagcttttttgagttgtcacagaggctgtgtgtgccctacactgaccagggtttgtaaaaccctttcattctggtacaagagtcgggggtataacttttatacttgaatctacctaccaagtttacatttctcaattcctttttgtaaggtgctatttctgtatttaaataactttcttttaacgtaaagctgctttctgcttatcttattgcactgctagttgtatgtaggtattaattttattgctgcttactgcttttgttttcttattatttagctctgctctttttcctaatggctatattatctatagctatttacttgtaactgtactacatgtaaactgattttttgttctgattttttttctaatatttttaggaaaatattaagctttataaaatagcaataaaaaataattcatttaaaaaaaaaaaaaaaaaactcgtagggggggcccgtacccaattc

SEQ ID NO: 1566 - DNA, 700 bp, Homo sapiens
ggcacgagaagtcatggcggcgctgtgtcggacccgtgctgtggctgccgagagccattttctgcgagtgtttctcttcttcaggccctttcggggtgtaggcactgagagtggatccgaaagtggtagttccaatgccaaggagcctaagacgcgcgcaggcggtttcgcgagcgcgttggagcggcactcggagcttctacagaagggttctccaaaaaatgtggaatcctttgcatctatgctgagacattctcctcttacacagatgggacctgcaaaggataaactggtcattggacggatctttcatattgtggagaatgatctgtacatagattttggtggaaagtttcattgtgtatgtagaagaccagaagtggatggagagaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattatagataaaaaaaaaaaaaaaaaa

SEQ ID NO: 1567 - DNA, 848 bp, Homo sapiens
  misc_feature (8)..(8): n equals a,t,g, or c
  misc_feature (15)..(15): n equals a,t,g, or c
  misc_feature (98)..(98): n equals a,t,g, or c
cccccaangaacagnttttggtaaatccaaaaattatgccacttttaaaaaaaaaaaacaaaccttaaaacagggatcttaataccctccccttgttntccccttgctttactcctccactttagaatattttccttaaaaatcacctcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttmatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattgaataaagatacaaatactttgtttggctggcatatattaaattattatatgaaraaaaaaaaaaaaaaaaaaaaaaaaaaaaaaaaaaaaaaaaaaaagggcggccgct

SEQ ID NO: 1568 - DNA, 2608 bp, Homo sapiens
ccacgcgtccgcacagggctcaggctgggctcagaggccactgagatgccagctccttgagagcagtgggggtgtcccaggccagagcagcctcttcctctcctggtcccagaaaaacccttgcagtaaatggtggcctctgggtggttacttctagcgcaggcttccttccttcctctagctcctcccggtgccctgggtgctgggtgctggatggatgggcgtcctctagctcctcccggtgccctgggtgctgggtgctggatgggtgggcgtcctctagctcctcccggtgccctgggtgctgggtgctggatgggtgggcgccacggtgcacccttgttgggctgcctgtgcccgagtggcctctgcagctcttatgtctgcctctaatgggatgtgcgccctgactgcctcgttcttaagggcatagtgggtcggctaagatctgatcgccaggactgcgttctgggcaggtgctgggaaggcggaaccaagccgtccgtgccgctagggagccgagactgccggaaagaagagcggcaggagggggcgtggttgtgcagccccacccccgggaggggctttaggcactgggaaggaaagtcctgttggaggaattcggtggctgttcacacccgcctcgctgtcttggagtcttgatctgtcgtcggcgggtcgctggcacaggactaaacatggctgaggctgggctccagccagatctggctggggacagcaccgcgtgggcccaggatccacccagagcaggcaggccttgctggggccccagtcaagtccacttccagtgaggagagccagccgggaggtcagtgccagagctctggtggagcccagaccctgccttccctgagggccgcccctgtcgccgccctggggtccctgtcctcctatcctgactcctgccccagggccaccacccctgaactgtgccctggggcccccaccctccacctggccgactccatctctgggcctgtcagtccacctgggtcctctctgggccctgatgcctggaccctctgtgccaagcaccaccaagcaaaggggatgaccttgggcacccccaaggtgctgagactacagccagtgagcccctgctgggggccaaagtcatggagggtgcctgggcccttccaacctggaaggaggaggggagagagcaggcagcagggcagggggaagaggaggagtgcccgatctgcacagagccctacgggcccagagagcgccgcctggccctgctgaactgtagccacggcctgtgtgtgggctgcctgcacaggctgctgggctcggcctccagtgccgacctgggccgggtgcgctgcccgctgtgccgcagaagacgcccgtgctggagtgggagatctgccggctacaggaggagctgctacaggccgacgggccctcacgccagccccgccgagaggcccctgcatcctatcaccgcaaccctgggccctggggctccctggagcaccgctaccagctgcgcttcctggcagggcccgtgggcggccggggctgcctgcccttcctgccctgtccaccctgcctgggtgcccggctctggaccctgcgggagcggggaccctgtgcccgccgcctggcgctgctgagcctgctggcccttgagcttctggggctgctgctggtcttcacgccgctcctgctgctgggactgctcttcgtgctcctggaccgctctggccgctgagcagagcccaggacagccccgccgcaacaggccagggggcccagactggcccacgtccccatgcctgggtgctgtgaggcctgatgaccaggctggaaaaacccaaggttgggtccagggcagtggccttcaatcaagacctcccattgctgaacccacaaccagggctacccagaggcctgaccctgcagagtccatggctgcactgctgcccagacactagctgaacccaaggacaccagcgcccaaggacagctcctggaggaggccagcccagcaggaaagtctgtgagcaggaccccattcaccctgcggcagacgggcaccgtactggccacgggctgacgccggccacacttcccctccgagggccagctgagcacagcaggcatgaaagcaaacagagatacagcagtgagtcagttccttggagagggcagggactccgcccaccctgtgttcagataagggccagtgtgtgtccctgaaggtcaggccagccgggggaggggtccatgctgcgaaaattcagcctgcaaaggctcctctccccacttgatcaggcccagaccaggtgggggttggcgctggcctgtgttgcaggggacaagggcccacccaggccttggaacataagctctgcccctgcacaccctcatgtcaccacacctgggatggagacatcaggtggcccagcgagagatggaggactgatcctggaacgtgaagcagctttcaataaaccagctcctggggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1569 - DNA, 1259 bp, Homo sapiens
gacggggaccagagcacgttcctggctgcagaggccacaagtcacgctgtctctgagagccacggtggcctcatctctctgccataaacttgccaattatcctgctgctgcctcattgacttcgcacccactcttccctctggaacagaggacactctcgccagctctccccatggcggatccttgtctagggtcaggcctctgctccaaagtcacccctggggacaccttctctgaccagcccctcattcctatggcctcatgctgtttttatttcttcctaggacttagcacgtatcctagaaattaacctgctggtatatcctgtttcttgtctgtctctttccagtggaatgtcaccatcgcccaggtggggatttttgtgtgttttgttcactgctgtacamccagcccccagcacagcgsctgtccaggacaagtgcccagtaaacacttgggaagcaatgcaagcgtgcgtgcatggataagtawttctttsscagatgagggggctaaggttcagagaaggccctgggggtctcagactcatagcccagtgctctttctgctgacacgccctggtctctggggcagtttgttgcctgttcagcaacaaagagggtgtgcctcgttaggggtcctgcgtgcgaatcgcagtccctgcgtgtcttggctggaggtmacmaccctytctgctccagggcctgtaattaccacttaccctggtcaatgggtccgagagattmcccttgtaggcagggctgtggccagggtgctcacctggcccccagsaggtcccatgggcactgtctggccgggcttcatggctgacattccaggtacatttctagccctgggctgccatgggcagagggtggggagagggtcgtgggcttcaggctggacaaaccagtcagccttcccagctgggccgcctgaccacccacttcctgtggggctccttgaggcctggagggtggagggggtctctgttcaacccccacccatgccctcttcccttctctccctcggcaggtcytcccagcagytcctgcaaacagacccccgacccaagcccttccttctgsctccactgccaccactgctgctcatctctgctggcacagaagtctcttccctggtcttccagaaatcccctctccacactcagccagagggagctattaaaactgtgggccagcccacatcagtccacagcaaaaaaaaaaaaaaaaaaaaaaaaaaaaaaaaaactcgag

SEQ ID NO: 1570 - DNA, 1948 bp, Homo sapiens
cgcgtccggagctgcagagaagaggaggttggtgtggagcacaggcagcaccgagcctgccccgtgagctgagggcctgcagtctgcggctggaatcaggatagacaccaaggcaggacccccagagatgctgaagcctctttggaaagcagcagtggcccccacatggccatgctccatgccgccccgccgcccgtgggacagagaggctggcacgttgcaggtcctgggagcgctggctgtgctgtggctgggctccgtggctcttatctgcctcctgtggcaagtgccccgtcctcccacctggggccaggtgcagcccaaggacgtgcccaggtcctgggagcatggcttccagcccagcttgggagcccctggaagcagagggccaggcagcagagggactcctgccagcttgtccttgtggaaagcatcccccaggacctgccatctgcagccggcagcccctctgcccagcctctgggccaggcctggctgcagctgctggacactgcccaggagagcgtccacgtggcttcatactactggtccctcacagggcctgacatcggggtcaacgactcgtcttcccagctgggagaggctcttctgcagaagctgcagcagctgctgggcaggaacatttccctggctgtggccaccagcagcccgacactggccaggacatccaccgacctgcaggttctggctgcccgaggtgcccatgtacgacaggtgcccatggggcggctcaccatgggtgttttgcactccaaattctgggttgtggatggacggcacatatacatgggcagtgccaacatggactggcggtctctgacgcaggtgaaggagcttggcgctgtcatctataactgcagccacctgggccaagacctggagaagaccttccagacctactgggtactgggggtgcccaaggctgtcctccccaaaacctggcctcagaacttctcatctcacttcaaccgtttccagcccttccacggcctctttgatggggtgcccaccactgcctacttctcagcgtcgccaccagcactctgtccccagggccgcacccgggacctggaggcgctgctggcggtgatggggagcgcccaggagttcatctatgcctccgtgatggagtatttccccaccacgcgcttcagccaccccccgaggtactggccggtgctggacaacgcgctgcgggcggcagccttcggcaagggcgtgcgcgtgcgcctgctggtcggctgcggactcaacacggaccccaccatgttcccctacctgcggtccctgcaggcgctcagcaaccccgcggccaacgtctctgtggacgtgaaagtcttcatcgtgccggtggggaaccattccaacatcccattcagcagggtgaaccacagcaagttcatggtcacggagaaggcagcctacataggcacctccaactggtcggaggattacttcagcagcacggcgggggtgggcttggtggtcacccagagccctggcgcgcagcccgcgggggccacggtgcaggagcagctgcggcagctctttgagcgggactggagttcgcgctacgccgtcggcctggacggacaggctccgggccaggactgcgtttggcagggctgaggggggcctctttttctctcggcgaccccgccccgcacgcgccctcccctctgaccccggcctgggcttcagccgcttcctcccgcaagcagcccgggtccgcactgcgccaggagccgcctgcgaccgcccgggcgtcgcaaaccgcccgcctgctctctgatttccgagtccagccccccctgagccccacctcctccagggagccctccaggaagccccttccctgactcctggcccacaggccaggcctaaaaaaaactcgtggcttcaaaaaaaaaaaaaaaaaaaaaaaaaa

SEQ ID NO: 1571 - DNA, 2694 bp, Homo sapiens
gaaagctggtacgcctgcaggtaccggtccggaattcccgggtcgacccacgcgtccgatctacatccgcagatatgtgttcaagcttggtgtgctaggctggggggccccagccctcctggtgctgctttccctctctgtcaagagctcggtatacggaccctgcacaatccccgtcttcgacagctgggagaatggcacaggcttccagaacatgtccatatgctgggtgcggagccccgtggtgcacagtgtcctggtcatgggctacggcggcctcacgtccctcttcaacctggtggtgctggcctgggcgctgtggaccctgcgcaggctgcgggagcgggcggatgcaccaagtgtcagggcctgccatgacactgtcactgtgctgggcctcaccgtgctgctgggaaccacctgggccttggccttcttttcttttggcgtcttcctgctgccccagctgttcctcttcaccatcttaaactcgctctacggtttcttccttttcctgtggttctgctcccagcggtgccgctcagaagcagargccaaggcacagatagaggccttcagytcctyccaaacaacacagtagtccgggcctcctggcctggaatcctcagcctctctggccgccagtagcctgaggctacggctcctgctagagagggtggcaggcctgctgctggaccccagaggccactgtgaccgccaaggggccttttccacttccacggcctctccaggcactgaggggaaggcattgctctacctctccctgacattttgctccggggcagatccaaccttacctggggcagcaaactttgtcctggtacctgggcccagctcgccagggatgtgggcagagcaccagcctgggcatcaggaagccaagtttcaaggactgtctttgagtctgtctgtatgaccttgggcctgccacttctcacagaccctaggtatccacagctgtgacatgggggcaagcggctttgtttcagcctaacccaggagcttagtaaaaattgcataagaccagggggaagagtgtcagcgtggggtgggaattcccgcggcctccacctgcttgctaggggcaggatctcattcaggctgccctggaagcacctgcttggccctgccaccttcctccaggggagggccagatggcatcctggcttggggcgggtgggacctacccaggctctgagactttactggcctatgcctgaggcctcttttcctttaactccctaaattatgatgactccaagtccaagcccacccttyccaaagawtgggaggttccgccgttcccagaggctcctcctgcggtgctcccaagacttccatagaccatctggaccagtagcccatcccgcagttttcttgggggcagaggaaaacgcttctttctcctccagctgaatcagctggatcccagtgtcctggctgtttggtgattgggcaagattgaatttgcccaggtaggcgtgagagtgtgggttttaaattcgaagctcaggccatagtttcagagaatcacccttaccccagaccttcatgagacagtgctcatgaagccagtgcgtttcccagaacgaacactaggcggcaccgttggtccacactcagaggcccttggcgccaagactgcatctagaatcgctcaaacacctgtttgcagaccccatgcaccagctggaggggccgtaactgcaggactgcgcctactgagtgacccatttcctccaggaggaaaggcaagacacgcttacacggccatttgtctcttttcccaatgcggcggtgcactttcgctcttgggggctgcaccccagacatagctggcaccagagcagggtgctcaggtggtgggtgctcagggccctgccccaggccactgggccgttttgatgacctcgaaggtcacaggcrgaaaataggagcaggatttcccctggggaaaagttctcctgggacatcttctgctcttctgtacatttctagatgcaaataactccttcaccaggcagtgagtggcgtaggctctggagccaggctgcctgggctccaatgccagctctgccacttgctagctgtgagactgtggacaaaccactcagcctctgtgtgcctcagttttcctatttgtaaaatagaggccatagtggtacctattttgaagactaagtaaaagaattcaaataaagagacttggcacagagtaagtgctcagtaaatggttactggtattatcattagtatttttgctattattgttaacagtgttaactgagtttcagaggccagcctgtctaagccccaggcccagctctgctcaaccttgtaggcacaaccccttcttaggcacatctcaccatgcctcagtttctttccccagacgggtctctactcccacctcgctgactttctgctgttctaggaatagtccccacacagtgcagcctccaggccatgccacatgtcccccgacctcccagttccccaatcttccggtctatagaaattcctggtggtcatttatcacatctacaaaattgccccagcggtgcctagagaaggcctctttcccacgctaactccaggcagattctccccacccctgccaccatctgggtgatgtgagcacccatcaagcttccatgggtaagcccaggcttt

SEQ ID NO: 1572 - DNA, 826 bp, Homo sapiens
  misc_feature (2)..(2): n equals a,t,g, or c
  misc_feature (21)..(21): n equals a,t,g, or c
  misc_feature (657)..(657): n equals a,t,g, or c
  misc_feature (687)..(687): n equals a,t,g, or c
  misc_feature (696)..(696): n equals a,t,g, or c
  misc_feature (726)..(726): n equals a,t,g, or c
  misc_feature (817)..(817): n equals a,t,g, or c
  misc_feature (821)..(821): n equals a,t,g, or c
antccaacgggaattcgacgnacgtagtagggaaaggtggtcgcctgcaggtaccggtccggaattccgggtcgacccacgcgtccgggacggatccctggagtcctggcagaggcagatcatgggcacatacctggtgcggcaggggcagtgccggccagggctgcggaatgagctctttagccagctggtggcccagctatggcagaacccagatgaacagcagagccagcgtggctgggccctcatggctgttttgctcagcgcctttcccccactgcctgtcctacagaagccactgctcaagttcgtgtctgaccaggcccccaggggcatggcagcgctgtgccagcacaagctgctgggggccttggagcagtcgcagctggcctcgggggccactcgggcccaccccccgacccagctggagtggctggccggatggcggcggggccgcatggcgctggatgtgttcaccttcagcgaggagtgctactcggccgaggtggagtcttggaccaccggggagcagctggctgggtggatcctgcagagcagaggcctggakgcgcctycccggggctggtctgtgtcactgcactccarggacgcatggcaggacttggctggctgcgactttgtgctggacctgatcanccagactgaggactggggggacccagctcnaacccgcanctaccccatcactcctcttggctcagccgnagccataacccttaaccctggcattcaagaaccctcactggcccaggaaccctccaagttccagccccaacgctgcccaacaagggaccanacangggga

SEQ ID NO: 1573 - DNA, 3280 bp, Homo sapiens
gcgtccggtgagaggcaaggacttttcatctttagggcattctgaccacgtcctgcttcagagagattgttcccggcgtctcagtgctatggggagcaggttcctcctggtcctgctctcaggtctcactgtcttactggctctgccaggatcagaagccaagaattctggagcttcctgtcctccatgccctaaatatgccagctgccacaacagcacccactgtacttgtgaagatggctttcgggccaggtctggcaggacatactttcatgattcctctgagaagtgtgaagatattaatgaatgtgaaaccgggctggcaaagtgcaagtataaagcatattgtaggaataaagttggaggttacatctgtagctgtttggtaaaatatactttattcaactttctggctggtattatagattatgatcatccggattgttatgagaacaatagtcaagggacgacacagtcaaacgtggatatttgggtgagtggggtgaagcctggatttgggaaacagctggtacgtataactatgccattttcctacccaaacattaacatgtcttcctgtgatttttagggtagggtagttctatccaggggtaattttgtcctctgtcccaaggtcatctgtcaatgactggggacacttttggttgtcataccttgggggtgatgtgtgtgactggcatctggtggatggagaccagggatacagctcaacatcctacagtgcccaggacagcctcccacaatcaagaagtgcctagtgccatatgtccatagagatagagaaatacaagtgtagggggaaagtgcctcagctggcattcaaagacctacatcaagcacctagattctcaatgccacacgcaccttgtagcaccttaataaatatcgttgccttctgggctccccactccaacacttgtgcatattccctatttcttacatttcagtaagagtcaatctaattagcttaatttttttggaaggaaaatctgagaagaaatggaagcagagaggactttgcaagaagggctactcaactaattcaaagcgtggagttgagcatctggaatgcgagttttgcttctccaggaaagggtcaaatttctgaatttgatatagtctatgaaaccaagaggtgcaatgagacaagggagaatgcttttctggaagctggaaataacaccatggatatcaactgtgctgatgctttaaaaggaaacctaagagagagcactgcagttgccctatcacttatcaatctcttggggatattctgaatgcatccttttttagtaaacgaaaagggatgcaggaagtaaaactgaactcttacgttgtgagcggcaccatcggtttgaaggaaaaaatttccctctctgaacctgtgttcctgacttttcgccataatcagcctggtgacaagagaacaaaacatatctgtgtctactgggagggatcagagggaggccgctggtccacggagggctgctctcatgtgcacagcaacggttcttacaccaaatgcaagtgcttccatctgtccagctttgccgtcctcgtggctcttgcccccaaggaggaccctgtgctgaccgtgatcacccaggtggggctgaccatctctctgctgtgcctcttcctggccatcctcaccttcctcctgtgccggcccatccagaacaccagcacctccctccatctagagctctccctctgcctcttcctggcccacctcctgttcctgacgggcatcaacagaactgagcctgaggtgctgtgctccatcattgcagggctgctgcacttcctctacctggcttgcttcacctggatgctcctggaagggctgcacctcttcctcaccgtcaggaacctcaaggtggccaactacaccagcacgggcagattcaagaagaggttcatgtaccctgtaggctacgggatcccagctgtgattattgctgtgtcagcaatagttggaccccagaattatggaacatttactcactgttggctcaagcttgataaaggattcatctggagcttcatggggccagtagcagtcattatcttgataaacctggtgttctacttccaagttctgtggattttgagaagcaaactttcctccctcaataaagaagtttccaccattcaggacaccagagtcatgacatttaaagccatttctcagctatttatcctgggctgttcttggggccttggtttttttatggttgaagaagtagggaagacgattggatcaatcattgcatactcattcaccatcatcaacacccttcagggagtgttgctctttgtggtacactgtctccttaatcgccaggttcgaatggaatataaaaagtggtttagtgggatgcggaaaggggtagaaactgaaagcactgagatgtctcgctctactacccaaaccaaaacggaagaagtggggaagtcctcagaaatctttcataaaggaggcactgcatcatcatctgcagagtcaaccaagcaaccgcagccacaggttcatctcgtctctgctgcttggctaaagatgaactgacctggcaagtgccatggcaatgacccggaagttacccctcctttccgtttgtctacagcgcccctgtggtcacacatagattggacaaatgccactatttctagctttcctgtgaaaagtctaggctcattcacctattttggctttttatgttcatagaaagaacaagacatttgggagaattcttagatccagagtccagtagtgtggcacgtgcaatgaagtgtcggaaggatgcattttaaagatggcgggcgggagaagtggattttcttcttgcagctactgccaccttgccagaaactcactaactggcatctggattcagctcatagttccctttctggcctctctgctgtattttatgctcccaaagatcttacattaacactccacattcacataattcaacaattttcatatggatcagtattaaagagggtgttgcattttgcaatacaaaaatgcattatcaggtgctggagaggatgtggagaaataggaacacttttacactgttggtgggactgtaaactagttcaaccattgtggaagtcagtgtggcgattcctcagggatctaggactaggaataccatttgacacagctatcccattactgggtatataccccaagggctataaatcatgctgctataaagacacatgcacacgtaaaaaaaaaaaaaaa

SEQ ID NO: 1574 - DNA, 1962 bp, Homo sapiens
  misc_feature (452)..(452): n equals a,t,g, or c
  misc_feature (480)..(480): n equals a,t,g, or c
acccacgcgtccggtacaaaacacagttttattctatgaaaattttgagattattagaaacattagatttagggttgcatattaaaaactatatccattttgccttattatttagtgtctcactcaggatataacacactataatagaaaatgtagacttcagaatcaggtatatttgagatggtttgtatactggttctgacacttgttagctattcatctttggtaaattccccattaccctttgtkcacctatwtgtggggatcagtgcatagtgtgtgtwaagcatttaatacctggcaagtgttcagcaaattttttgttctatatatttattatttgattattggccctgaggagtaggtgtttgtttgtttgtttgtttgtttagttttatttctcatctcctcaggaacacaaatgaaacttggatattgttatggtgcttttnataatatatttattattttcagcaattnattcttgttaaaacaatttcttatgacaagttactcatcttcaatggtgagaagaaatctagctcagaataatatatttttagtgtttgtatctctggatactcattttgctcattgccacgtaaagtaaaaaaatacataaattagcttattccaatgtaatatcttcaggatagtcatgggcaaggaattaatcacattaagagataactgcaactaagcactatttgaggtgacttctgtggaaaaaaaattaatyctttaccattgcagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaacgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaaaaaaaaaaaaaaaaaaaa

SEQ ID NO: 1575 - DNA, 2240 bp, Homo sapiens
tcgaccacgcgtccgcttcctcatgctgcccgctcgcctaccgttcaggctgctgagccttttccttcgtggatccgctcccacggcagcgcgccatggcctccgggagccgctcctggagaggaggtgcgctgccgcctcctccttccagcactcatcgagtctgggacgcgagcttccttatgaccccgtggacacggagggctttggagaaggtggtgacatgcaggagcgttttctgttcccggagtacatcctggatccggagccgcaacccacccgcgaaaagcagctgcaggagctccagcaacagcaggaggaggaggagcgacagaggcagcagcggcgggaggagcggcgacagcaaaacctacgggccaggtcccgggagcacccggtcgtggggcacccggacccggcattgccgcccagcggcgtgaactgctcgggctgcggggcagagctgcactgccaggacgccggagtgcccggctacctgccccgagagaagttcctccgcacggcggaggcagacggcgggctggcacggaccgtgtgccagcgctgctggctgctgtcgcaccaccggcgcgctctacgcctgcaggtgagccgcgagcagtacctggagctggtgagcgccgcgttgcggcggcccggcccctccctggtgctctacatggtggacctgctggacctgcccgacgccctgctgcccgacttgcccgcgctggtgggccccaagcagctgatcgtgctgggaaacaaagtggacctcctgccccaggatgctcctggctaccggcagaggctgcgggagcgactgtgggaggactgtgcccgcgccgggctcctgctggcccctggccaccaagggccacagcgccccgtcaaggacgagccacaggacggggagaatccgaatccgccgaactggtcccgcacagtggtcagggacgtgcggctgatcagcgccaagaccggctatggagtggaagagttgatctctgcccttcagcgctcctggcgctaccgtggggacgtctacttagtgggcgccaccaacgccggcaaatccactctctttaacacgctcctggagtccgattactgcactgccaagggctccgacgccatcgacagagccaccatctccccttggccaggtactacattaaaccttctgaagtttcctatttgcaacccaactccttacagaatgtttaaaaggcatcaaagacttaaaaaagattcaactcaagctgaagaagatcttagtgagcaagaacaaaatcagcttaatgtcctcaaaaagcatggttatgtcgtaggaagagttggaaggacattcttgtattcagaagaacagaaggataacattccctttgagtttgatgctgattcacttgcctttgacatggaaaatgaccctgttatgggtacacacaaatccaccaaacaagtagaattgactgcacaagatgtgaaagatgcccactggttttatgacacccctggaattacaaaagaaaattgtattttaaatcttctaacagaaaaagaagtaaatattgttttgccaacacagtccattgttccaagaacttttgtgcttaaaccaggaatggttctgtttttgggtgctataggccgcatagatttcctgcagggaaatcagtcagcttggtttacagtcgtggcttccaacatcctccctgtgcatatcacctccttggacagggcagacgctctgtatcagaagcatgcaggtcatacgttactccagattccaatgggtggaaaagaacgaatggcaggatttcctcctcttgttgctgaagacattatgttaaaagaaggactgggggcatctgaagcagtggccgacatcaagttttcctctgcaggttgggtttcagtaacacctaattttaaggacagactgcatctccgaggctatacacctgaaggaacagttttgaccgtccggccccctctcttgccatatattgttaacatcaaaggacagcgcatcaagaaaagtgtggcctataaaaccaagaagcctccttcccttatgtacaacgtgaggaagaagaaaggaaagataaatgtatgagaccgaccttgttcactccagatattaactgtattgaacacaacaaaatacattgaatttgtattaaacatataacgcataaataaagctcccattcttacccttaaaaaaaaaaaaaaaa

SEQ ID NO: 1576 - DNA, 1770 bp, Homo sapiens
cccacgcgtccgctgggtgccatggcggcagcggcggtgacaggccagcggcctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcaccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccgctacatgacagtgctgttttatttgaacaacgtcactggtgggggcgagactgttttccctgtagcagataacagaacctacgatgaaatgagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcgaaaaaaaaaaaaaaaaaaaaaaaaaaaaaaaagg

SEQ ID NO: 1577 - DNA, 2316 bp, Homo sapiens
  misc_feature (39)..(39): n equals a,t,g, or c
cgggggactctcaacgggaaagacttcctatagggaatnctggtacgcctgcaggtaccggtccggaattcccgggtcgacccacgcgtccggkgagagaagggggccttatttctcggaaaccagccctgctgccctcttcccatggccacaggagcctccccagtgacggagttgtgagattgggggtttctggtgtcctgacttccgtcccagggatcaccttgggtttcccacgttgcagagactaactgaaaggacatgagggctttaccctgggaatgctctgctggggcaggtgggtgttagctgcgattctgtgttattttcccatcctcagaggtctgcggggtttccgagaggctcgccgggatttctggcggggggctgagagcctggaggctgccctgacccacaacgcagaggttcccaggcgccgggcccaggaggcagaagaggcaggagctgctttgaggacggctcgagctgggtaccggggacgggcactggattatgccctgcagatcaacgtgattgaggacaagaggaagtttgacatcatggartttgtgctgcgtttggtggaggcccagsctacccatttcagcaggccatgaggagctgagccggctgtcccagtatcgaaaggagctgggcgcccagttgcaccagctggtcttgaattcagcacgagagaagagggacatggagcagagacacgtgctgctgaaacagaaggagctgggtggggaggagccagaaccaagcttaagagaggggcctggtggcctggtgatggaaggacatctcttcaaacgggccagcaacgcatttaagacctggagcagacgctggttcaccattcagagcaaccaactggtttaccagaagaagtacaaggaccctgtgactgtggtggtggatgaccttcgtctctgcacagtgaaactctgccctgactcagaaaggcggttctgctttgaggtggtgtccaccagcaagtcctgcctcctccaggctgactcagagcgcctcctgcagctgtgggtcagtgctgtgcagagcagcattgcttctgccttcagtcaggctcgccttgatgacagcccccggggtccaggccagggctcaggacacctggccataggctctgctgccaccctgggctctggtggaatggccaggggaagggagcctgggggagtcgggcacgtggtggcccaggtccagagtgtggatggcaatgcccagtgctgcgactgccgggagccagccccggagtgggccagcatcaaccttggtgtcaccctctgcattcagtgttccggcatccacaggagccttggtgttcacttctccaaagtccggtctctgacccttgactcatgggagccagaactagtgaagctcatgtgtgagctgggaaatgtcatcatcaaccagatctatgaggcccgcgtggaggccatggcagtgaagaaaccagggcccagctgctcccggcaggagaaggaggcctggattcacgctaaatacgtggagaagaagttcctgaccaagctgcctgagattcgagggcgaagaggtggccgggggcgcccaagggggcagcctcctgtgcccccaaagccttccatcaggccccggccagggagcttgagatccaagccagagcccccctctgaggacctgggaagcctgcaccctggggccctactgtttcgagcgtctgggcatcctccatctcttcccaccatggctgatgcccttgcccatggagctgatgtcaactgggtcaatgggggccaagataatgccacaccgctgatccaggccacagctgctaattctcttctggcctgtgagtttctcctccagaacggggcgaacgtgaaccaagcggacagtgcgggccggggcccgctgcaccacgcaaccattcttggccacacggggctcgcctgcctgttcctgaaacggggagctgatctgggggctcgagactctgaaggcagggaccctctgaccatcgccatggaaacagccaacgctgacatcgtcaccctgctacgactggcaaagatgagggaggctgaagcggcccaggggcaggcaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctcttcaaaaaaaaaaaaaaaaa

SEQ ID NO: 1578 - DNA, 1019 bp, Homo sapiens
  misc_feature (884)..(884): n equals a,t,g, or c
  misc_feature (922)..(922): n equals a,t,g, or c
  misc_feature (939)..(939): n equals a,t,g, or c
  misc_feature (965)..(965): n equals a,t,g, or c
  misc_feature (1003)..(1003): n equals a,t,g, or c
ggcgtccaggtccgctcggtaaccgtttcccgcgcgcccggccccgactccggggtaaagagccccggagcggagcagcgctggccgcgtgccgcctccggagccggcagcccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataataacttcctgtttcattgtattctgtgagtgataagtgtcagatcaataacagattaatttgttgttaacagctcntttttttttttttttttttggagacaggagtctggttngcccagacttggagtgncagtgggccaaatcctctggctcaantggcaaacttccaacctccccggggtttaaacggattnctccctggccacagcc

SEQ ID NO: 1579 - DNA, 586 bp, Homo sapiens
  misc_feature (1)..(1): n equals a,t,g, or c
  misc_feature (28)..(28): n equals a,t,g, or c
  misc_feature (550)..(550): n equals a,t,g, or c
nccgctcttagaactagtgatcccccgngctgcaggctggggggctccggttccctgagggatgagccttcagcctccctttgtaatgctgctcctctccactgcccagcaccatgagttgggtgcagacacctagaaggagagacttcttggaacgctcatcccccgctatacctccccttcctcctgcatctccccttctttccttccccctcaggagagagaaaacttagtgcttccagcccttcttggagccttcatggtccaggggtaggggccccactggcctgagcatgccattttgaggggagggtagttgtgcctacttatcccctggcagaggggatgccaggaccatggacatgaggcttgcccatccctgccaacttacacagcctgtaccactgtccccccttccttggctactttgacatgtgcctgctcctggcatttcaataaaacccggcttgggtctgaaaaaaaaaaaaaaaaaaaaactcgagggggggccggtamccaattcgccctatartgaatcgtattaaaattnaatgggcggtcgttttacaaagtcgtgactggggaa

SEQ ID NO: 1580 - DNA, 1089 bp, Homo sapiens
gaattcggcacgaggagaagatcgctcacaagagtttgaacataagctggaccacaaaggatagagtaaatgtggaaagatggaaaagaaaaaaagaaacctacaaacaccagatatgtagcccaaaagcccagcttctataacttgttcatggctaccgtacatagaagcacccaggactgcaatcccttttgtatacaagtttcttttctttctgagccaagtcaagaaacctgaaaactataaggcaggaaaaaagaagaagattaagrttatccatgatttcatcactcgggatgaccagtgttattgtactatttatcttaaaagtgtttttcaaatatttttctacaacatcatttttaaatgcttgcatacattttatacataaatgtaaactagttaactaattcctctattgctggaattttaagatgtctctaaatgatataaacaatatttcaaattttgtgattgggaatgtggattctagaatatgagtgtcaaggtccaagatttgtctccactgtttgttaggtgaattgcataaactctataaactcagtttcctactttaaaaaacagaagtgtgtcagtgacagtggtgtatgcctgtagtcctagctattctagaggcagaggggagaggatcacttgagtccaggagtttaaagctgtagtgtgccatgatctcacctgtgaatagccactgcactccagcctagacaacacagtgagacctcatctctaaaaaagaaaatagggggctaggcgtggtgttacgcctgtaatcccagcactttgggaggctgaggcaggtggatcacgtggtcaggagttcgagaccagcctggccaacatggtgaaaccccgtctctaccaaaaatacaaaaattagctgggtgtggaggtgcatgcctataatcccagctactcaggaggctgaggcaggagaatcgcttgaacccgggaggcggtggttgcagtgagcgaagatagtgccattgcactccagcctgggtgacagggtgagactctgtctcaaaaaaaaaaaaaaaaaaaaaaaaaaaaaaaaaaaaaaaactcgta

SEQ ID NO: 1581 - DNA, 1092 bp, Homo sapiens
aggccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggacgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtcttcacccctgaactaagacacagggagtatttcagaaggccaagcgtaggagtcatcgacaacgaaaaagccgagaacccagggccagcagttggagccttcagcagaaccagggcctggtccttgctaattgctgcagggtggagtttgatctggcagacccgatcctccttcatgaacacccagcaacctgagcaagtcccggccctgccctcagcgagcccggcaggcgtcccgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggaaaaaaaaaaaaaaaaaaaaa

SEQ ID NO: 1582 - DNA, 1376 bp, Homo sapiens
ggccacccttcccccacccagagactgggcagctgtgtctggtggactctgcgccccgccccctgcagccgtacttgcgcctcatgcggttggacaagcccattggaacctggcttctgtatttaccatgtacctggagcattggtttggcagctgaaccaggttgttttccagattggtacatgctctccctctttggcactggagctattctgatgcgtggagcaggctgtactattaatgacatgtgggaccaggactatgataaaaaggttacaagaacagccaatcgtccaatagccgctggagacatttcaacttttcagtcctttgtttttcttgggggacagctaaccctggcactgggtgttcttctgtgtctaaattactacagtatagctctgggagcaggatccttacttcttgtcatcacctacccactaatgaaaagaatttcatactggcctcaactagccttgggcttgacatttaattggggagcgttacttggatggtctgctatcaagggttcctgtgatccatctgtttgcctgcctctttatttttctggagttatgtggacactaatatatgacactatttatgcccatcaggacaaaagagatgatgttttgattggtcttaagtcaacggctctgcggttcggagaaaataccaagccgtggctcagcggcttcagtgttgcaatgctgggggcactgagcytagtgggtgtgaacagtggacagactgctccytactacgctgccctgggtgctgtaggagcccatctgactcaccagatttacactctagacatccacagacctgaggattgttggaataaatttatctccaaccgaacactgggactaatagtttttttagggattgtccttgggaatttgtggaaagaaaagaagacagacaaaacaaagaagggtatagagaataaaatagaaaattaatgaatgaaatttatctaggaatttttaaaacattttttacaaaatataattagatttgaatacaaaatctgatacaatatgttaaagaattaagaacctgaagatgaagatttagagcatatttacctggattttacttatttgctagcaaaattcccccttgtcacagaaaccagggactcttcaggatttgagatggccttgagtattttagttgatacattcttctgcccattataattctcacctgaagttatggggattgcacgggttttggcactttagaaaaagcctgatgtgggtcttacataaatgaatgtctgtataagaaaatggactcttttttttagggaaaaataaaagcaactatgggaaaaaaaaaaaaaaaaaaaaaaaaagggcggccgc

SEQ ID NO: 1583 - DNA, 589 bp, Homo sapiens
ggcacgagccccgcgcatggggaggtaggctcggaccggcccgcggagctgctgcagtccttcgcgccctcctcgccctccccaccgacatcatgctccagttcctgcttggatttacactgggcaacgtggttggaatgtatctggctcagaactatgatataccaaacctggctaaaaaacttgaagaaattaaaaaggacttggatgccaagaagaaaccccctagtgcatgagactgcctccagcactgccttcaggatatactgattctactgctcttgagggcctcgtttactatctgaaccaaaagcttttgttttcgtctccagcctcagcacttctcttctttgctagaccctgtgttttttgctttaaagcaagcaaaatggggccccaatttgagaactacccgacatttccaacatactcacctcttcccataatccctttccaactgcatgggaggttctaagactggaattatggtgctagattagtaaacatgacttttaaaaaaaaaaaaaaaaaaaaaaaaaaaaaaaaaaaaaaaaaaaaaaaaaaaaaaaaaaaaaaaaagggcggccgc

SEQ ID NO: 1584 - DNA, 1037 bp, Homo sapiens
agctactccgtctggccccgccttttctctgctctcctgaacctttaggcttgtctcggcccatttgaagaccaggaagttgatcaatcccgaggctgctgagagacggtggcgcgattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaggtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgggctgtgcttaagagtaaaacttcagcgatgtttaccatttaaacataagttggaaatctacatttctgaaggaacccactcaacagaagaagacatcaataagcagataaatgacaaagagcgagtggcagctgcaatggaaaaccccaacttacgggaaattgtggaacagtgtgtccttgaacctgactgatagctgttttaagagccactggcctgtaattgtttgatatatttgtttaaactctttgtataatgtcagagactcatgtttaatacataggtgatttgtacctcagagcattttttaaaggattctttccaagcgagatttaattataaggtagtacctaatttgttcaatgtataacattctcaggatttgtaacacttaaatgatcagacagaataatattttctagttattatgtgtaagatgagttgctatttttctgatgctcattctgatacaactatttttcgtgtcaaatatctactgtgcccaaatgtactcaatttaaatcattactctgtaaaataaataagcagatgattcttaaaaaaaaaaaataaaaaaaaaaaaaaagggcggccgc

SEQ ID NO: 1585 - DNA, 1031 bp, Homo sapiens
ctgacagtcaccgtccggaatcccgggtcgacccacgcgtccgggcgtccgcgtcggcgatccggggtctgggcgcggcgaggtctggtgtggcagatgtggatagctggaccctcctgggtgcctctgcgttatgtcgtttggttgatgcatttggagagaatctgtgctctccacaactgcaggggcaacatgctttcctggcctcttcagatcagggtggctgttcttgggtgctgcaccaaaactccagcagtgggctttcttcaagtggccggctcacctcattcctgccaagacccaggtccgtgttctcacagtgctgccatctttcctccgtgtgagcgtgggctgtgcggagatggacctcggtgtgtgcggggctgcgtgcactgccatcgctcccttctacacgagccggcgtggacccagggctgagctgtgaccacgagggccatcccgacgagccgccatggacccagggctgagctgtgaccatgagggctatcccgacgagctgccgtggacccagggctgarccgtgaccatgagggscatcccgaaactgtgattgttttctgaatgtggaagcgtcggccgagcgcggtccttggagaacccttgctgcggagaatgacgctcactctgcggcctggcctcgcctcmccatcccttctgcamactcacaggacaggattgatggggagagcccaggcgaaacgaagctgaccctastgaccagccctactggcggctctggaacaggcccgggaccggtggcctggagacagtggtcctttctggatgggctgcagtctccgaaggcttcccccactggagtcagccctttaggagtttgtccagtgcctccagaaagctgttttttgggggacggaggacttggcctggaattctggaattcccagggggtcagacatggttatgggaagtttaataaaaccggtkaatcacgtgaattctgaaaaaaaaaaaaaaaaaaaaaaaaaaaaaaaaaaaaaaagggcggccgc

SEQ ID NO: 1586 - DNA, 985 bp, Homo sapiens
ccacgcgtccggcacagatgagagcgctccgaagactgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagtgtgagtctggagggtgcccttcctccaccagccctgtggggagggacccccaggtcctctgcattaaaccagtttacactccaaaaaaaaaaaaaaaaaaaaaaaaaaaaaaaaaaaaaaaaaaaaaaaaaaa

SEQ ID NO: 1587 - DNA, 4598 bp, Homo sapiens
  misc_feature (948)..(948): n equals a,t,g, or c
tactgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatrccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtanctaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaacttctggttaatatcagtaccttgatgtcatcaccgtgatgacaaagagaagagttattgttgatcttcttggttttggtctgtctcttttcttaggataaagaaaaacttccaaactagaaaaacaggccctggttcccttagtttgcacttgaacccaatatgttgccttgtacatacttggtccctgtcacattgactgcttgggaggcttccagggagaagtatgagaccctgaggggtgagaatgggcagctagcaagaacatggaaattctgcttggcactacagtcataaatagaaaacactgtgtgtgctcaggggagcaggggatgccactgaagaaactcaagggaatgtgtatttgaaggaaatgcaaaaactaagtatttagcaaaatgaaattatgccttgatgactaaaaggcactagaaaggttgtgtctactaacttcagccctaatcagaacagatgcctagaaggagcatttttgtgacaacttcatagtgattagaatcagtggagaactccatcttagtggcaggaatataatgaaactacccacgcaagaacatggttgaatcacatttgcttgacttagggcaaagtacgaaagagagacaaaagggttctcttggaaacaagaagagtkactccagatgtggcctgaataattgccatgttaagttaatgcaaaagatcagaacagggctacatttgcacaggcagtttctctccgggccgtagttttcactgatgatcacctttcacagcattttccccaaccagcatttcacttagtcttctctatacccagcacctcccccggcacccccggcaagcccactatcacttccgacttccaacgtggcatccgtgagatctgtccacattaggcgaagcaggagaacactgagagcagcaggatgggtttggaaagagcatgcctctggaaacacagcttcctgggaattcacatgaggccagtcctacagagagcaagatgcaccccaggatttcttcattttctaatagatgtgggagtgctccattttccccgacagcgaatttcccctgagaaacgatactagaccctgggtttgcccaccttgtaactcttccttatctcctccttttcatccctaattcatcctccctctggcatggaattgacgcccgtgcagtacatttgccaagtggcaccttctttcaatttatgttttattttgctatggtggtgattctttatttgctggttgtcttttctcacacatctttctctctgtctctctctttcctgctctttgtttttctgcccagaaaaacctgacttcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaagaaaaaaaaaaccaaaaaagcggtctgaatttaatagtgtttataataaaaattttaaaaatgaccctcatagcacgcaaaacaggatggggaatttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcattttgtaaactaaaaaaaaaaaaaaaaaggttggaatagtgagcataataggtacaacctaacacattattatgtttattaactttgagacccagaaataaattcttttcttttcttgattcttgctcttaaaaatacaaaaaaaaaaatgttttgttttgtgttatttttggtttgtttattggggggctttttttaattgtcaggattatgatcttgctgtttttcttcaatatgtatacaaggtgatgtgaaaagatgacttgggcagaggagtaagaacaagtaggcttgttcttctactttgcttcagaattcagttaatgccaaaagcgaagatcaagcccatgttgatgtctcgttgctcacctgcatttccagagagtgtgacactcatgcagtccctgagaaaaataaaatcagggacatacttctccttttagccttttaaaaattcaaaaacgtttagtccaagggaactttttatgctatcaggaaaggtttttgctgtttttgattctgattatcacagccaagtactttgttttattctccctaattaataactacattccatgaggcctcttccaaccaaagaggccttttcttccaggagagtcccgcagagatgctggtatgatgggcaccattggttaagtaaactacatgcaggaagaagtccttggggccagtctgccagctgagtcctggttttggatgaagagttaatgagatattgggccaggctcaatgctgtagttttaatgctaagaggttacgtttacttcacagagtacacctcttagtaacctctgacttaggcagctgcttaaagcaaattgcaaaactggcttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatagtttcttttgttgcaaaaaaaaaaaaaaaaaaaaaaaaaaa

SEQ ID NO: 1588 - DNA, 1730 bp, Homo sapiens
cccacgcgtccgggggcctgtggcggagtccaagaggaactaggccgccttcgggatggtgtggagcgctgctcctgccccctgttgcctcctcggggtcctggggctggtccaggtgttgggggcccaagccgtgggcccctggacggcttcagcgtgtttgggggcagctcaggctcagccctgcaggccctgcaaggagagctctctgaggttattctcagcttcagctccctcaatgactcactgaatgagctccagaccactgtggagggccagggcgctgatctggctgacctgggggcaaccaaggaccgtatcatttctgagattaacaggctgcagcaggaggccacagagcatgctacagagagtgaagagcgcttccgaggcctagaggagggacaagcacaggccggccagtgccccagcttagaggggcgattgggccgtcttgagggtgtctgtgaacggttggacactgtggctgggggactgcagggcctgcgcgagggcctttccagacacgtggctgggctctgggctgggctccgggaaaccaacaccaccagccagatgcaggcagccctgctggagaagctggtcgggggacaggcgggcctgggcaggcggctgggtgcccttaacagctccctgcagctcctggaggaccgtctgcaccagctcagcctgaaggacctcactgggcctgcaggagaggctgggcccccagggcctcctgggctgcagggacccccaggccctgctggacctccaggatcaccaggcaaggacgggcaagagggccccatcgggccaccaggtcctcaaggtgaacagggagtggagggggcaccagcagcccctgtgccccaagtggcattttcagctgctctgagtttgccccggtctgaaccaggcacggttcccttcgacagagtcctgctcaatgatggaggctattatgatccagagacaggcgtgttcacagtcgccactggctggacgctacttgctgagcgcggtgctgactgggcaccggcacgagaaagtggaggccgtgctgtggccgctccaaccagggcgtggccggcgtagactccgggtggctacgagcctgagggcctggagaataagccggtggccgagagccagcccagcccgggcaccctgggcgtcttcagcctcatcctgccgctgcaggccggggacacggtctgcgtcgacctggtcatggggcagctggcgcactcggaggagccgctcaccatcttcagcggggccctgctctatggggacccagagcttgaacacgcgtagactggggtcccgcccgacgtgtctacgtcggctgaagagacagcgggggcggcgggctcctggggtctcgcctgagacggggcacctagccctgggcgagcgccgcacccgggcccgcagcggcaccgcgcccagagcggcctctccccacgcccggggcgcgccggctcagggaggctcggggccgcccatgcagacttttggcctggcgcgatcccccaagaacccctccagggccggcctgcggaggagccgatcctcgcaccctccgctccctccactggccctccaggtcgattccctgggctccaggctcccccgcgcgggcgccgcccaccgccatactaaacgatcgaggaataaagacacttggtttttctaaaaaaaaaaaaaaaaaaaaaaggggccgg

SEQ ID NO: 1589 - DNA, 970 bp, Homo sapiens
  misc_feature (37)..(37): n equals a,t,g, or c
ggcagagcttaggagaacagctccctttggatccctntcaaaggtgataccattggctcccagcttagagtaagaagctctgagaagttgaatgaagggtgagatagagatgctgaacccattcttscagcttcttctagtgttgttatttccagaatggccaacacccctacattgatacataaacacattccaaggccttgtgtaatacaaagttcaccgtcctcctggaataggagccctgggttctagttctcactctgccactgggggaaaatccaattaaagtctggtttagtcagcttgggtcaccatagactgggtggcttaaacagcagacatttatttctggtagtttctggaggctacaaatctaagagcaaggtgccagcatggtcacattctggtgagggscctcttcctggcttgtagacggctgcyttctcaccgtgtgctcacatagcctttcgtgtgtgtgtgtgtgtgtgtgtgcgtkcgtgcaagcttcckgatgtctcttcttagaaggacaccaaccccatcatgagagccctactctcatgacttagcctaaccctaattaccctccaaaggccccatctccaaatgccatcacattggagggtagagcttcaacatagggattttgggggacacaaacattcagtccataacaaaggctgtagtccttartttccttgtctgtgaaatgagagtgttgagattctttctagcctttatcatttataattctgtgagatgtagatttgcattattttcgagttcgagttatatgaaatgtttccctctacattttcttgggcaactgagaactgaatagggctaggtttaaatagagttaggcagttaggcttattcttttatttaataagcatttttggagcatctacggtgttccaggaactgaactgttgtaaacattggagctgtaacagagaacaaaagagac

SEQ ID NO: 1590 - DNA, 300 bp, Homo sapiens
  misc_feature (273)..(273): n equals a,t,g, or c
  misc_feature (294)..(294): n equals a,t,g, or c
caacccctgccttttttttgttttccatttgcttggtagatcttcctccatccctttattttgagcctatgtgtgtctctgcccgtgagatgagtctcctgaatacagcacacttactggtcttgactctgtatccaatttgccagtctgtgtctttcatttggagcatttagcccatttacatttaaggtkaatattgttatgtgtgaatttratcytrtcattatgwtgttagctggttattttgcttgttagttgatgcagtttcttccnggcatcaatggtctttacaanttggca

SEQ ID NO: 1591 - DNA, 773 bp, Homo sapiens
gcacaggtatgttttctgatggcacaggcgaggtcacagaaaagtggatggcaggcgttgctgtctgtcagaataacacgaaagtgagagaaggccgctctttcagaataacaccacaagtgggagaaggccgctccctcagggctggccatgaataaatggggatttctgcctgttytctccctcccgcctcactcccttttcctgcagaggcagctcctgagccattgccgagcaggatgctagttttagcatggattacatttccaccgtgtaaagcctgctgcatgatgtgcatcttctccagccgcctccttcagcaggagarggtttgcacarttgtccagggaarggaacctaggggcatggcccaacgggacagaggatttgartccctctgattatgagcaggttaatttaaaagtgaaaaccatggttacccattgccctttaaaaamcacccaggggccgggcacagtggctcatgcctgtaattcccagcacttttggaggccgaggcaggcagatcacaaggtcaggagatggagaccatcctggctaacatggtgaaaccccgtctctactaaaaaagtacaaaaaattagccaggcgtggtggcgggccgagtagtcccagctgctcgagaggctgaggcaggagaatggcgtgaacctgggaggcggagcttgcagtgagcctagatcgcgccactgcactccagcctgggtgacagagcaagactccatctcaaaaaaaaaaaaaaaaaactcgta

SEQ ID NO: 1592 - DNA, 542 bp, Homo sapiens
  misc_feature (429)..(429): n equals a,t,g, or c
  misc_feature (473)..(473): n equals a,t,g, or c
  misc_feature (510)..(510): n equals a,t,g, or c
  misc_feature (518)..(518): n equals a,t,g, or c
gatcttaagcatttttaagcacccctggatagctctcaatgacaccctgcgctggctgtcctggagtcacctgggggagggagggaatgggttgctagatggtgcatgtcagtaatttgccttggtgtttgatgacattaagtatattcgcattgttgtgcaaccatcactgccatccatccacagaacgcctttcctcttgcaaaactgaaactccgtagtcagtaagcaacaactccccagtccctcatcctccacctcagcctctggaaaccactagtctactttctatctctgtgagtttgacactctcagtaccttgtacaggtggaaccatacagtatttgtctttttgtgactggcttatgtcacctagaatagtatcctcgaagggggggccggtacccaattcgccctatagtgagtcgnattacaatcaatgggccgtcgttttacaacgtcgtgactggggnaaaacctggcggtacccaacttaatggcttgcagganatcccccnttcggcagtggggtaataacgaag

SEQ ID NO: 1593 - DNA, 372 bp, Homo sapiens
  misc_feature (1)..(1): n equals a,t,g, or c
  misc_feature (283)..(283): n equals a,t,g, or c
  misc_feature (285)..(285): n equals a,t,g, or c
  misc_feature (330)..(330): n equals a,t,g, or c
ntttgggtggagtttccaaggtgaaagtttctgaattggtcaatcagtgacgcctttgtaaagatggctcatgtggtggtcgctcgcaatgaatgcctgataagggcttttctgtttcttttgcactgtgtaagtttgctcccatcgcctggggaagttaatatcagacacacactttttacggtagaagagaggttgactactccaagggcactgaaactctcactgagccttattgtttctctacacgcgacttgcagaaagcaggagtgctcgagcatcngngaggaggtctgtcctacaacccttgaaggttgtggcactgttgtncatggaagttcaaatgctttcaattcctgaccatttgggggt

SEQ ID NO: 1594 - DNA, 476 bp, Homo sapiens
  misc_feature (297)..(297): n equals a,t,g, or c
  misc_feature (331)..(331): n equals a,t,g, or c
gaattcggcacgagaggacatggattatgggtactactcagcaggccagtttttactccacctctttctagctgacttgacacaagcaacaacccaacagaaaaccaatacttctgagaatggctgcaagtttgtttgtgctgtcttttgaggtaagaaatcaaggctgagctcttctttctcctaattctcaggaaggaggaaggcagatgtgagaacactgattgggtctgagtgtactgggcagcatcactgttaaaaggtcagcacacagatgcaagctcacttgtctgcttnctttcatgtgactgaagtggttaagaargttgtncaactcccccctgcacccccctcaccaccgcagtaagggagagacagggccaaacctgcagcttcggtagaagaggccaaggcaggtgtccaaggccagatcagcagtcagccagggcaaatgggctcactctggttacatgacc

SEQ ID NO: 1595 - DNA, 2342 bp, Homo sapiens
ggcacgagctcagatctctcctggtaccccttccccacgcccttagataatccatctcaattcctcatgctaattgaggagctatggctgcaaggcaccttccaggatttcacacctacacaaatctcctttttctccttttgccttctctgcttatgggatattctgagtccccacccccaatcactgacagctgggcccccttcatcagcctcacacaccacgtattaagtcagtcacaatckcccctctcmtctaactgctggatttgtctttctacacacacccaatgattcacggctcttccggctgamctacttacatggacacagtccaacgtgagcttacacatttcttacttggctataccattcttggctgattcattcctgaaamcggttcataacctggaaactcagctaaacacctttccttcaaactcagctctctcagcatggtttcaggtagggctgttgccctccttcacctaatagcttctggactaacatccatacaaaccaacacagcatcatctaaaccaccaatatgggggtaccatttctactcaaacttccttcatatccccaccccccttatgtctcagccgaacctaccctaatccagcccacgccacaatggtgggacaggttccccagtccctatgtggtcttatttttacccttgcactccctgtagaccatcaattctacaccctaattacaaaatcatatccacctctgcctggcagaaggtgttatgcttttctggctcgcctaccatccacacatccctacacctcaccaccggatcctcttttctttccttccatccaattcctggcttccccgctgccaactctgctctctatgtctccagtttaaaggtgccccctggaaaaaatgtaacaattccctcacctgtgactggtacctgacagccaccacaccggggcagcaatggctaacggttgacaaagacaatttctttctctctccaaaaccaaacagccttcatcaactccctagccaagactccctatcaggcccttacaggtgccgctctggctggcagttacccaatttgggaaaacgaaaataccctatcatggtacctaccttcacctacaactttgctgtcacccccagttctcttttgtgtgatacaactgatatttkgcctaccagccaactggtcaggaacttgcaccctggtctttcaggctccaaccatcaacatcctaccccctaaccaaactattctaatttctgtagaagcctctatctcctcttcacccataagaaataaatgggctctacatctcatcaccctgctaacaggattaggcatcactgctgcacttggcactggaatagcaggcataaccacctcaatcacctcataccaaacactattcacaaccctttctaacaccgtagaagatatgcacacttccattaccagtctccaacgacaattagacttcctcgtgggagtcatccttcaaaactggagagtcctggacctcctaaccactgagaaagggggtacctgcatatacctccaggaagaatgctgtttctgtgttaatgaatctggcattgttcatatcgcagttcgtaggcttcatgacagggctgcagagctttgacatcaagtcgctgactcctggtggcaaggatcatcccttctaagatggataccctgggttgcccccttcctaggacccctgatcttcctcttcctgttactaatgattgggccatgcatatttaaccttgtatcccgcttcatttcccaaaggctgaattgttttatccaggcaagcatgcaaaaacacattgataatatatttcacctttgccacgtctaataccagagcctacgaggaaaccattcggaagctccagaacccaggccctaatcacaacgcccctatccagcaggaagcagccagatgatcaacgacgccctttttcctttttatactaaagtaagaaataagaatgttagcccaaactgcactattttgcagacccctaccattttacaaactggtcagagtggaaaattccaccagggcctgagctgtgagaaacatcctgtcaggcaggtcccaggcctaacccctggctgcactaaattccttcattatcagcagccaaacacaccgcccccaccccattttcacaacaatcccagacctctcctgcccgggactgtaactggtccagcctgtaagcgggaagggggctctggcactagctggtaccccctctccgcaggtctttctcccaataaatctgtgttgccattgaaaaaaaaaaaaaaaaaaaaaaactcga

SEQ ID NO: 1596 - DNA, 3478 bp, Homo sapiens
ggcacgagcatgcttctacttctggtgtttttggtggcttgttttatcaacaggaaatgccagaaacagaggaagaagaagcccgcagaggacattttggaagaatatcctctgaataccaaggtagaagtgcccaagaggcacccggaccgggtggagaagaacgtgaatagacactactgcactgtgcggaacgtcaacatcctgagtgagcctgaggcggcttacacgttcaaaggtgctaaagtcaaaagactgaatctagaagtcagagttcacaacaatttacaagatggaacagaagtttaatggaggagacctatgtgtatttttttctaaaatcatttttataaaatggggggaaatactggtatttttataatctcgcagataaaaaagggaaaactatagctttgagtggcagacagcacacatcacatgcatcaactcacaactgagctacctcattcagcaaagaaccactgagaaccccagagtattacagttatttccgtagatccctttaatagtgtcaacaactgtacacagctccttctgtaaggctggtcttagaaaacaagtactttagtttcaggacaggagttgaacaattaggttagcagatggagatgagaggactgggtagagtaccatggcagatctcagagagaagaagtaggtacgggcctttggttccctcccccagccccagctttctcctacagggcttttcctgagtccccagacagcagagtatgaactgctgacacccagattccattaaaaattctgctaatcgacacaacacatatatttgctcatgatttcacttgacagcgtatgctccttggcctctaattgtactttgcttttccagagccctttttacctggggatttcagtgtgcttaagtaaaatcctctgaaaaccacgggagcctctgcctcctcagccacagagaactccctcctacaaagggggagactgaaacccgagttaaggaggggcctggcaggcgtatcagagcacattagtgatgcccttcaccccagggaggtgtctgttcccaactagtttatgtggcactgagacatccatccctgaccaaggatgctgcgaaacaggatcaatgtactacggccttttaattcaacattgccataaatgctttaaagaaaacccaccacactttcctcctactccggtctttgcccgttcctgtaacagacaatcccatgtcctaggtatggttttttattctgttagtgcttcgggaaagtaagtgattcatttgaataaggcaaattaggagaaagcccaggttggggtgaaatcagacttaacagatacatgctggttctccttgctgtgtgtgacacagcagacagaggcactattcctggtgcagtatttcagggatttctctttgaggggttcttttctggtagctcaggcaattatttttaccatatcagcacatgacaaggccatgaacacatggctctaaaataatttagtgttcaagtatcagcttaactattttgtgtaggctacacacagcttgcttttgtttctcttctgtttctgccttattggcggaaacataagcgtgcatgccatgttgttttgaattggaggcacaatttcattattcgagagtaaaagacatgtcctcttctgatgcatggcacaccatagtcaccaagcaaataacagagccttcacattgtgtaatatttgtatgagaatgactcaagctctttgagaacattccaaactagtaacatttcgctactaaaagctagaaaggatgaactgtgaaaggttctaggcagctctgtgagactccaagctccttgaaagtaggacctttgtgagccacgcctttcattcttcaacagtgccttgcatgtaacaagcactccagaaatgtttgttgaatgaatgaatggtgtcatgggtgaatgatggggagtaaatttaggaaggggaagtgagagagtatggtggcaatatcacaagggaggagagaggaaaacaattatcttctctacttggattatgagataaccttttcttggaggaaagaaacaccgctttacaaaggcatgactctggcggtggtcctaaggaagcatgagcagaaaattcataaaaatgtatcatcagcaggagatgagactatgaattggcatccagaacaggagatttagagcaaaatctaatttagcattctgagatgagtgtcaggttttcaggagagaatgagttggggtgagcccagagtctgaaactcctgactggtcaggtgctacttaagaccagcttgggcaattcagggcagaactcctgtatcagcctcatggacacccagaattggtatctcatggctggagagctgatcagccaggcacagaatctccagaacaacctagagagtgaatgctaatttgtagagcgaatttccatttggcccattatttgtaactgtgtaactgctccaagtgccagaatgcttacacgttaaagcagcacctttccatttgcccacatattcttcttgcacaccccttccattactgctgaataggacattgcatgggaagagtacagaggtggcagaatgaagctagagtgggaaggactaaagactgagccccagagtgctcccagcaaccgccacgtacaaggtctgaaatgacaagggcaagagtgagataggaaactgtgtgtgaaaggaaagcccttgcagtatttctgcctccctttctttctgcctttcaccccactaaatgaacgttattgaatgccagtacttctctagtggatgcacacttgttaaatagtgttaagagatgtggagatgagatatacccctttgatgtagaattattcatttggtttgtttcatacttcattataggaatcaagtaatttgatgactaatgtggattatatttcagtcaaagctctgctttcaatttctctgatttgctcactaatgccttatgtgtgttttactaaccttttatatcttgccttcaagtgagaaggaacaaacaactctcagtggttactacttgcttttatatgctggctgtgaaggttaaaagaaagaatggtctgtaccattttttctgctttgctgcccttttattgtaccccaggcctcctagaggactcctgcagattctattgttgggtgggaaatagtgttggaatgtgtttgcacagtcttatgatattcagtctcagtctgctataggtatttgttattcttggatactacacacctgctcagactgagtaaacatttgtggtgctgtcaacctgatttcttgactctcaaatgatttttgtatttccaatatgaatttgtgtgttatgaatttctgatttctccaatagtatatgccactatataaatttgtattaataaatgacagtcttgttggtttttaaaaaaaaaaaaaaaaaa

SEQ ID NO: 1597 - DNA, 2160 bp, Homo sapiens
cccccgggctgcaggaattcggcacgagagaaaatgaaagccgacgtccacagggacccaggcagggttgggtgttgtgactcactccacctctgtgccctgcagaggtactgttgggtccttgtcttgtgagcctggggtgagctctctgtacatgttgttgttccacgtatgggttgacttggcatgctggggggtcctcgttcactctctgaagttggcctcctttcactggggattgaaaagcacctccacccctaccctagtgatgtcccctgaggacccgggtgatagtacagtcaatattgtcagtactttgctttgattgaaggctgtagagctgagttaccaaaatttctatttcaaaggaaaccaaaccttaaaaaaaaaaaacaaaaactgggctgggtcttccaaacctaccatgaaaccctggtgtgcaggctgcactcaatgacctcaacccaacacctccctgagtgtgcttcttggaagagcctagaagattcctggatggagaccccattggttcagcctcaagtctggcccgtcttcgaaaaaacaaacacatttgtaagctttgtgggagcttccaggcctgctctaagatgccttgcttgtcctttgacccatcagcatggagctcagtggttgctgtttggttctgcaggctggtggggaggccgcccattgtggtggggcatctgtccagccccattgccactcagggcatccaaacaggaggcacccgctgggaagggtctaaagatactccttgtggccactgctactgttcacacttgacttgtggagaagcgaagggctgaggggaggtttgtgtacacccatgtatttaaaagtgactgactgactgaaatgagcacataccgacatatgcaacatactaataccttcctgattttcgagactttctaattactacaactaacctgttgtgctcacctctggaattcagaaagagagccactgcgagcactgaccacaagggctgccttaggaaggaaatgtgtgctttcaggagttcttattaggggaattttaagagcacaaaaattttattgaacccaccttagtgacaaacagaaaatgatttgttagattgtcagttggaaggggtttattatgactgctggtgaaataaacagtgaccagtttctgccaacatttatggaaataacgtttctaggttttaaatgtgagccgtaaactgaagctacttcagttaaaaaaaaaaaaatcaatacttaaactgtagggaaaaggtggattggtgccagagaaaacattatttaatagtgtcagaacatggaactgcaacacagtttgtagcaaggcactgagaaaaacccacaactaatccttcatcgcagctgtctgaactcttgatcatctgccatcccccaaacagtgacttctttttttctggtgactccaggcctgaatgacctagtgtggagagtttaaactatgtacaagggaggaaagaaaaaaaggaaaggaaccttaagtaagcctcagccaaaggttttatgcattggacttcctgtgcctgcccccaggggcaagactgatccccatgcctgtgcccatgacatctccctgaaagaggacaccatgacagcccggctttgccttgactgacccactgctaccccagaaataagaatcaagagcagctattgttatccttagagtgttttccgtctagggccggctcgtgaacagccacatatccttgcacctgacactgtccccacacaaatagctggctttcgttgcttgttgaatgaatgagtgagttggctctatatccccttggagctggccggtaagatattagtgcctcattttacaagaagagaataggaaggaattaagcaatttggccaacagatacaagatagattccagagttttatctcccactttagggtggcagccagtaggccaaactccaaagaccgttgctgatgtctttttctgcctcccctctttgggttagtgtggtatgtacaagctcactcttgttgaaaattagaaaatagttgaaaacaaaaggtttttgtttttctttttaaatcacattaaatgttttacattgcttaaaaaaaaaaaaaaaaaaaactcgagggggggccc

SEQ ID NO: 1598 - DNA, 1848 bp, Homo sapiens
gaaactggaccggagaaccggagcgaagcgaagcggaagcccggaatgaggccggactggaaagccggagcggggccaggcgggcctccccaaaagcctgccccttcatcccagcggaaaccgccggcccggccgagcgcggcggccgctgcgattgcagtcgcggcggcggaggaagagagacggctccggcagcggaaccgcctgaggctggaggaggacaaaccggccgtggagcggtgcttggaggagctggtcttcggcgacgtcgagaacgacgaggacgcgttgctgcggcgtctgcgaggcccgagggttcaagaacatgaagactcgggtgactcagaagtggagaatgaagcaaaaggtaattttccacctcaaaagaagccagtttgggtggatgaagaagatgaagatgaggaaatggttgacatgatgaacaatcggtttcggaaggatatgatgaaaaatgctagtgaaagtaaactttcgaaagacaaccttaaaaagagacttaaagaagaattccaacatgccatgggaggagtacctgcctgggcagagactactaagcggaaaacatcttcagatgatgaaagtgaagaggatgaagatgatttgttgcaaaggactgggaatttcatatccacatcaacttctcttccaagaggcatcttgaagatgaagaactgccagcatgcgaatgctgaacgtcctactgttgctcggatctccatctgtgcagttccatcccggtgcacagattgtgatggttgctgggattagataatgctgtatcactatttcaggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtttgaaagagaagatagtgaggagctttgaagtctccccagatgggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggttcatcttccttcctgtacagtattttcaaacttcccagtcattaaaaataagaatatttctcatgttcataccatggatttttctccgagaagtggatactttgccttggggaatgaaaagggcaaggccctgatgtataggttgcaccattactcagacttctaaagagactatttgaagtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttgaaaaaaaaaaaaaaaaaaaaaaaaaaaaaaaaaaactcga

SEQ ID NO: 1599 - DNA, 2371 bp, Homo sapiens
ggcacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtagctatgccagcggggctgggcaggccagccgggcatcctgaccgatgggcaccctctcccagggcaggcggcttcccgctcccaccagggcccggtgggtcctgggttttctgcaaacatggaggaccactttctgataggacattttcctttcttctttctgttttctttcccttgtttttgcacaaagccattatgcagggaatattttttaatctgtagtattcaagatgaatcaaaatgatggctggtaatacggcaataaggtagcaaaggcaggtgctttgcagaaagaatgcttggaaacttgagtctccctagaggtgaaaagtgagcagaggcccctagaaaccctcctctgaatcctcctaattccttaagatagatgcaaaatggtaagccgaggcatcgcgcaaaagctggtgcgatgcttcagggaaaatggaaaacccacgcaagaataatgattgattccggttccaaaaggtgtcacctacctgtttcagaaaagttagactttccatcgccttttccttccatcagttgagtggctgagagagaagtgcctcatccctgagccacacagggggcgtgggagcatcccagttatccctggaaagctagaaggggacagaggtgtccctgattaagcaggaaacagcacccttggcgtccccagcaggctccccactgtcagccacacacctgcccccatcacaccaagccgacctcagagttgttcatcttccttatgggacaaaaccggttgaccagaaaatgggcagagagagatgacctcggaagcatttccacagatggtgtcagggtttcaagaagtcttagggcttccaggggtcccctggaagctttagaatatttatgggtttttttttcaaatatcaattatatggtagattgaggattttttttctgtagctcaaaggtggagggagtttattagttaaccaaatatcgttgagaggaatttaaaatactgttactaccaaagatttttattaataaaggcttatattttggtaacacttctctatatttttactcacaggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctcattgatgtgatgttacattccctttaatctgccaactgtggtcaaagttcataggtgtcgtacatttccattatttgctaaaatcatgcaatctgatgcttctcttttctcttgtacagtaagtagtttgaagtgggttttgtatataaatactgtattaaaaattaggcaattaccaaaaatccttttatggaaaccatttttttaaaaagtgaatgtacacaaatccacagaggactgtggctggacattcatctaaataaatttgaatatacgacaaaaaaaaaaaaaaaaaa

SEQ ID NO: 1600 - DNA, 1461 bp, Homo sapiens
gaattcggcacgaggctaagggctgtggcctccgtgggagccgcactcattctcttcccttgcctactatacggggcatatgccttcctgccgtttgatgtcccacggctgcccaccatgagttcccgcctgatctacacactgcgctgcggggtctttgccaccttccccattgtgctggggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccggctgatctactggctgacctttgccgtgggccgctccttccgaggcttcggctacggcctgacgtttctgccactgctgtcgatgctgatgtggaacctctactacatgttcgtggtggagccggagcgcatgctcactgccaccgagagccgcctggactacccggaccacgcccgctcggcctccgactacaggccccgcccctggggctgagcctctccgccctcgccctcggaataaggggtacggcttgggtctgacacatctttgaaccttgtggccaggcctggacttccgcccccaggctctaggaacgcggtgggtggaaccctgctactgccccaacagggactccaatcaatcggagttctccccttgccggagctgcccttcacctttggggcccgagacagtcataagggatggacttagttttcttgcagggaaaaaggtggacagccgtgtttcttaaggatgctgagggcatggggccaggaccaggggagaggcacagctccttcctgagcagcctctcaccactgccacaaggctccctaatgctggtctctgctccactccccggcttcccgtgaggcaggaggcagagccacagccaaggccctgaccacttctgtgccagttgtctaagcagagcgcctcagggacgctggaaatgccttaaggatagaggctgggcatcacatcaaatgggactgtggtgtttggtgaaaaccttcctgaggatctggattcaggaccctccatgactggcctatttactgtttacagctggccagtgcagagctgctgctcttttacctttttaggcccctgtaacttcccacctttaaactgcccagaaggcatgcctctcccacaggaagaggggagcagacagggaaatctgcctaccaagaggggtgtgtgtgtctttgtgcccacacgtggtggctggggaagtgcctggatggtgcggtggttgatgttaacctagtgtgtgtgtgtgtgtgtgtgtgtgtgtgtgtaacaataaattactaccagtcaaaaaaaaaaaaaaaaaaa

SEQ ID NO: 1601 - DNA, 696 bp, Homo sapiens
  misc_feature (11)..(11): n equals a,t,g, or c
tttcccccttntaatttttttgctatgaagaacatacaaagaacaactggcaaaacatgaatgtacacctgtaatttcagatggtcaaaatgaactggtgtaatctcctgacttttatggttgtattgtggttatgcagggagaatgtccttgctgggaggaaatacactgaagcatttggggatcgtgggtatatcagtttggcaacttactatcaaacagttcaggcgagggggaagctctttgtattataattgcaacttttctgtaggtgtgagattgtttcaaaataaaacaaaattatgtatttgaaaaataatcctcatcctcctttccaaacacataagattactgaagttaccttaggtgatagcagccctgggaattaatcatccacagctgatacttggaccaacacccctataagcaacactattccattcttagtaggaagggaggctcagttgagtgcagagccttctgagtttgggcccgaggcatttcaaggtagcctcttctctttttctactcataagcacaggcttagatgaaaaagagaaggaagaaaaagaactttgaattaatttgtctacacaatgggacagattgagaaaaaatttaaaatctgtgtcaagttcattgcattagaaacagtgaatcagcctgatataataaaagtacaattggtctcgtgcc

SEQ ID NO: 1602 - DNA, 1292 bp, Homo sapiens
gctgccttgctccacacctggtcaggggagagaggggaaagccaagggaagggacctaactgaaaacaaacaagctgggagaagcaggaatctgcgctcgggttccgcagatgcagaggttgaggtggctgcgggactggaagtcatcgggcagaggtctcacagcarccaaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgyctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagsccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgaaaaaraaaaaaaaaaaaaactcga

SEQ ID NO: 1603 - DNA, 1389 bp, Homo sapiens
gaaaaaggcagagtctgtgtcatgattggagtccagtgttgcacttttatccctattaacacagcccctaatggaacaattacaaaagcattacagggccttacaagtgaattagctgaaaatcccggaataaatggccccttttcaggtcttatggaaaaatggtttggaaaatggaaatgactcatgacctcaatatttacttctcttgcagttgttacaggtgtactcattcttgtaggttgctgtattacaccttctgttcatgggttggtgcaaaggcttacagaaacagctcttactaaaacctccctcaattcttccccaccctattcagataaactcccacttctagatcaccaagaggaacaacagagccaaattatgtttgaaaaatttgaagagggaaaactataaagagggggatattgccaggaaccataagttctcttcaaacttcgtggtccttctgggtctgtaaacaacccttcccacctaattggtaccaggaccagcctcttccttcctgcctaataggccctattcaatttcaaacaatagccaatcgggtttagatggtgtggtccaactctagttactggggaaaggacacagaaacatgagctgcattaggggtaaaaaccccctgccctagcccccttggtgtgctcttgcaattgctttcagatgcaagtagcaccctttctgcagaagtaaagttgtcttgctgaggaattttcagtctaagtgctagttctttctttgtggcacccaacacctgttcccaacaatgagaatatcaacaaataggaaatataacaaagaaccaaacagaaatgaagataaagatacaataatgaaaattaaaaattcactggaagtgtttgacatattatttgattccattcttcctaaatatgatttcaatcttcttaaatgtattcagtcctgttttgtgacctatcctggaaatatgtgatgtgatctatcctggagaatgttctgtgtgcacttgagaagattacatatttttcttttgttaattgaaaaattctgtatatggctattacatcaatttaaagtccactattttgttattgattttctatctggattttctattttttattgaaagtggggtactgaattattctaccattacactattgctgtccatttctcctttcagatattttgatatttgttctatatacttaggtagtctaatagtaggtacatatgtatttacaattgctgttatcttcctgttgaattcacccttttatcattatgtaatgactttgtctcctgggacagtttttgacttaaattctaatttgtgctatataagaaaaaaaaaaaaaaaaaaaaaaaaaaaaaaaaaaaaaa

SEQ ID NO: 1604 - DNA, 914 bp, Homo sapiens
ggcacgagctaaggctaagaaagaacactgtgaaattttcattatatagacattttaaaaatactctgatctttgctgtgctggcttctatagtgtttatggggtggacaactaagacatttagaattgcaaaatgccaatcagattggatggaacgctgggttgacgatgcattttggagcttccttttttcgcttatccttattgtaatcatgtttttgtggagaccatcagcaaacaatcagagatatgccttcatgcccttaatagatgattctgatgatgaaattgaggaattcatggtaacttctgaaaatttaaccgaaggaataaaattaagagcctcaaaatcagtttccaatggaacagctaagcctgccacttctgagaactttgatgaagatttgaagtgggtagaagaaaatattccctcttcattcacagatgtagctcttccagtgttagtggattcagatgaggaaatcatgaccagatctgaaatggctgaaaaaatgttctcttcagaaaagataatgtgattggaacccgtataagaaatgtagttaagcctgaaggactatccttcatcaagactgaaagtgagctttgatttgatattgcctaaaaatttttattgtgttatcttggaagtctgtgtatcaaaatgaagaattcagatggtaggaggttctatagtccttttaaagctgactcttgagtgtcagttgaatatccattaaattggatttggaaataacctgaggaaagtattatgataaagatctgcacagatgcctcttagctgataggtggcaggcctgtgggtttgggttctccctcttttctctggaacatatgacaattccagattaaagaaaaatgttttttaataaaaaaaaaaaaaaaaaaaaaaa

SEQ ID NO: 1605 - DNA, 2284 bp, Homo sapiens
ggcacgagatttgccggtcataggagcaggaagtgtcgaccttgcagcaggatttggacactctgggagccaaactggatgtggaagctccaaaggtgcagaaaaagggctccaaaatgttgacttttacctctgtcctggaaatcaccctgacgctagctgtagagatacttaccagtttttctgccctgattggacatgtgtaactttagccacctactctgggggatcaactagatcttcaactctttccataagttgtgctcctcatcctaaattatgtactagaaaaaattgtaatcctcttactataactgtccatgaccctaatgcagctcaatggtattatggcatgtcatggggattaagactttatatcccaggatttgatgttgggactatgttcaccatccaaaagaaaatcttggtctcatggagcccccccaagccaatcaggcctttaactgatctaggtgaccctatattccagaaacaccctgacaaagttgatttaactgttcctcagccattcttagttcctagaccccagctacaacaacaacatcttcaacccagcctaatgtctatactaggtggagtacaccatctccttaacctcacccagcctaaactagcccaagattgttggctatgtttaaaagcaaaacccccttattatgtaggattaggagtagaagccacacttaaacgtggccctctatcttgtcatacacgaccccgtgctctcacaataggagatgtgtctggaaatgcttcctgtctgattagtaccgggtataacttatctgcttctccttttcaggctacttgtaatcagtccctgcttacttacataagcacctcagtctcttaccaagcacctaacaatacctggttggcctgcacctcaggtctcactcgctgcattaatggaactgaaccaggacctctcctgtgcgtgttagttcatgtacttccccaggtatatgtgtacagtggaccagaaggacgacaactcatcgctccccctgagttacatcccaggttgcaccaagctgtcccacttctggttcccctattggctggtcttagcatagctggatcagcagccattggtacggctgccctggttcaaggagaaactggactaatatccctgtctcaacaggtggatgctgattttagtaacctccagtctgccatagatatactacattcccaggtagagtctctggctgaagtagttcttcaaaactgccgatgcttagatctgctattcctctctcaaggaggtttatgtgcagctctaggagaaagttgttgcttctatgccaatcaatctggagtcataaaaggtacagtaaaaaaagttcgagaaaatctagataggcaccaacaagaacgagaaaataacatcccctggtatcaaagcatgtttaactggaacccatggctaactactttaatcactgggttagctggacctctcctcatcctactattaagtttaatttttgggccttgtatattaaattcgtttcttaattttataaaacaacgcatagcttctgtcaaacttacgtatcttaagactcaatatgacacccttgttaataactgaggaatcaacaatttgattccccgaaaacatgggtggtgaatgtaatgcccaacattgtttttactaaccctgtttttagactctcccttttgctctcttaatcacctagccttgtttccacatgactaaaactctcgcttagctgagaaagccggacaaactccatctggcccccttgatttgtaagacattaaggactccttacccacccccttcttcaaggagttaacttgtgtaaacagattctcaacatatcaaaagagtccaattaactgataaggtactgaaacaaacaatgtacgaagttcccaggattttgctcaaaagataacaccacaaagcattgagtctgtgtccggcatagcacccatatctaacatcttatgaaggatttagagcccccgcacctgctaccgttgcttttctgtaaacatttgtcttttaaattgtctgtttctctgtaatcatttgtccttttaatttttgcatgtttttacttctgtagaattgttgcgtttgagctcccctccccttcctaaaccaaagtataaaagaaaatcaagccccctcctcatggccgagagaattttgagcgttagcggtctctttggccaccggctaaataaaggactcttaattcatcccaaaaaaaaaaaaaaaaaa

SEQ ID NO: 1606 - DNA, 2199 bp, Homo sapiens
ggcacgaggagagtcgcacacgggctgccctgagagacatttccatggacatcctcatgctgcttctgcttttgtgtgtaatatatgggagattttcccaagatgaatactccctcaatcaagctatccggaaagaatttacaagaaatgccagaaactgcttgggtggcctgagaaacatcgctgactggtgggactggagtctgaccacacttctggatggcctgtacccgggaggcaccccgtcagcccgtgtgccgggggctcagcctggagctcttggaggaaaatgctacctaataggcagttccgtaattaggcagctaaaagtttttcctaggcatttatgcaagcctcccaggccattttcagcactcatcgaagactctattcctacatgtagtcccgaagttggaggccctgagaacccctacctgatagacccagagaaccaaaacgtgaccctgaatggtcctgggggctgtgggacaagggaggactgtgtgctcagcctgggcagaacaaggactgaagcccacacagccctgtcccgactcagggccagcatgtggattgaccgcagcaccagggctgtgtctgtgcacttcactctctataaccctccaacccaactcttcaccagcgtgtccctgagagtggagatcctccctacggggagtctcgtcccctcatccctggtggagtcattcagcatcttccgcagcgactcagccctgcagtaccacctcatgcttccccagctggtcttcctggcactcagcctgatccacctctgtgttcaactctaccgtatgatggacaagggcgtcctcagctactggcgaaagccaaggaactggctggagctctccgtggttggagtgagcctcacctactatgcagtttccggccaccttgttactcttgctggagatgtcactaaccagtttcacagaggactttgccgagcatttatggacctcacccttatggcatcatggaatcagagggctcgatggctccggggaatcctcttattcctcttcacattaaaatgcgtctatcttcctggcattcaaaacacaatggcatcctgctcctccatgatgcgccactcactccccagcatctttgtagcagggctggtgggggcactgatgctggccgccctctcccacctgcaccgatttctgctctctatgtgggttctaccacctggcaccttcacagacgccttccccgggctgctgtttcattttcccagaagaagccaaaaagactgcctccttggcctttccaagtctgaccagcgggccatggcttgttactttgggatccttttaatagtctctgccacactgtgttttggaatgctgagaggttttctcatgactttaccccaaaaaagaaaatcttttcaaagtaaatcttttgtgagacttaaagatgtcactgcttatatgtgggaaaaggtcctcacctttctgagactggaaacaccaaagttggaagaggctgagatggttgagaatcacaattactacttggatgaatttgcaaatctgttagacgaacttctgatgaagattaatggtttgtccgacagcctacaactcccccttctggaaaaaacatccaacaacacaggggaggcaaggacagaagagagtcccttagtggacatttctagttaccaagctgctgagccagcagacatcaaggacttctgaggagcctggtaccttgcataggcactatggaccctgttttgcttaacccacccaacagccaattttagcagacatcctagttttgcaggtgagaagagctgaggtacgaagaagttttgttaatttttccagttcacgtaacaagtaaatgggaaaccaggatgaaaatcaaggtttatctgtcatcagactgttactcataatcaccattcggagagttcagatgtgggacaagattctaactccagccttctcccaaatggttaatttgccagttgccctagagttacatattgtcttatttgtttgttttactgaatctgtctgagtattaaaagccttgtatcttgtgaaatttctttcaggtctcataaaagcgatgaaagagaccaggataacattctaatatttaaataagatttttgaagtaaaatccttattttgtaaatttaaaaaaaaaaaaaaaaaa

SEQ ID NO: 1607 - DNA, 1541 bp, Homo sapiens
ggcacgagcttcctcgatcctactctgtctctctttgttttggagaagttcaatttaccagctggatatgtgggactagtattcctgggtatggcactgtcctatgccatctcttcaccactatttggtctcctaagtgataaaaggccacctctaaggaaatggcttctggtgtttggcaacttaatcacagccgggtgctacatgctcttagggcctgtcccaatcttgcatattaaaagtcagctctggctgctggtgctgatattagttgtaagtggcctctctgctggaatgagtataattccaactttcccggaaattctcagttgtgcacatgaaaatgggtttgaagagggattaagtacattgggacttgtatcaggtctttttagtgcaatgtggtcaattggtgcttttatgggaccaacgctgggtggatttctgtatgagaaaattggttttgaatgggcagcagctatacaaggtctatgggctctgataagtggattagccatgggcttgttttatctactggagtattcaaggagaaaaaggtctaaatctcaaaacatcctcagcacagaggaggaacgaactactctcttgcctaatgaaacctagtccgatggatcctggattgatacaaggttgagaaatgaatgctcctggccttaaacatcaccgtaggaagggtttttaaaattttacgcgcaaaactccgtggaccccgtgccagtgtcttggaagtgtcaacgtgtttttggatgatcctgtattgggctgtacttactgtgatactgaaaagctgtcctgctgaagcagctatatttgaaatattaagtatgaaaggagtaattaaaaacaagcaaaacaaaacaagacttagtttttaaatgaccaaacttgtccttaaagatgttgttattaactcgagttagttcttatttcctctgtttattttttattctaagtacactgattctgtgaatgtaccttttttattacacagggaaagaaatgaattaatttgatatgctctaaatacataaaggtgcttcaaaatatgtagaaacattactatgaaatcagtttttaaaagatatactttctctttgtcctgaggtttttcggtcttgttcaaaaggaagaattcttgcctgccatacagaaactctctagcactccctgaccttaagcttttctaaaaattctgtttgtgtgaaaagtacaagaataacaatacttacaacttccatttttgtaacctacgttcacttatgatctggatttataaacattacttggtataacgtttttcatttcctttaatgtctctgttttttggctctaccatctgttttgtttttgtttttatctatatcttggtagatgtatttcatccctagagcaggtcagcctccttcccctaatgcgaatgcttgttttgttagggaagggcttcctccaacttcgtgtgaaattgtgatgttgaagtgaataaatgtctattgtgtaacaaaaaaaaaaaaaaaaaaaaa

SEQ ID NO: 1608 - DNA, 890 bp, Homo sapiens
ttttaattgatctgtgaraaaacttaagaaaatcacaatttcagctaacagcaattgtgtcccaaagatgaagatactataacctcaaatggtgcagatccagaactgggctggatgacatccctactgtgccatgtcctggggcatttggaagggactggacctctttcccctcatcaaaggaaacagcagtctttgcctctttctgttggttgtgcccaagggctacagtagctctgaaataacaagagctctgtaataacagtaataaatagctctgaaataacagtcctaagaactcctaaagtcctgagaacttttcttgtaatgcagctttttctcttcctgagaaacagtgtgttctaatgggattcccaggcagttcctacacctacggtgtgtgttccagcagggaggagttatgggctgggctgccttttcccatgggtcttcattcccaatggaaagttcactctgcttagtttggaattatttttctttcagttgttctggaacctttgctttttattgatttatacaatacaattggtgggagggtggacttgggatgggagtgggaaaagcatgtaagagctccttttgtgatggtccatctacccaaaagagatctgctttagtgaacgatactctttcatttttctaaattagatcaagttgttattgattttagatgacttgtatgcaaatttgaaaaacttttttttttaaagctgattgggaactacaaacaatgaatggaatctactgacacagctaattggaaaacagatgtcttcttctgtcctattgatgctggtgtttaaaaaacatcacttaaaaaaaaagaataaatagttctaaaagcaaaaaaaaaaaaaaaaaaaaaattc

SEQ ID NO: 1609 - DNA, 1574 bp, Homo sapiens
  misc_feature (19)..(19): n equals a,t,g, or c
  misc_feature (873)..(873): n equals a,t,g, or c
gtgatctttgtaatatctnctgttgtttctatgatataggagctaggggaagggggttgtttgccttcttcaggacctgactggacagatggacctggctcaagcaactactctggatgcactttgctgtgtgggatgaactaaaagtgtctgaattttgctgataactttataaaactcactatggcatgcttccctcctggtgggccctaggatggatgacactcaagatactacagatgtgggtgcaggcatgcacacacacgatggaatatggccattcctacacaggtggggtagagagtgggtcagcagcctggcacctcacagaggtgggacctaagaggactcatgattatgcagagaattggattgggtctctgtcatagattgagtaatctcttcccttacctcaattccatctccacccatctctacatctgggcacagcaacccagagatggccaaaagcattcaagcctgggggaagatgtttgactattgctgctcttcaccagaacctcacacctctcctgggactggaacccttcagtgggtgtgtggccagttttggaggctggaatgatgggccagggtgtaggattcattctccatgtaaagtttcctttcatcctgcctagccatccccaaggtttatttccagaagaaaggaatatctctacttggatcaattctggtcatttcaagaggatggaggcctcaagtgtgggaacttcccctactccctggatgtgtgtacctagcacacttccttctcccacccctttttccagttggatttgtttttctgttctcttctgtcctgtcttatactgcaactgtgtctcctaggggacagatggccttctttgncatcttcactctccacccccagagaggagtcagagccataactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactggcctgtggtgatgcaaagctgctttgctctgtatctggctggactgatctgtctcacaagaagccatgaggccatagggagaagctccctctccccttcatcttctgctccaaaggtggtagcaagaggagtacccagttaggggttggagcccccatataacatcttcctgtcagaagactgatggatctttttcattccaaccatctccctttcccccgatgaatgcaataaaactctgtgacaccagcaaccattgctctttagaaatgggttttctgatcatatggctgatgtgttatgggcagtatggatgtcttcatttgttgcttctgtttttcatcttttttgttttattaataaaaatttatgtatttgctcctgttactataataatacagggaataaattattcaatccaaaaaaaaaaaaaaaaaaaaaaaaaaaaaaaaaaaaaaactcgag

SEQ ID NO: 1610 - DNA, 3301 bp, Homo sapiens
ggcacgagcagaactggggacactctgggccggccttctgcctgcatggacgctctgaagccaccctgtctctggaggaaccacgagcgagggaagaaggacagggactcgtgtggcaggaagaactcagagccgggaagcccccattcactagaagcactgagagatgcggccccctcgcagggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtgatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagttgtaagggaagccattttagaagacttgcagaaaattgggaaagaaagtggccttaaaacttttgaacaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatactgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagataaaaaaaaaaaaaaaaaaa

SEQ ID NO: 1611 - DNA, 1070 bp, Homo sapiens
  misc_feature (1016)..(1016): n equals a,t,g, or c
  misc_feature (1026)..(1026): n equals a,t,g, or c
  misc_feature (1043)..(1043): n equals a,t,g, or c
acagcctttgttaccttccgagccacccgaaaacctctagtacagacaaccccaaggttggtttataagtggttcctgctaatctataaaatcagctatgccactggcattgttggctacatggctgtcatgtttaccctctttggtcttaacttattattcaagatcaaaccagaagatgccatggactttggcatctcccttctcttctatggcctctactatggagttctggaacgggactttgcagaaatgtgtgcagactacatggcatctaccatarggttctasagcgagtcgggcatgcctaccaaacatctttcagacagtktgtgtgctktktgtgggcagcagatctttgtggacgtcatgaagaggggatcattgagaacacgtataggctgtcctgcaatcatgtcttccacgagttctgcatccgtggctggtgcatcgtgggaaagaagcaaacgtgtccctactgcaaagagaaggtagacctcaagaggatgttcagcaatccctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggcgcttgggccactcaggacccctccggctgtgtcggactggggagggatatgatggagagccagccagtggggctgkcagcagtggggggctttttaaaagaaaactattttgatgaatatatttaaaaaacctttttttattgtggagcataggaattgcccccctccaggcttcaccctccctgcctaagcaggttgggggcagagccatgacatttttggtttaaaggagccttctcatctctggccgagaacactgctgggctcccangtagctgaangcctcagcccayccatncccttcttccctgtgtggggctcaagc

SEQ ID NO: 1612 - DNA, 1002 bp, Homo sapiens
gaattcggcacgagccgaggtcggcagcacagagctctggagatgaagaccctgttcctgggtgtcacgctcggmctggccgctgccctgtccttmaccctggrggaggaggatatcacagggacctggtacgtgaaggccatggtggtcgataagactttccggagacaggaggcccagaaggtgtccccagtgaaggtgacagccctgggcggtgggaagttggaagccacgttcaccttcatgagggaggatcggtgcatccagaagaaaatcctgrtgcggaagacggaggagcctggcaaatacagcgcctgtgagcccctcccccaytcccacccccaccytcccccaccgccaaccccagtgcaccagcctccacaggtagagagtgcccaggctgcccttttgccagggccccagctctgcccacctccaaggaggggctggcctctccttcctggggggctggtggccctgacatcagacaccgggtgtgacaggcttgtccgcagtcgagatggaccagatcacgcctgccctctgggaggccctagccattgacacattgaggaagctgaggattgggacaaggaggccaaggattagatgggggcaggaagctcatgtacctgcaggagctgcccaggagggaccaytacatcttttactgcaaagaccagcaccatgggggcstgctccacatgggaaagcttgtgggtaggaattctgataccaaccgggaggccctggaagaatttaagaaattggtgcagcgcaagggactctcggaggaggacattttcacgcccctgcagacgggaagctgcgttcccgaacactaggcagcccccgggtctgcacctccagagcccaccctaccaccagacacagagcccggaccacctggacctaccctccagccatgacccttccctgctcccacccacctgactccaaataaagtccttctcccccaaaaaaaaaaaaaaaaaaactcga

SEQ ID NO: 1613 - DNA, 2074 bp, Homo sapiens
  misc_feature (848)..(848): n equals a,t,g, or c
  misc_feature (2073)..(2073): n equals a,t,g, or c
ccgcctgaccgccccgggcttaagggagcctggctaggccggcagccggatggtcccgcagctcggggccggccatgcttcgcggtccgtggcgccagctttggctctttytcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggargcagccacggggcccctgggctggcgccttcctctgttgggccagcggtacctggacctcctgaccacgtggtactgcagcttcaaagactgctgccctagaggggattgcagaatctccaacaactttacaggcttagagtgggacctgaatgtgcggctgcatggccagcatttggtccagcagctggtcctaagaacagtgaggggctacttagagacgccccagccagaaaaggcccttgctctgtcgttccacggctggtctggcacaggcaagaacttcgtggcacggatgctggtggagaacctgtatcgggacgggctgatgagtgactgtgtcaggatgttcatcgccacgttccactttcctcaccccaaatatgtggacctgtacaaggagcagctgatgagccagatccgggagacgcagcagctctgccaccagaccctgttcatcttcgatgaagcggagaagctgcacccagggctgctggaggtccttgggccacacttagaacgccgggcccctganggccacagggctgagtctccatggactatctttctgtttctcagtaatctcaggggcgatataatcaatgaggtggtcctaaagttgctcaaggctggatggtcccgggaagaaattacgatggaacacctggagccccacctccaggcggagattgtggagaccatagacaatggctttggccacagccgtcttgtgaaggaaaacctgattgactacttcatccccttcctgcctttggagtaccgtcacgtgaggctgtgtgcacgggatgccttcctgagccaggagctcctgtataaagaagagacactggatgaaatagcccagatgatggtgtatgtccccaaggaggaacaactcttttcttcccagggctgcaagtctatttcccagaggattaactacttcctgtcatgaaggctagaggaagacttcctggaactgcctttcttccactaacaggaccctgggacctgtaggagcaccccgtttgggactgtgaggtgtttgagggtgtggactggcatccagcagccactaacaaacacacaactggtgtgtaaaaggcaggccttacattagaagccaagccaatcctttttcttttttttggaggtcccaccgagatagataggaacttggattgctgaattcaaaaacagagcccattcttaagatcacttggtgccttaaagacacgcattccaaagtggaatgtggttgaagaaagtgggccaggtggttgaagaaagccatgtgggagctcagcaaatcccaagggcttattatgacactccagatggtctccttagcatctcagctcttctgcaaggaagagcttgggtgttaggcctcagaggctgtagggtccttgggttacagagccggggagaacgaagttctgtgacccaggggtggagaatacactctaggtttgcgggctggtgggctttcaaattggtacttccagaggaaagccaagctgcttctgttgtgagcgaatcagccaagagcctgaggctgaagggaaaagtacacagaggaagatattttacaaaccaggtcagtgtaggccaagacttatggtctacagattttggcgggggaggggggaccttttcaaagacaatagggggtcttgacatgtttgttgtatgtaaagatgataagattaaaatttttgattttcctaaaaaaaaaaaaaaaaaaaaaaaaaaaattnc

SEQ ID NO: 1614 - DNA, 1642 bp, Homo sapiens
gcccacgcgtccggacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagagaaaaaaaatccagtacttgactcgtggagaggagtcttcgtccgataccaataagtcagcctgatgctctaatggaaaaatggccctcttcaagcctgggcctcccattggccaaacacagcagcaaaccagaggacaagggagcccagtggcactgtccatagaggacagattcctggggtccagaagagggtggagaaagctgaaggctggagagtgaatctagggcatataaggccccacacagagcccagcacagagacggccttgcagctatcaggaagatgaggagcttccttcatggcctgctgtgggctgagtaaataatatgattgccttctacagcgctagagattcatatgtttatccccatttttcaggtgaggaaatgcttcagatgaggctccaccttgttaaataaattggatgtatggaaaaatagactgcaaaaaaaaaaaaaaaaaaattaaaaaactcgaggggggcccggtacc

SEQ ID NO: 1615 - DNA, 2100 bp, Homo sapiens
  misc_feature (1)..(1): n equals a,t,g, or c
nccagaggcagaaagtcctgcttctggggcgtaacctacaggatatccttggaacagaagatcttattgtggaagtracttccaatgatgctgtgagattttatccctggaccattgataataaatactattcagcagacatcaatctatgtgtggtgccaaacaaatttcttgttactgcagagattgcagaatctgtccaagcatttgtggtttactttgacagcacacaaaaatcgggccttgatagtgtctcctcatggcttccactggcaaaagcatggttaccygaggtgatgatcttggtctgcgatagagtgtctgaagatggtataaaccgacaaaaagctcaagaatggtgcatccaaacatggctttgaattggtagaacttagtccagaggagttgcctgaggaggatgatgacttcccagaatctacaggagtaaagcgaattgtccaagccctgaatgccaatgtgtggtccaatgtagtgatgaagaatgataggaaccaaggctttagcttgctgcaactcattgactggaacaaaccatagcattgggtcagcagatccctgtcacccagagcaaccccatttgccagcagcagatagtactgaatccctctctgatcatcggggtggtgcatctaacacaacagatgcccaggttgatagcattgtggatcccatgttagatctggatattcaagaattagccagtcttaccactggaggaggagatgtggagaattttgaaagactcttttcaaagttaaaggaaatgaaagacaaggctgcgacgcttcctcatgagcaaagaaaagtgcatgcagaaaaggtggccaaagcattctggatggcaatcgggggagacagagatgaaattgaaggcctttcatctgatgaagagcactgaattattcatactagggtttgaccaacaaagatgctagctgtctctgagatacctctctactcagcccagtcatattttgccaaaattgcccttatcatgttggctgcctgacttgtttatagggtccccttaattttagtttttagtaggaggttaaggagaaatcttttttttcctcagtatattgtaagagagtgaggaatacagtgatagtaatgagtgaggatttcttaaatrtactttttttttgttctaggaatgagggtaggataaatctcagaggtctgtgtgatttactcaagttgaagacaacctccaggccattcctggtcaaccttttaagtagcatttccagcattcacacttgatactgcacatcaggagttgtgtcacctttcctgggtgatttgggttttctccattcaaggagcttgtagctctgaagctatgatgcttttattgggaggaaaggaggcagctgcagaattgatgtgagctatgtggggccgaagtctcagcccgcagctaagtctctacctaagaaaatgcctctgggcattcttttgaagtatagtgtctgagctcatgctagaaagaatcaaaaagccagtgtggatttttagactgtaataaatgaggcaaaggatttctattccagtgggaagraaacctctctactgagttgtgggggatatgttgtatgttagagagaaccttaaggagtccttgtatgggccatggagacagtatgtgataacataccgtgattttcatgaagaaattcttctgtcttagagttctcccctgctgcttgagatgccagagctgtgttgttgcacacctgcaaaacaaggcacatttccccctttctctttaaagccaaagagagatcactgccaaagtgggagcactaaggggtgggtggggaagtgaaatgttaggcgatgaattcctgagcaccttgtttttcttccaaggttcgtagctcctctctgcccttccaagcctgtaacctcggaggactatcttttgttctttatcctttgtcttgtttgagtgggtcagccccagaggaactgataagcaaatggcaagtttttaaaggaagagtggaaagtactgcaaataaaaatccttatttgtttttgtagaaaaaaaaaaaaaaaaaaaaaaaaaaaaag

SEQ ID NO: 1616 - DNA, 1561 bp, Homo sapiens
ggcacgagtgaggctcatgtctgacctgcagaactgtataatgataaattatgttgtttgaaaccgctacatttgcggtaatttgttacagcagcaatagaaaacgaatcccctgcccagaatgacttcctcctttcctgtcggacgaaggctcaggccttctgctgaaagcttgctcccctaagtagtcacacccaatgccgaatactccccagaagcagctgctattttctgaggacaatgagttgcttgtaagcctgagaacaggacgaaaacccactttgcaagcagccctgcgtgtgacgggcatgccctcggagggcaggttggttttgctatctgctttctgtcctgcctttttccccccatgggtcctgtctggctcttttgctttctcactttgtgcagaaagccatctcaactcttctcacaggagaatagctgtatggacgtagcagggggagttaccacatgcctacctccatggttttcgagaggggcccctgcccaaatgtctcagtggccaccttcatcagaccatggagcagtcagagcgggaagggattctagagttggtccagtccaaccatctcatcttacatgtgaaggaggaaaggaagaaagggagaaaaataagaaagctgaggtcaaccctcctacagggatgggcctggccaacaggatcccaagggatgacataacattgaaattaagaaaccaaggaaagttgagaactaaagaaaacagaacccagtcagccaagaggcatccttgagggccaaccaagccgtcaaacctggatgcccccgacgagtcagaaagtcgggtgcctcaagagccaagcagccaagaaatggggtctggaactggcactttggtccgcctctgtgcactcacccagaaagggtggaagggaccctgggaccaagtgccaaggtcacacaacggatgaatagactgctggacttcaaactgaacatgccattttgccaaagcagtcatcaccttccgtgaatcataaatgtttgttcaaagccacaaatgtatatactctttgtatgtatacagattttttctaaaggttaacatctaaacagatcaattaaggtcagccttaatttgtctgagctttttggttaaagtttcctgagtaattgagcgaattcaagtttctggctttctcctttctctttctccatttaaaacatgatctcatgaaatttttgtcccaagaaaggcaggattacattttcttttaacagtttgagttggtgtagtgtattcttggttatcagaatactcatatagctttgggattttgaattggtaaatattcatgatgtgtgaaaaatcatgatacatactgtacaatctcagtgccacaaaattggatgttgtgcctacacacgcacaggacctagaagagcatgtcaaactataaactgcctgtgattgtgaatgactttgttctttgcttcttgcgtttttcagtttcctataatgcacatcttaacttttaaaaaataaaggttattttaaaagccaaaaaaaaaaaaaaaaa

SEQ ID NO: 1617 - DNA, 2219 bp, Homo sapiens
ggcacgagctccatgagcagatgaagtagacagctttactcagtatctcagaccaagaacttcatctccatctccaactagctgaaacatcttccctcctcaacctggaaaattctctgacttagaaatttaaacaaaaccctcccctttcattgaatctccattgtctggagtttgcttgttttaatctagcctgttcctccactatgggctccctttcaaactatgccctgcttcaactaacccttactgcttttttgacaattctagtacaacctcagcacctgcttgctccagttttccggacactatctatcttgactaatcagtctaattgctggttatgtgaacatctagataatgcagaacaacccgaactagtttttgttcctgccagtgcaagcacctggtggacctattctggacaatggatgtatgaaagggtgtggtatccacaagcagaagtacagaatcactctacttcctcctatcgtaaagtgacttggcactgggaagcctccatggaagctcaaggtctatcctttgctcaagtaaggttattggagggaaatttttctctttgcgtagaaaataaaaatggcagtggacccttcctaggtaatatacctaaacaatactgtaatcaaatactatggtttgattctacagatggcaccttcatgccctctatagatgttacaaatgaatccaggaacgatgatgatgatccaagtgtttgcctaggcactagacaatgttcctggtttgcaggttgcacaaaccggacctggaacagctcagctgttcccttgattggtctgcccaatacccaagactacaaatgggtagatcgaaattctggattgacctggtcaggtaatgacacctgtctctatagctgccaaaaccaaaccaaaggccttctgtaccagctatttcgcaacctattttgctcttatggcctgacagaggcacatgggaaatggagatgtgcagatgccagcataactaatgacaaaggtcatgatggacaccggacccccacctggtggctcacaggttccaatctgaccttgtctgtgaacaactctggcctcttttttttgtgcggcaatggggtgtacaaagggtttccacctaaatggtctgggcgatgtggacttgggtatcttgtaccttccctcaccagatacctcaccttaaatgctagccaaattacaaacctgagatccttcattcataaagtaacaccgcatagatgcacccaaggagacacagacaatccacctctgtattgcaaccccaaggacaattcaacaataagggccctttttccaagtttgggaacttatgatttagaaaaggcaattctaaacatttccaaagcaatggaacaggaattcagtgccactaagcagaccttggaagcacaccaatcaaaagttagcagtttagcctctgcatcccgaaaggatcatgtcttggatataccgaccacccaacgacaaacggcttgtggaactgttggcaaacagtgttgcctctatataaattattcggaagaaataaagtctaatatacagcgtctccacgaagcatccgagaacctgaagaatgtaccgttacttgattggcaaggcatatttgcaaaagtgggagactggttcagatcatggggctatgtgcttttaattgttcttttctgcttattcatctttgttttaatctatgttcgtgtctttcgcaaatctcgcagatcccttaactcccaacctctgaacctagccttatctccacagcaatcagcacagctccttgtcagtgaaacttcatgtcaagtttcaaatagggcaatgaagggactaacaacccatcaatatgacacaagtctactttgagaatatctgaacaaacagcagctgcagacaaaaagccttagctaaactttgatgagtaaagcaggtcttaccgagaattcagctgccaaaaccctcctctgagtgttcctcttataagggcacttagcactaggacctcccaaggtattgtaaataagccttatcagaactttttgtagtttcattctgaagccttaagacacacaccataaagctgatctgtaaacccttaccccttgctgttcagagagctactctttgtagtgttcttgcatgcatatataataaatgttttttctattgaaaaaaaaaaaaaaaaaa

SEQ ID NO: 1618 - DNA, 1866 bp, Homo sapiens
agcccgcgccgctgcctggcgctgctgcatctcctgcagctgggttacctgtacaggtgcgtgcaggagctgcggcaggggctgctggtgtggcagcaggaggagccctctgagtttgacttggcctacgccgacttcctcgccctggacatcagcatgctgcggctcttcgagaccttcttggagacggcaccacagctcacgctggtgctggccatcatgctgcagagtggccgggctgagtactaccagtgggttggcatctgcacatccttcctgggcatctcgtgggcactgctcgactaccaccgggccttgcgcacctgcctcccctccaagccgctcctgggcctgggctcctccgtgatctacttcctgtggaacctgctgctgctgtggccccgagtcctggctgtggccctgttctcagccctcttccccagctatgtggccctgcacttcctgggcctgtggctggtactgctgctctgggtctggcttcagggcacagacttcatgccggaccccagctccgagtggctgtaccgggtgacggtggccaccatcctctatttctcctggttcaacgtggctgagggccgcacccgaggccgggccatcatccacttcgccttcctcctgagtgacagcattctcctggtggccacctgggtgactcatagctcctggctgcccagcgggattccactgcagctgtggctgcctgtgggatgcggctgcttctttctgggcctggctctgcggcttgtgtactaccactggctgcaccctagctgctgctggaagcccgaccctgaccaggtagacggggcccggagtctgctttctccagaggggtatcagctgcctcagaacaggcgcatgacccatttagcacagaagtttttccccaaggctaaggatgaggctgcttcgccagtgaagggataggtgaacggcgtcctttgaagcaggatcagacccagccagcagagatggagagtgactctgttggcagaaggcaggcgaggataagctaacgatgctgctgtggcctctatgcactcagcaagagcgggacgcctgtgctgggccgggcaccagggatggtgctgagtcgggcagaggcctcctttcaaggagttcacagtgaacaagatgagaagggctgggccctggagggtcaagagccccaattatgtacaagacactttgggaggaaagaagactaccttttccccctgccattggtatagctggtgccccaaaacttccacctccctccctggccacctctaaaatgactggtataggtgctgccccaccccttagctcccctatcctgggctaggaggccacaggggctgtcctctagaattcttccttccctcccccacaccattcattcaattcatgaaacaaatctttgccaagagcagtttatgtgccaggaacatcattctgtccttgcaacctggaacaagaccagctaccagcctagcttcatccgctacttgcaccaaccagtcccgggttagatcccaaatgctagaagccagggatgcccaactctgggtggccccagtcagaacctctgggatctcagtgaagctggcctggcctctgctcctgctctcaaggggctgcttttcaaccaagagccttgtgagcctggtctgagccttgcacagccactgagtattttttttgccttagccagtgtacctcctacctcagtctatgtgagaggaagagaatgtgtgtgcctgtgggtctctacaagtgacagatgtgttgttttcaacagtattattaggttatgaataaagcctcatgaaatcctcaaaaaaaaaaaaaaaaaaaaaa

SEQ ID NO: 1619 - DNA, 1804 bp, Homo sapiens
ggcagagcagacgcgkctccttggagggagtgcggtcctctagggaggcatcgggctcctaggggcttcttggcgtgtgtggtgggattggggtccgccggccatggccttcactttcgctgcgttctgctacatgctgtctctggtgctgtgcgctgcgctcatcttcttcgccatctggcacataattgcctttgatgagttaaggacagattttaagagccccatagaccagtgcaatcctgttcatgcgagggaacggttgaggaacatcgagcgcatctgcttccttctgcgaaagctggtgctgccagaatactccatccatagcctcttctgcattatgttcctgtgtgcgcaagagtggctcacgctggggctgaatgtccctctacttttctatcacttctggaggtatttccactgtccagcagatagctcagaactagcctacgacccaccggtggtcatgaatgccgacactttgagttactgtcagaaggaggcckggtgtaagctggccttctatctcctctccttcttctactacctttactgcatgatctacactttagtgagctcttaacgcaaagaccatgcacatcatcagagactgagatgggagaggcctgagacggagaggtgcatttctgctggtgactggaggagggaccagaatgaggatacgtgagaaatagacccggcaggcagtcagactgaatgggagctggaatcacgcagcagctgggagccgagttaaccctgcgtgtctgtgtcaccctgtttgtcaatctttggcattcgaattccacacacggggtcctagagcccttctgagcatcagtggtgtgggggagtaggtgacgaaacactagacctctcctgagagagaattgctgcttcctgaatccacttcattgaacagcaccttgcaagttcaaatgagttcctgggagtggaggctggaaggccacaaggtgcttgctaaggaacagaatgacccagagtcaaggccaagtctgcagggacctgttgaaagcctcgagaatgkcttggctgcccaagactcttgktgcctttcttccaagccatggccatgccctttttctcaaatgggargggctggarggtgtgtgggatttgtcttcagctgcaaccagccttgagcctgctgggctattttcagctgaggaggggtgaatataggaaaaatgcatttttgaaacrtttgcaacatgatcaaggtgttagttctccaccacacaagttgtattcttcttttgccacctcaaaccatcacagagtctttaaatgcaaatcaattggtcaatgctagtcaaagctatgttcttacaaaaaccccagacagctcagagctcagaaaatcctgtggagtggctgctctgtaccgtgggcatccggcagccaggaagtgagacaacataattataactttgttttatgatgctgcatcatttgtactgtttaggtcgacrtgaggacatcatcttatttagaattttccgtttggcattctcttttgggtgggagttatgctgggggttgtaaataatgacaaggctgagatttttatgatgtttaaattgggcacaatgattttgaccttattccccaaacttcttttcttttctactgtttaacatacacaggctatttatacacgtccccagctcccatctgaaacctgtgactcaggtttatgaatggtgtttgtgtagcaacacattgtgtgctatgtttattaaaatgcagcgacaaaaaaaaraaaaaaaaaaaactcgag

SEQ ID NO: 1620 - DNA, 1813 bp, Homo sapiens
  misc_feature (1)..(1): n equals a,t,g, or c
nctctgcatctgcctgcctcgggcagaggagggctaccctggggctgagagttcacctgtctcaggaaccacctgagcccacagatcctgtgggcagcggccagggcagccatggcttgggcaagtaggctgggcctgctgctggcactgctgctgcccgtggtcggtgcctccacgccaggcaccgtggtccgactcaacaaggcagcattgagctacgtgtctgaaattgggaaagcccctctccagcgggccctgcaggtcactgtccctcatttcctggactggagtggagaggcgcttcagcccaccaggatccggattctgaatgtccatgtgccccgcctccacctgaaattcattgctggtttcggagtgcgcctgctggcagcagctaattttactttcaaggtctttcgcgccccagagcccctggagctgacgctgcctgtggaactgctggctgacacccgcgtgacccagagctccatcaggacccctgtggtcagcatctctgcctgctctttattctcgggccacgccaacgagtttgatggcagtaacagcacctcccacgcgctgctggtcctggtgcagaagcacattaaagctgtcttgagtaacaagctgtgcctgagcatctccaacctggtgcagggtgtcaatgtccacctgggcaccttaattggcctcaaccccgtgggtcctgagtcccagatccgctattccatggtcagtgtgcccactgtcaccagtgactacatttccctggaagtcaatgctgttctcttcctgctgggcaagcccatcatcctgcccacggatgccaccccttttgtgttgccaaggcatgtgggtaccgagggctccatggccaccgtgggcctctcccagcagctgtttgactctgcgctcctgctgctgcagaaggccggtgccctcaacctggacatcacagggcagctgaggtcggatgacaacctgctgaacacctctgctctgggccggctcatcccggaggtggcccgccagtttcccgagcccatgcctgtggtgctcaaggtgcggctgggtgccacacctgtggccatgctccacacaaacaacgccaccctgcggctgcagcccttcgtggaggtcctggccacagcctccaactcggctttccagtccctcttctccctggatgtggtagtgaacttgagactccagctctctgtgtccaaggtgaagcttcaggggaccacgtctgtgctgggggatgtccagctcacggtggcctcctccaacgtgggcttcattgatacagatcaggtgcgcacactgatgggcaccgtttttgagaagcccctgctggaccatctcaatgctctcttggccatgggaattgccctccctggtgtggtcaacctccactatgtcgcccctgagatctttgtctatgagggctacgtggtgatatccagtggactcttctaccagagctgaggcaagaccactgggaggcctgagagtgggccagctcgctgctcaggcgaatttctcatttcaagccactggggaaactgaggcaaaaccatacttagtcatcaccaacaagctggactgcttagctgggctgttttatcttccctgagtgcctgggtctccctccctcacttctgccctttcccttcctcctcctcttctcctccctcttccctcatctcccccctccttcctctgccccaccccagcggggagcagactgctcctccaggctgtatagacctgccctcttgcattaaacaacttctcttgagctgcaactttc

SEQ ID NO: 1621 - DNA, 1377 bp, Homo sapiens
ggcacgagaaaaccttgaggtgattcatcttccaggctctccttccatcaagtctctcctccctagcgctctgggtccttaatggcagcagccgccgctaccaagatccttctgtgcctcccgcttctgctcctgctgtccggctggtcccgggctgggcgagccgaccctcactctctttgctatgacatcaccgtcatccctaagttcagacctggaccacggtggtgtgcggttcaaggccaggtggatgaaaagacttttcttcactatgactgtggcaacaagacagtcacacctgtcagtcccctggggaagaaactaaatgtcacaacggcctggaaagcacagaacccagtactgagagaggtggtggacatacttacagagcaactgcgtgacattcagctggagaattacacacccaaggaacccctcaccctgcaggccaggatgtcttgtgagcagaaagctgaaggacacagcagtggatcttggcagttcagtttcgatgggcagatcttcctcctctttgactcagagaagagaatgtggacaacggttcatcctggagccagaaagatgaaagaaaagtgggagaatgacaaggttgtggccatgtccttccattacttctcaatgggagactgtataggatggcttgaggacttcttgatgggcatggacagcaccctggagccaagtgcaggagcaccactcgccatgtcctcaggcacaacccaactcagggccacagccaccaccctcatcctttgctgcctcctcatcatcctcccctgcttcatcctccctggcatctgaggagagtcctttagagtgacaggttaaagctgataccaaaaggctcctgtgagcacggtcttgatcaaactcgcccttctgtctggccagctgcccacgacctacggtgtatgtccagtggcctccagcagatcatgatgacatcatggacccaatagctcattcactgccttgattccttttgccaacaattttaccagcagttatacctaacatattatgcaattttctcttggtgctacctgatggaattcctgcacttaaagttctggctgactaaacaagatatatcattttctttcttctctttttgtttggaaaatcaagtacttctttgaatgatgatctctttcttgcaaatgatattgtcagtaaaataatcacgttagacttcagacctctggggattctttccgtgtcctgaaagagaatttttaaattatttaataagaaaaaatttatattaatgattgtttcctttagtaatttattgttctgtactgatatttaaataaagagttctatttcccaaaaaaaaaaaaaaaaaaaaaaaaa

SEQ ID NO: 1622 - DNA, 2892 bp, Homo sapiens
gcggcggcggcggcggcggcaggagcccgggaggcggaggcgggaggcggcggcggcgcgcggagacgcagcagcggcagcggcagcatgtcggccggcggagcgtcagtcccgccgcccccgaaccccgccgtgtccttcccgccgccccgggtcaccctgcccgccggccccgacatcctgcggacctactcgggcgccttcgtctgcctggagattctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttgttatggttgcagtttgggtctggctttacgaagatggcgaccgtaacactccttagaaactggcagtcgtatgttagtttcacttgtctactttatatgtctgatcaatttggataccattttgtccagatgcaaaaacattccaaaagtaatgtgtttagtagagagagactctaagctcaagttctggtttatttcatggatggaatgttaattttattatgatattaaagaaatggccttttattttacatctctcccctttttccctttccccctttattttcctccttttctttctgaaagtttccttttatgtccataaaatacaaatatattgttcataaaaaattagtatcccttttgtttggttgctgagtcacctgaaccttaattttaattggtaattacagcccctaaaaaaaacacatttcaaataggcttcccactaaactctatattttagtgtaaaccaggaattggcacactttttttagaatgggccagatggtaaatatttatgcttcacggtccatacagtctctgtcacaactattcagttctgctagtatagcgtgaaagcagctatacacaatacagaaatgaatgagtgtggttatgttctaataaaacttatttataaaaacaaggggaggctgggtttagcctgtgggccatagtttgtcaaccactggtgtaaaaccttagttatatatgatctgcattttcttgaactgatcattgaaaacttataaacctaacagaaaagccacataatatttagtgtcattatgcaataatcacattgcctttgtgttaatagtcaaatacttacctttggagaatacttacctttggaggaatgtataaaatttctcaggcagagtcctggatataggaaaaagtaatttatgaagtaaacttcagttgcttaatcaaactaatgatagtctaacaactgagcaagatcctcatctgagagtgcttaaaatgggatccccagagaccattaaccaatactggaactggtatctagctactgatgtcttactttgagtttatttatgcttcagaatacagttgtttgccctgtgcatgaatatacccatatttgtgtgtggatatgtgaagcttttccaaatagagctctcagaagaattaagtttttacttctaattattttgcattactttgagttaaatttgaatagagtattaaatataaagttgtagattcttatgtgtttttgtattagcccagacatctgtaatgtttttgcactggtgacagacaaaatctgttttaaaatcatatccagcacaaaaactatttctggctgaatagcacagaaaagtattttaacctacctgtagagatcctcgtcatggaaaggtgccaaactgttttgaatggaaggacaagtaagagtgaggccacagttcccaccacacgagggcttttgtattgttctactttttcagccctttactttctggctgaagcatccccttggagtgccatgtataagttgggctattagagttcatggaacatagaacaaccatgaatgagtggcatgatccgtgcttaatgatcaagtgttacttatctaataatcctctagaaagaaccctgttagatcttggtttgtgataaaaatataaagacagaagacatgaggaaaaacaaaaggtttgaggaaatcaggcatatgactttatacttaacatcagatcttttctataatatcctactactttggttttcctagctccataccacacacctaaacctgtattatgaattacatattacaaagtcataaatgtgccatatggatatacagtacattctagttggaatcgtttactctgctagaatttaggtgtgagattttttgtttcccaggtatagcaggcttatgtttggtggcattaaattggtttctttaaaatgctttggtggcacttttgtaaacagattgcttctagattgttacaaaccaagcctaagacacatctgtgaatacttagatttgtagcttaatcacattctagacttgtgagttgaatgacaaagcagttgaacaaaaattatggcatttaagaatttaacatgtcttagctgtaaaaatgagaaagtgttggttggttttaaaatctggtaactccatgatgaaaagaaatttattttatacgtgttatgtctctaataaagtattcatttgataaaaaaaaaaaaaaaaagggcggccgctctagaggatccaagcttacgtacgcgtgcatgcgacgtcatagctcttctatagtgtcaccta

SEQ ID NO: 1623 - DNA, 2310 bp, Homo sapiens
catggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagttttagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaatgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaaaaaaaaaaaaaaaaaaaaaaaaaaaaa

SEQ ID NO: 1624 - DNA, 683 bp, Homo sapiens
  misc_feature (41)..(41): n equals a,t,g, or c
gggagaataggttagaagaaaatatctaccctgagacaggnaaaaacaagaaaatgacatatacagaaaagagcatatgagacacaggaactggtagtaaagtctatgaaaggctgttgtctctcacctagtgttgggcctaaagttgctgcagtcagaaaggcctgcagttaaaaggaaaagttggatgtcaagtgggaaatactgagaagaaaagttctcagaggaagcaatatcctccctaaaaaccaggaactttcgaacaactcaagggtccactttcaggtcaagtgctgaaaggcaatgcagatgacagttgtatggtatgtgattactgcaatcatttggtggagaatgagcatgtgtgaagccctctcacagaattgcttctaatcctaaaatgtatctcactgtgatgaaaaacaatcaaagtacagtttagactaagggatgtgtcctcaagtttagcagactcttaaacacttacttctagttgtagcttgattatttcattttgtttttctttttcttgacttcttagctttgcatttaactctgaaatttccatctcctttttctctattagttctttgtgcttttcttcatttaattcaactgaataaaatgaaataaataaaattcatttgttaaaaatttcaaaaaaaaaaaaaaaaaactcgtag

SEQ ID NO: 1625 - DNA, 1248 bp, Homo sapiens
ggcacgagtttgggttatagcaagagttctgagatacaaatgtgttcattttatcttccagtgactacattcacatcaatggcttaggacatgtatttacaaattcctgtgaaacacatgttacactcaggttatcaggctacctttttttcccccaagataggatgttcaagcattctagtttttgtttgtttgcttgtttttttgagacagagtctggctctgttgcccaggctggagtacagtggtgctatcttggctcactgcaatctccacctcctgggttccagcgattctcctgcctcagcctccccagtagctgggattacaggcatgcaccaccacacccagctatttttttgtacttttagtagagatgggattttaccatgttggccaggctggtctccaactcctgacctcaggcaatccaccctcctcagcctcccaaagtgctgggattacaggcatgagccactgcgcccggcccaagcattctagttttaagtgagaataagttaaaaatatttgcagaacaaagtacaattacattcttgaataatcaaattagtgctttaaaaatatttgagactatcaaatgctctcaaatccaagcttatctcaagaactaatcaacataatataatgtatgcagctttggttgagaacatcataaattaataggatctggaatataaataccagaaattgttatatgttgcatggtttgtcttttagtgggaatgaaaagtacagctgggagcagtggctcatgcttgtaatcccagcacttcaggaggccgaggcaggaggatcacttgaggtcaggagttcaagactagcctggccaacaaggtgaaaccctgtctctactaaaaatacaaaattagccagatgtggtggtgtatgcctgtagtcccagctacccgggaggctgaggcacgagaatggcttatacccgggaggtggaagttgcattgagccgagatcatgctactgcactcagcctgggtaacagactgagactccatctcaaaaggagaaaagtacagctcctaatttaatactcctaaaatattttttggcacctaccacagacaaggtactttgataagtactggggacaccatatcctgtctaggtctgttatgttcatctgcagctagagaggggattgcaatatgcaggattctgaagaaacacaagcataaaggggccaaattatacatttaggtctcacatgtagat

SEQ ID NO: 1626 - DNA, 1255 bp, Homo sapiens
gctgaaatgtctcatttagctaaatggaaacattcaccagacacttctagctagctctcccacatcactttgagccacacaggcacttccatgtttgggactgaattgcctgggaatccgtatacccaaaatctgagccctcattcttacccttgggtgatgcctctccatagccctcagcaatgctctccactcgctggatggggctacatctcgtgcagattttgtggcgctgttggaccagttcggcaaccattacatccaggaagctatctacggctttgaggagtcctgttctatctggtacccaaacaagcaggtccagcggcgactctggctggagtatgaagacatcagtaaaggcaactccccatcagatgagtctgaggagcgggaaagagaccccaagtgctgacattcccagaatacatcaccagcttgtcagactccggcaccaagcgcatggcggctggagtccgcatggagtgccagagcaagggacgatgcccctcgtcctgccccctgtgtcatgtgacatccagccctgacacccctgctgagccggttctgctggaggtgaccaaagcagcccccatctatgaactagtgaccaacaaccagacccagaggctcttgcaggaggctaccatgagctctctctggtgctcagggactggagatgtcatcgaggactggtgtcgatgtgactccactgcttttggagctgatggactccccacctgtgcgcctctcccacagcctgtgtatggttctctttctctctttcagcattactctggaaacagataatgagcgtctactatttgcaaagaaataggctgggtactgggaaacaaagaaaaatatgacacaatacctgcctttagagagctttcaatctaccaagggaggcagcacagatggttttagtagagaaagggtgtgacaagtgttaacaagaggcatttaaagaaagtgtgaagagggaatggtcaagtctgaactgacgccatggtgacggctctgtggaggaggtggcgcttgaacttctccttgaaggtggagaaagtaggacagcataactagaagacaatggggagaaaagtgccattgtaatggaagaagttagagatctacactgagagcttaactagaccaaaaacataaccactcattgaacacttactgggtgtccaggcattgtatggagcagttagatactgctcatttaatagacaaaaaaaaaaaaaaaaaa

SEQ ID NO: 1627 - DNA, 1186 bp, Homo sapiens
cgcgagccaccacaccaggccaaataatcatgaaataatgtattgacttcctgctatgaagtttacaaccctagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggarytgctactggaccaggtgcagacagtgyttgggytactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagtactaagaaactaagaagcttaatgaaaagaaat

SEQ ID NO: 1628 - DNA, 2001 bp, Homo sapiens
ggcacgagggcacacccagagaggttcttcaaaaatttcaattacatcatgtctctccttcgttaaaaaatatttaatgattttctacccatgaaataattctgctagactgcaagctctaaagatgcaaggactaggtttgccttatttgtttctgtttatgcagagcctagccttgcatgtagtaggaacttaacacattgacctagatcttgtccaccttctcagcctcacctctcatggaagcactcatagacctcagtccagttactcttttctcagatccctgagatggcctggtccagggctgcctggaccgtgatgcgttcactcctgatttgttggctggtatctgcttatattcttgctactgtaactgatgtccaaggaagtcacataggcatccctgggagcttgctagagctcaggcaccaccctagatccaatgaatcagaatctgcatgttgacaaggtccccaggtggttcatatgtacattcaagtttacggtgctttgctctggatcccagcctgagtgttagttctttaaagagacctttcccaactggccaaatcttatcaagtcatgtgatggattcacccacacggtctgtgatacagaagggaaaagaagttgagacctattgatcagaagctgctcactttagagttttacctacgggtgatcctatcaaaagttctggattttgtagagaagcatacaaagtatgtgaatagtttgatttgagcacattgaaaattgccagttttctttgctttaaccaatgtttgctttccctctggaaatcccttgttacaggtccttagttttagtttgccacattatgacacgatgggaataatgcacagcagtgatcctcagttggtttgggttttcaatacataattgatccatggttgtgacatgcattgtagcatgtccaactagaatacctattctttcaattactttcattactttcaatggcaaaaccacaattacttttgcactaacctgatagctttgctacaagtcagttgttcagttttctttttttgttgttgtttgtttttatttttgcaaacactttagatactgcatagtggatggattagtttgtggttcctgggatcttctgtgtattctgttgaagctcaataatcacattactgcggacctccaaaattttacaaaggactgcacagtgagtattcagccgataaactaaaccacagcttaatactgtgagatgaaagaaagcacaccaattaaaagtaaacactgtttaaacctacctcaatgaatttctaaagtgtcatacatttattatattctctacttgtaaaatattttgttgtgtgtattgccaagtatttcaggattttatggatataatgtattctattaatttaactggaaaacttgtagttattcaccaaacaaactaaaagtgttggcagagatgtaattttaaagcacaatcccactcattcgttcagtattacagctgctccttgtttgtttaataatagaactgatgagtagttaatttgagaggaaagctggtgcaggtgtagtgctatttggatgtcatggaggacacatgtgacatctgcagctagctatatggtaaaagcaaaacagaagttaaaatcagccctgtgtcaaatctgcatagttttaggcttcagggagtgtctctgtatgttgaggcaggaagtttagtagaattccaaggaagtaagagaggaacaaacatttgtagattttgccttctatgggggaactcattcaatcatcaggagaactcttcaataggttttatttgctccggtttacctagatgaaaaattgagacccagaatccatgcttttctttcctggttacacattagaatcaccaatgtgacattaaaacacacacacacacacacacacacacacacacacacacactgcacacccattaggatggctgctatcaaaaaaaaaaaaaaaaaa

SEQ ID NO: 1629 - DNA, 1183 bp, Homo sapiens
  misc_feature (4)..(4): n equals a,t,g, or c
  misc_feature (7)..(7): n equals a,t,g, or c
cacntgnattcatctatcagaacaatggtgtgagcatgaagaggcacagacaggtctccaaaatagatgttaggatttgggtgctacctgacacagaagtaggtctaaccctccaagtactggggatgataggataatcaatgaggtatatatatatttgtcattttgtataaaatattgtgaaaattgaaggaggacactcagtaaacatcctgggactatttgtaagttatggcaaaaccagatgagagaaaagggacagtcccctctgtatcctcgttgtctcttagtaacatcaaattgtagttaaaaaaattttaaactatgtacaagctacaaaatagcatctctttcatggtatgtttgagtgtgtaattttagtttcttttctggttgtatttgtggtagtcagatgtgttggattgattccaactggacagagtaaggaattccagcatcctcttcctgcttgctcgtgttaccccacagatcaaaccctcaattctagttggggatgctgtctagccccacaccatgactgaagccttaagcactgttgcgcctccatgtgctttggatcagcaaccccagtggtattctaccagagcattgtgggaaagcagatgtatagtcaggtcccaayagcaaattgttgggtgtgagagttctaaagtataggggtgagggaagagaaggatatgaactcctctgaccttaagccagcattcatttaacttttatgtctacttaacaagagaacctggagaaaactaccgtattcaagagattaatcaaaatcagtgttttagccaggcgatgacagagaagcaccattcctcaccctccattcttgtaatgtctgtaataaatttcagtgcgtcaggatggatgaacccaagatccagtgaatgattcagctgttccaagccttacattttccatcattcatcatccattctcattcagtgtaacctcttgcactattgtggttaattttatgtaaaaccagtttatgtttttttttttttaatatgtgcctatgtaataaagtctacacactggctatctctgtagaggtgaggttttgtttttagttgttctactgattatatccttttctgagctatgaaaatgaattattaataaaaaatttttgaacaaaaaaaaaaaaaaaaaactcgag

SEQ ID NO: 1630 - DNA, 2274 bp, Homo sapiens
ggcacgaggttttttttttttttttttgctttaagtttcaggatacatgtgcagaatgtgcaggtttgttacataggtatacgggtgccatggtggtttgttacacagatatacctgtgccatggtggtttgctacacctattgacccatcctctaagttccttcccctcactcgccacccgctaacaagccctggtgtgtgttgttccctccctgtgcccatgtgttctcattgttcagctcccacttatgagtgagaacatgtggtgtttggttttctgttcctgtgttagtttgccgaggatgatggcttccagcttcatccatgacatagcaaaagacatgatctcattcctttttatgagtgcatggtattacacgtattttaatagctttgaaatttatcgatttcaatttacatttattgagtactcactatgggtcaaacaccatgcttctttaccaggggtacaataaacagagccaaaattttatttaacttgtatatacaactttactatcaacattagccattgaggtgtaaaaataaagaagcaatttgtattaaaagtcaatttccacataatcacgtcttataaatgccatttacttttattatacataactcaggaaggtgagttttagtaaacagctgaaaagctatttactgaaatttattaattgctttagaatgaaaacaaaacaaaatgcttgtaagcaattacagagaaaagagaggtacacatggtaaaatatttaaaataaagttcatacaattaaaaatattatcataccactgacctttggtttaaaaaaacaactatgattcaaggataaaatatgttaaatccataaaataatacaacataatttctagagaatttggctttttctactactctaaatgtgtcacatcctaatagcatcacaaaatttaattatgatactaataattattctaattattattaaagcattataattctattattagaattacttggcactcattcaaagagatataaacatatcaattaaaaaccatgtatttttcaaaaaataaaactgaactaattataaaaaataaagattcctgtaacggattttaatcttaataccctggagaaccttaatgttaatcacattcagaatttgttttttcagctctcccttctgactggagctgaggctaagataggaaaaaaaagtccacttcccagtcatgccctggtttctgctgcttttgtcttcacactgtatctttagttttatgcagcagtccaaggcttgtaattcttctgatgacacatccatgccattgcggctgtctccgaactccaccaaagagcatggagactctgtaagactgtttcggagcttgtcaacatccttctctctgtgctattgtggtagcatgaattttgtgaagcatgatgccttttaatctactcttggtttcccagacataaaaaggacctagtatgcttccctttgcagaagcaataggaaagcaaaggaagcaatgtacagctcaggatccaaaccaacctcggagaaagtctctttgctcatttctaacagtctccagcctactctccagctaaaaagtcaagaagagaccaaacccattggttcttccccattgcatctccaattcactttctgttgtagactgggaaaataactttttaagttaaaagttaagaatttgactggccgcagtggctcatgcctataatccaagcacttcgggaggcacaggcaggcggatcacctgaggtcaggagttcgaggctagcctggccaacatggtgaagccctgtcaccactaaaaatacaaaaatcagccgggcgtggtgacacatacctataattctagctaatggggaggctgaggcagcaggagaactgcttgaacctgggaggtggagattgcagtgagccaagatcacgccactgccctccaggctgggcaacaaagcaggacactctgtctcaaaaaaacaaaaacaaaaacaaaaaaaacagttaacaatttgataattgtgctcttcttctaaggtgaggtttttactcccaaccaccatataggagaatgattagaaaacaatcatttttaaagaacaaaaagaaaaatccactagcattttgttttatattgtgttttgttacaagatacatcgtactctaggccaggcgcggtggctcacacctgtaatctcagcactctgggagaccaaggcagactgatcacttgaggtccagggggggccc

SEQ ID NO: 1631 - DNA, 2805 bp, Homo sapiens
ggcacgagagagaaagatgtcactgtctctaatctccctgtcatttttatttccagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcccgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgagtcgcttccatgccccacacccacctgccaggaggctttgtggaggatgaggcctattgggcaggggtcttttgacctagctctgagttctgagcctgcttctgtgcccacaggtgaggggtatggggcagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgcggggctggctgcagtgtaccgtggacagcctcagggggctgtcggccaagagcctggagaaagggagcaagctgccccctccttgcccccaaggatgaggctggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggctgtttttgagtatgagtgcagtcgtgtccatcctccatggcacagccctcctgctgccaggacctgcttgaactaccagggccacaggagggggataatcagagcttgaggctggcactctgactgctggcttttcccaaacagcccaagggccggaacagcaggtggcttctcagttcctctgggcctggagtgacacaggaaggatctgcacttcctctgtgctgcttgccagccttgcagttggagttttaagcagaggtgacatctggttgacgcctcaggtgaaaatctggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctccccacatggtgctgaggctccctgctgcaatgcaattaaagcaattgattttctagtgctggtatttgttgactaccatgcagaagggctatctttctattcacgtcaaacttttggttgtgtggggttttttgttgctttttgggttttgttttttaatactttagggtcctgatttgtgggaacagaccttcttgtaaataaccactatttgagttgtggcaggaggatgataaagcacgcggcccctcccaaaggagcccttgagctagggaggtggtgcagtcagcctcgctctcaacgtgacccggggaatgaccacccagagggatgagctagcctgtagaggggaactggggtccaaaggtctttggggagggaggcagagctggctggctcagctaagtggcacgatgacgcatgaaggagattatgttgtgctctttattgccaaaaataaacacttttaaaaagacaacttctgttaatcaataaatatcctttcctttcaaaaaaaaaaaaaaaaaaa

SEQ ID NO: 1632 - DNA, 1510 bp, Homo sapiens
  misc_feature (39)..(39): n equals a,t,g, or c
aggcgacgtgggccagatcttctcctgccgcctgcaggncaccaacaacttcttcggcgccgggcagaacaagcggccgccaagctgggcmagatcggccggagcaagcgggttgttattgaagatgataggattgatgacgtgctgaaaaatatgaccgacaaggcacctcctggtgtctaactcccccaaagacaatgagttaagggagagaataagaacggcggtaacagttattggcaaaaagcatgaaaagagaaagcactttgaaatttattactagcttgctacccacgatgaaatcaacaacctgtatctggtatcaggccgggagacagatgaggcgagaggaggaggaggaggaggagaaggctctgggctcctctgcaaaaataaaaataaaaaaataaataaaattttaaaaataataaaaattcactatatacacatataaagaaataaaaagaagtctcagttgcagctatttgtcaaaattaatatccatttctttttatatacggtgaatattgcgcaattatagatctggattttgaaccacttaatgaagcggcaacaccaggtgttttgaggtgttggcattcttcgctgatttggctgttcccaatgtttacattatttaatcttgcaaaaatggttctgtgcacttggatgtgaaatgctgtccagttttattttttttatgttgttatccttggatgtacaaaaaattcagaaaatgatctctgtagatattctgttttattttggtcatctttagaagttatcaggaatgtgtttaaaacaagaagagaacttttctaaggaatgatacatagaaaagattttattttaaaatgagttgtaaagcttgtgtttctttgttgctgcaagctatctgcccaagttaatgcaaatggacacattttttatgtcagaaaaacacacacacacacacacacacacacacacacacacacacacgaaaaacaaagaaaaaaatgcttgagctttttctaacttccccttgcagtctgttgtgtgagcagcctgtttatttctctaatattatgtcagtttattctctttaatggactgtaaaaaaatgtaatcacaagagtgccaaatatcttgaaatgccaaaaggcattttagtttcttttctctgtgctctgagtccacgtacaggaatgcttggagtgtcttttctgttatttatagggattctcttaaggcacaccagctgcctgttttgcatggtatttgcaaaaatgcctcttgcgtgaggaaatcttttaccattttttgtttgcaactttggacctcaagaggtttcccttcccttccccgttccctcttttcttaattcaatattctgtatgttgcaccttgaaccagcacacagggctatttctccaatgtacaataaaagaattgttcctgtgtctcaaaaaaaaaaaaaaaaaaaaactcgagggggggcccgtacccaatcgcctratgatcgtatagc

SEQ ID NO: 1633 - DNA, 1442 bp, Homo sapiens
aattgcttggcatgagtttactttaatggctgtttctgagtttgatccctctccggaaccaaccsctctgatgtgtcctgttccagcaggaagagacagacctggaggttctgtacttgtgatttctggttgtggatcctgagaacaagaagtactgggatcctaaagttctgacatttgcaaagcagattaatgacctaccacattccagatcatttggtgayywtgtgttgtgcgtgtgggtgtgtgtgtgtgtgtgccaaattcaaggtggtcccagcctttctagtcttctctaacctttcttctcaraartcgcacctgttctgtctttctaggatataattttttttctattagcctgggtaacaccccaaccaataaagtttgcaatatccaagcctcctaatttctctacttattagcttatattaagcttcagcatgagcaagcctaaaaactcgccattatctggaaaagttctatttcacaggctttaatctctcctagagtagttagcactcttttgtggctttgtgttcctgtactagcttgaattccacagtctgacgttaataattagctccttaacacgtccatcctctcttgatgtcctgctctctatttttccttctttcttccaagttgggataaattcagcttcttattttcctgctccagamcttggttgtggagaaagatagaaaaagttccatacaggggactctgtgatcctgctaacatcattatttacctaagctctttagactccagtgaaagcttctgatttaatgtcatgtccctactttatgccacatgtcccataccattttctttgttttatgcaatttatttccactatctgatcccattccacccacatgactttgagtggaaaacttcatctcttcattgctgagtaaacaaacttcaggatgaacaagccctgtccactattttcccttttactktaaarkyctggaatttwwatgatctacgtttttttcctctgtttttattcttcactccatatcaacttacttggggatctacaccttcattcatycttttcattctgtcggcacctggctatggagtttacatttctcatcatatttactcctcataataatcctgtgaggtatataccactctgagtcttgtataagagaaaaagaaactgagatagggataactcaaagggataattcatttgctggagctaccaactagctactaaccatgctagaatggacagagatgacattcatgccaaagaccatgttgacttgctatctctacatttgctctaagtttagaaaaaaaaaatcccttcaatttatcctccaacagtcttcttagaaccttaccatggatgccttgtwtaacacatttcacctttctggtaaaaaaaaaaaaaaaaaaaaaaaaaaaaaactcga

SEQ ID NO: 1634 - DNA, 1040 bp, Homo sapiens
aggaccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagsgtctcagaaagcactatttctggagccaaggaggagactgtggccaccctcaccatgaccgaccgggtgcccagtcctctctccacagtggtatccacagccacaggaatttcctcaaccgcctggtccccgccgggacyyggaagcctgggacagcagggaacatctcccatgtggccgagggggacaaaccgcagcacagagccaccatctgcctgagcaagatggatatcgcctgggtgatcctggccatcagcgtgcccatctcctcctgctctgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatatatatattataaatataacctttgtgtaaccctgacttaatgagaaacattttcagctttttttcctatgaattgtcaacatcttttttacaagtgtggtttaaaaaaaaaaaaaaaaaamtcactgcggccgtcaagggaattc

SEQ ID NO: 1635 - DNA, 1146 bp, Homo sapiens
ggcacgagatttttggtcaggtttttatgttgtttttcagtttgaaggagtcgttatatatttttcatactgctattttgttagtagtatgctttgcatgtgcagtagtatgtcagtatgtaatagtacgtgtatgtgcagtagtattttgcttttcaaaatctcagtctttgatctgaatttaaagaatagtatttttttgtgtaagaggttatttttatcttttgctatttaaaaaatcaagtgccatttgtatatgatagtacttaagtcttcagtttgaattctaaaaatgtgtatacctatataatccacacacctgtcatcccatcatcctatcaacacccctgaaaattcccttgtgcctcttcctagtcaaccccaccactgcctcaagtaagtactcttctgatttctgttctcatagattagtttcacttgctctagaacatcatataatggggctgggcgcgatggctcacgccagtaatcccagcacttgggaggctgaggtgggcagatcacttgaggtcaggagtttgagaccagcctggcaaacatggtgaaaccctgtctctactaaaaatgcaaaaattaacctggtgtggtggcatgccttttgtaatccccagctactccaggagtccaaggcccgagaatcgcttgaacctgggagacagaggttgcactgagctgctgcactccagcctgggcaacagagtgagactgtctaagaaaaaagaagtttatatgatggaattatacagtaaataatctgtatctattttcatttagcattgtatctatgaaattcatgcatgttttatctattaatattttttttggccgggctcggtggctcacgcctgtaatcccagcacttttggaggctgaggcaggtggatcactaggtcaggagttcaagaccagcctaggcaaagatggtgaaaccccatctctactaaaaatacaaaaattagctgggcatggtggcaggcgcctgtaatcccagctactcaggaggctgaggcagagaattgcttgaacctgggaggcagaggttgcagcaagctgagatcgtgccactgcactccagcctgggcgacagagcgagactccatctcaaaaaaaaaaaaaaaaaaaaaa

SEQ ID NO: 1636 - DNA, 1228 bp, Homo sapiens
  misc_feature (580)..(580): n equals a,t,g, or c
  misc_feature (621)..(621): n equals a,t,g, or c
  misc_feature (1159)..(1159): n equals a,t,g, or c
ggctgcccaggccccgcactggaagagcctccagcagcaagatgtgaccgytgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacatcatccaacaggaagcgtcaccctgagggaggagacagaagcctgggccaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatgnttccagcctgacctggtgctggtggcgctggggcctgccantgcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgccccsgccccacccatcgcgccccggcccgtcccatcgaggcccatgcaacccacgctcggtyccgttccggcccctgcgctckcgctknsttcgctccccgcccttgcgccgttagtaaacatcgctcaaacgaaaaaaaaaaaaaaaaaaaactcga

SEQ ID NO: 1637 - DNA, 894 bp, Homo sapiens
  misc_feature (836)..(836): n equals a,t,g, or c
  misc_feature (852)..(852): n equals a,t,g, or c
ggcacgaggtcgcgcctaggcctttccctcaggttttcctcttccccactgcggctccccagtcggcgcttgcgsggagaactcagcgctgagattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaasttgaccttctcttagattatgttcaatgaatattgtaaatgttcaagtattgttaatgaatagaataaatacaatattgcattcccawaaaaaaaaaaaaaaaagggcggccgctctagaggatccaagcttacgtacgcgtgcatgcgacgtcatagctcttctatagtgtcacctaaattcaattcactggccgncgttttacaacgtcgngactgggaaaaccctggcgttacccaacttaatcgccttgca

SEQ ID NO: 1638 - DNA, 749 bp, Homo sapiens
aaggccaagccaatggtagaagaaaacagctttattgaaggggcagtgttatagctccagccctgttacaactctgattactcctgcacagcaggctctggcagagactagcagctcagggcagttttgcagtcatttatakswaytyggcacgagggcagattaaggggtgatttgtgcaaaaatttctagggaatgggtaataacttttgggtcatcgagtcaatgccatggaagagaggggggataaccccctggtgttgcgatggcaacggtaaactgacatggcaactgatgagcgtgtcttacggaaagctcattccaccccagccctgtttcagctagtcctcaatttggtccagtgtccgagccctgcctctggagtcaagtcccacctcctacctcataaggagagacataaatcaatggaatagaatcgagagttccagaaataaactcatacctcgatgatcaattgattttcaacaacagtgccaagaccattcagtkgggggaaagaatcatattttcaacaaatggtgccagataacgacatccaaaggagtgcaactgggcccctgtctcacaccatctacagaaattaagtcaaagtgcctcaaacactaagagctaagactataacattcttagaagaatacagggttacctctttatgatcttgatttggtaattgatttttagataacactaaaagcacaagcaacaataggaaaaaaaaaaaaaaaaaa

SEQ ID NO: 1639 - DNA, 362 bp, Homo sapiens
  misc_feature (343)..(343): n equals a,t,g, or c
  misc_feature (345)..(345): n equals a,t,g, or c
ggcacgagcctggccaatttttcctccatctgtgagtcagcgtaagtatgcctactcttttttcaaacctcccctgactcactcatgcagaatagaagtcctgctttctgttttctccttatgtacttactgtgcacttgtgtaacaagagttcttttaagtataatcttcaatttgataagggcctacctctggagttggcatgatgttacaccatgtgtaagagtaggaattaccccagtttatcttttcctatccagtgctgcacacaatgccaggcatatagtaggtactctctaaatacatgataaggatgggtggatgcatgactttgtctttaagngntaaagttagttgttaaa

SEQ ID NO: 1640 - DNA, 933 bp, Homo sapiens
ggcacgaggtgcttccctcccagatggctgtgtatgtattttcttttcttttttgctttcttcttctttccgttgttttgttattgttttaactataataagagggccagaggcagtcaagccctggccaggtcctggcggcccatgggggttctggggagggggaggggggaagtcagtgggggtcagaggtggagggtgaagaatgagaaagttggggagttaggcttagctcaggaaccatgtgtccctgcccactcccctccttccttgcccctccctacctccctgcctctacatggcttctctccacccctcccagagtcctacgggacaggaccctgctccagtggtatccaactcctccctgcccactcttcctcatgggccacctcacctcccactttcgatgtctcgcctcccgtggccaccctgcaattagctttccaagccccctcccgtggccgtcccctcccaagacctctcacccatgtagcaatccctacatggctgcctgtcatgtccctactctctaagccctcctgcccactgttcctccctccccgacatgctgasaccaagtggtggaaaccacccctcagccccagcctgccctgtgcagarttcagctktgtgttgaatgagggggagarggacaagtgagggcggagagagagttcaggaggaggcaggatgcgcagggagcagagagtgagggagggagataccgaacagatagacagaaaacgttgtacggaaaagttgttttttcttattttttttccgggagaacccgcttacacagctctgtttgtaatttttttcttcatgctaaaatcacacggcctatttgttgatgtaagttgcctgaattccgtggtatgctatcttcttttttaaaaacaaaagcaaaaaaaaaaaaaaaaaactcga

SEQ ID NO: 1641 - DNA, 585 bp, Homo sapiens
gaattcggcacgaggtgaagtggcatttcttataaagaaaaaaaagtcctctagtattgtctatgggaaattcttccaggctacaatacctagtatgcaagttttaatgctggcacattttttgatcttgctagaacatgttcagggaaggtgttcagacaacaactaggactaatattccttcaagggtcattaaatggttgattaactgaaacatcaagggattatagatcaggcatgtgtaggcaatgacaactatgtcatgactgctgtgtggccaacagtaattgaaggctgccatcaattataagacacattccatttcagagatgttacagtgtggggtgggggaaagtctgtctggaattagtagtaagggacctgtcttataataggcagaaaatgtgtgtaattgaatcttaagtatataacatctaaagaattataagattttagagccaggaataaaaaaacacatgttaccatcccttagaatcttagaaaatgttattggtgaaataaactttagtgatgatcatacagaaaaaaaaaaaaaaaaaaaaaaaaaaaaaaaaaaaaactcga

SEQ ID NO: 1642 - DNA, 1433 bp, Homo sapiens
cccggagccgtggacgccctacagctgagaaggggacccaaggggtcggccgcggccaaggcccctaggaccgccgccccagctcacgctgccgacggcattatkagacattctgcgtcaggtccgggctcctggacttcgcctttcccgagccctggaggtggggagaaaaggttcaccaatttttaaaatccaaatatatctcatggtacagtggaagaactggccagagagtctggaagtttgggttctggtcctggctgtgccactgactcactgtgaccttgggatcttgtgctgtgaagacatttcccaagtgcttcatgttagccagcaaatctgacccacaaggcctggaaagaggtgattgttaggttgcgcagaggtggtcttatccagctcagcttcccctgggacccaccgtgggacctgaggcagaactggggtggacttggcctcctccatggcacaccggctgcagatacgactgctgacgtgggatgtgaaggacacgctgctcaggctccgccaccccttaggggaggcctatgccaccaaggcccgggcccatgggctggaggtggagccctcagccctggaacaaggcttcaggcaggcatacagggctcagagccacagcttccccaactacggcctgagccacggcctaacctcccgccagtggtggctggatgtggtcctgcagaccttccacctggcgggtgtccaggatgctcaggctgtagcccccatcgctgaacagctttataaagacttcagccacccctgcacctggcaggtgttggatggggctgaggacaccctgagggagtgccgcacacggggtctgagactggcagtgatctccaactttgaccgacggctagagggcatcctggrgggccttggcctgcgtgaacacttcgactttgtgctgacctccgaggctgctggctggcccaagccggacccccgcattttccaggaggccttgcggcttgctcatatggaaccagtagtggcagcccatgttggggataattacctctgcgattaccaggggcctcgggctgtgggcatgcacagcttcctggtggttggcccacaggcactggaccccgtggtcagggattctgtacctaaagaacacatcctcccctctctggcccatctcctgcctgcccttgactgcctagagggctcaactccagggctttgaggccagtgagggaagtggctggccctaggccatggagaaaaccttaaacaaaccctggagacagggagccccttctttctccacagctctggacctttccccctctcctgcggcctttgtcacctactgtgataataaagcagtgagtgctgagctctcacccttcccccactaaaaaaaaaaaaaaaaaaactcgagggggggcccggtaccc

SEQ ID NO: 1643 - DNA, 1569 bp, Homo sapiens
  misc_feature (282)..(282): n equals a,t,g, or c
gcccacgcgtccgcttcctccaaggctcccccagatttaccagtgacgcccttccctaagtatcaacttagccgtactttgaactctggcccctcaggtttcaaggggacggccttgtctgggatcagctctgtctggggaaagaagctgcaccagcctctgaatagcaggctgagtcacttgtttcttgtgccttgagtcagttctctcatcagctctcctcctaagccagtgttattacctccagtaaagatggaaaagttggggttcagagaaggctanaaacagacagcctgctgtgtcctgtcttttctcctggcacgagcaggttcaccaatttttaaaatccaaatatatctcatggtacagtggaagaactggccagagagtctggaagtttgggttctggtcctggctgtgccactgactcactgtgaccttgggatcttgtgctgtgaagacatttcccaagtgcttcatgttagccagcaaatctgacccacaaggcctggaaagaggtgattgttaggttgcgcagaggtggtcttatccagctcagcttcccctgggacccaccgtgggacctgaggcagaactggggtggacttggcctcctccatggcacaccggctgcagatacgactgctgacgtgggatgtgaaggacacgctgctcaggctccgccaccccttaggggaggcctatgccaccaaggcccgggcccatgggctggaggtggagccctcagccctggaacaaggcttcaggcaggcatacagggctcagagccacagcttccccaactacggcctgagccacggcctaacctcccgccagtggtggctggatgtggtcctgcagaccttccacctggcgggtgtccaggatgctcaggctgtagcccccatcgctgaacagctttataaagacttcagccacccctgcacctggcaaggtgttggatggggctgaggacaccctgagggagtgccgcacacggggtctgagactggcagtgatctccaactttgaccgacggctagagggcatcctggggggccttggcctgcgtgaacacttcgactttgtgctgacctccgaggctgctggctggcccaagccggacccccgcattttccaggaggccttgcggcttgctcatatggaaccagtagtggcagcccatgttggggataattacctctgcgattaccaggggcctcgggctgtgggcatgcacagcttcctggtggttggcccacaggcactggaccccgtggtcagggattctgtacctaaagaacacatcctcccctctctggcccatctcctgcctgcccttgactgcctagagggctcaactccagggctttgaggccagtgagggaagtggctgggccctaggccatggagaaaaccttaaacaaaccctggagacagggagccccttctttctccacagctctggacctttccccctctccctgcggcctttgtcacctactgtgataataaagcagtgagtgctgagctctcacccttcccccactaaaaaaaaaaaaaaaaaaa

SEQ ID NO: 1644 - DNA, 456 bp, Homo sapiens
  misc_feature (444)..(444): n equals a,t,g, or c
ggcacagcaaacttgacgccatgaagatcccggtccttcctgccgtggtgctcctctccctcctggtgctccactctgcccagggagccaccctgggtggtcctgaggaagaaagcaccattgagaattatgcgtcacgacccgaggcctttaacaccccgttcctgaacatcgacaaattgcgatctgcgtttaaggctgatgagttcctgaactggcacgccctctttgagtctatcaaaaggaaacttcctttcctcaactgggatgcctttcctaagctgaaaggactgaggagcgcaactcctgatgcccagtgaccatgacctccactggaagagggggctagcgtgagcgctgattctcaacctaccataactctttcctgcctcaggaactccaataaaacattttccatccaaaaaaaaaaaaaaaaaaaccccngggggggcccgg

SEQ ID NO: 1645 - DNA, 602 bp, Homo sapiens
aattcggcacagkttgtgtttctmatgttccaggtccggccaggctggcagctcctgctggtcatgttttcctcatgtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagyttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccaggatgtgtacccggttgtagtaggagctgaaatccatgctgagctgtaccaggaacttgcatatctagagacagagactgagtcactggcccatctctttgctcttgtccccaggccagaataaagaatagagtgtaaaaaaaaaaaaaaaaaaaaaaaaaactcgag

SEQ ID NO: 1646 - DNA, 3692 bp, Homo sapiens
  misc_feature (518)..(518): n equals a,t,g, or c
  misc_feature (606)..(606): n equals a,t,g, or c
  misc_feature (639)..(639): n equals a,t,g, or c
  misc_feature (2303)..(2303): n equals a,t,g, or c
  misc_feature (2441)..(2441): n equals a,t,g, or c
aattcggcacaggttgtgtttctmatgttccaggtccggccaggctggcagctcctgctggtcatgttttcctcatgtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagyttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagattctccaggcctttcggggacaccagggaygtggkayccgggccatagctgcccatgagaggcaggcctgggtgatcactgggggtgatgactccaggcatcggctgtngcacttggtagggcgtgggtaccggggattgggggtctcggctctctgcttcaagtcccgtagtaggccaggtacactcaaggctgknactctggctggctcttggcgactgctggcagtnactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtracttcctggtgtgtggtgaccgccggggctctgtgctgctattcccctccaraccaggtctgctcaaggaccctggggtgggaggcaaggctcgggctggtgctggggcactgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtratggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttsgtcccaccggctagatgagtattgggaccggcaacgcaatcggcatcggatggttaaggtagacccagagaccaggtaatatatgctcctgggcagggtgtggtatgggtcatgcagatgctcccaggcttgcaggctccacctgacagctgcatgttgtctctgcaggtacatgtcccttgctgtgtgtgaacttgaccagcccggccttggcccccttgtggctgcagcctgtagtgatggggccgtaagntctttcttttgcaggattctgggcggattctgcagctccttgctgaaaccttccaccataagcratgtgtcctcaaggtccactcctttacacacgaggcacccaaccagaggcggaggctcctcctgtgcagcgcantactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtaragtraaaaaaaaaaaaaaaaaaaaaaactcgag

SEQ ID NO: 1647 - DNA, 629 bp, Homo sapiens
  misc_feature (533)..(533): n equals a,t,g, or c
gcacactttgaccacttgtgatgagccttatttgggagcaaggtcttcaactttgtggtttttgtttgttttatttggttttctgcttctgcattagttcacttagggtgatggctttcagctgctyccatgttgcttgctgcaaaggatatgattttgtycttttttatggctgtgtagtattccatggtgtatatggaccacattttctttatccaatccaccatatatgggcacctaggttgattccatgtctttgctattgtgaatagcactgtgatgaacatagaagtggattaaatttctttttcttgacagtctcctaatttatgcttgtacatatatttttctctcatgccttgaggtttttaaaagtcctctcctctttctcatggcaatacttttactaaagtacatttcctgggaatccttagggttccccttattttgaataggctgaatattttcatatgtttggtgatttttatcttttaatcctttaataggtttgaaagtctctcttgatatgggtngctcagataggctccatcgtagagtctagaaatcatcctatgatttttttttgcccattcctaggttaaaaaaaaaaaaaaaaaaaaaaactcgag

SEQ ID NO: 1648 - DNA, 785 bp, Homo sapiens
ggcacgaggggctttgcgtacacaatagctgctaggagtacccaaagcctgartacarcctgctggtgtcatggccacgtgtgagcaggccagcgtcamacggctcgctgtgacccgtcccgragactgaaatgggcctgggtcttctcctkgtcctgtgatwaaagtcctctcttgaaagtggagagcaaaggcacacagaggtgcgcgctcacaagaattcctcccggtgactgggtaatcaatgttactgctgtttcctttgcaggaaagaccacagcaagattctttcattcgtctcctcctagcctgggggaccaggctcgaactgaccctggacatcaaaggagggattatgtggctgctaaagccatcggcccacagccctgttcacrtcttggtgcttctctttcccagaggctggtcccagccaggcacacacaaaaggcagattctcgtaaacscagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgtaaaaaaaaaaaaaaaaaaaaaaaaaaaaaaaaaaaaaaaa

SEQ ID NO: 1649 - DNA, 1168 bp, Homo sapiens
ttgcmaggaattcggcacgagcacagcctgagatcttggggatccctcagcctaacacccacagacgtcagctggtggattcccgctgcatcaaggcctacccactgtctccatgctgggctctccctgccttctgtggctcctggccgtgaccttcttggttcccagagctcagcccttggcccctcaagactttgaagaagaggaggcagatgagactgagacggcgtggccgcctttgccggctgtcccctgcgactacgaccactgccgacacctgcaggtgccctgcaaggagctacagagggtcgggccggcggcctgcctgtgcccaggactctccagccccgcccagccgcccgacccgccgcgcatgggagaagtgcgcattgcggccgaagagggccgcgcagtggtccactggtgtgcccccttctccccggtcctccactactggctgctgctttgggacggcagcgaggctgcgcagaaggggcccccgctgaacgctacggtccgcagagccgaactgaaggggctgaagccagggggcatttatgtcgtttgcgtagtggccgctaacgaggccggggcaagccgcgtgccccaggctggaggagagggcctcgagggggccgacatccctgccttcgggccttgcagccgccttgcggtgccgcccaacccccgcactctggtccacgcggccgtcggggtgggcacggccctggccctgctaagctgtgccgccctggtgtggcacttctgcctgcgcgatcgctggggctgcccgcgccgagccgccgcccgagccgcaggggcgctctgaaaggggcctgggggcatctcgggcacagacagccccacctggggcgctcagcctggcccccgggaaagaggaaaacccgctgcctccagggagggctggacggcgagctgggagccagccccaggctccagggccacggcggagtcatggttctcaggactgagcgcttgtttaggtccggtacttggcgctttgtttcctggctgaggtctgggaaggaatagaaaggggcccccaatttttttttaagcggccagataataaataatgtaacctttgcggtttaagaggataaaaaaaaaaaaaaaawaaawaaaaaaaaaaaaaactckagggggg

SEQ ID NO: 1650 - DNA, 911 bp, Homo sapiens
  misc_feature (1)..(1): n equals a,t,g, or c
ngcgctgaggctgctggaggcgcgggccgggcggtgcgcactgcgggcgcatccctgccccggcgccgtccgtgcccgcgggacctgacagccgggtcagagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccctgcccagtgcagggctgcctcagaccacacagggtgcagctcctccggcggtgggggcgggttcaacagcagggcagggctgagcaaggtttcagtcctcggtggtgggggcgggatcacaggccagagctcgcaggggccttccttctcagaacttcttggcgtgacgcttgtcacggtatggccggtcgaggccttaagcaaacggttgtgctcgtgaataccgagaccctggttgtgtggccttctgccgggaatgtttgagggagagttttttcgcggaattatgagtgcggaactctcccacaggaacgatcggctaactacct

SEQ ID NO: 1651 - DNA, 940 bp, Homo sapiens
ggcacgaggggactctgggcatggctgtgtccctgtggcctgaggggtctgggcctctctgtgccctctccctgctcacgtgctgcctcgttttgcgtcctgcttcatcctctggattcctctggagcctggaagagactcctgcccttcaagggctttgtgaaattgcccagccttaagtgtagagtctagtttttagactaattttttttgtatttttgtatttgtaatttttgtgggtacatggtacatacgtttgtaggtatggggtacgtgagatattttgatataggcatgcagtgtgtaataatcgcatcagggtaaaggggtatccaaccctcaaacatttgtcctttgtgttccaacaatccaattaatactcatagtgatttaagaatgtatgatacattattggtgcttgtaatcctgttgtgctggcaaacaccaggtcttactggttctttctcactatgatttgtacgtgttcaccctccccacctcctgtagtctagtttttattctgtcttttccccagaggccacagaaactggtgtggagaggtgatgctcacttcccagccttggggtcagcccctgcattttctctctaggaccatgtgtttctcgattgttttcattcctctgttgtcagtttagccagatgcagtcatatgaggtctttgcgcaaaccttagggtagatacagatctcaaaaatgtgccaagcggggtgagggcaggaggcacaggaagggaggagaaggaagcctagctgactcctcccacccccaagggctgcccctccctacactcctgtttgagtaagagtggcagccacctgccctgtccccgggggtgacaaccttgagctgggagggcgagcccctcagtgccttcttttagacctgtctcacctgcaggtgtctctctagccaggctcaa

SEQ ID NO: 1652 - DNA, 537 bp, Homo sapiens
ggcacgagggtgtctgctgtccccgccaggcaagcctggggtgagagcacagaggagtgggccgggaccatgcgggggacgcagctggtgctcctggcgctggtgctggctgcctgcggagagctggcgccggccctgcgctgctacgtctgtccggagcccacaggagtgtcggactgtgtcaccatcgccacctgcaccaccaacgaaaccatgtgcaagaccacactctactcccgggagatagtgtaccccttccagggggactccacggtgaccaagtcctgtgccagcaagtgtaagccctcggatgtggatggcatcggccagaccctgcccgtgtcctgctgcaatactgagctgtgcaatgtagacggggcgcccgctctgaacagcctccactgcggggccctcacgctcctcccactcttgagcctccgactgtagagtccccgcccacccccatggccctatgcggcccagccccgaatgccttgaagaagtgccccctgcaccaggaaaaaaaaaaaaaaaaaa

SEQ ID NO: 1653 - DNA, 787 bp, Homo sapiens
  misc_feature (39)..(39): n equals a,t,g, or c
  misc_feature (78)..(78): n equals a,t,g, or c
  misc_feature (754)..(754): n equals a,t,g, or c
  misc_feature (770)..(770): n equals a,t,g, or c
  misc_feature (779)..(779): n equals a,t,g, or c
gcctccccttttagggaaagctgggtacgcctgcaggtnccgggtccggaatttcccggggtcggacccaggcgtccngcgaagcctcgaccgctacccgcaccctaaatcccagaggttggccccctgaggtgcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtcaaaaaaaaaaaaaaaaaaaaacncgagggggggccccgnacccaattngccctata

SEQ ID NO: 1654 - DNA, 437 bp, Homo sapiens
  misc_feature (414)..(414): n equals a,t,g, or c
  misc_feature (434)..(436): n equals a,t,g, or c
gaattcggcacgaggcaggaggtaattaggaggtgttggttaccagggagggaggctggaggtgtccagggttatggccctttggaggttgggcaggtaagacggatggggagaggagggaaggagggaggagaactcaatggcttgggtgcgaaccacttgtggagggatggggaggggcagatttgaggacaggctggggactgggcattcttgttttggatgtggctggcgggggctgctcttggctccccggcatgaaccagtctgtggtctggcccagctcctcccaccctctcatgtactgtagccttgtcctccagccagacccttgccccggcttttcaggcatcccagctcagctttttacgggatgggctggagctgttctcagcacaggtctcgggcctcccnagggcctgctggagcaaacnnnc

SEQ ID NO: 1655 - DNA, 616 bp, Homo sapiens
gaattcggcacgagtcttgacagcctggtcaccaagggtttggaaaaaggttctattggagtggagattgatgggtggaaaaaggagagaggggagttggacctgataccaaagagatgttttcagccatcaaccagctgcaaaacaagatgggcttccttttcctacatattcttccaagcatcataaatactcggtctgctccccaacccacatcctgcaggatgcagccagagcaacagccccactccactctgaaaccagtcatcctagggatgatgatcatttcttagcttccctgttggaggtcggttggggttggctgatcgctgcttggttcactcctgcactggctgggcgttggctgcatggtaaagctgttccctgtctcatcctgttgggataaacagagtatcctaggcatattttctccagagcagtggcagacacaaagggtcaacagaaaccctcaaggttttgtcatgcctactcttgcaactagcacattgtcatttcagcctcatgctattgaccaaagcaagtcacttgaccaaattcaaagccacaaaactcgtgccgaattcgatatcaagcttatcgataccgtcgacctcga

SEQ ID NO: 1656 - DNA, 1172 bp, Homo sapiens
aaaattattctgtaccatcacagcttttcacaacgatggcaagccttatgtcttgggagcctgttttgctaggcaaagttacaagtgacctaatgggagctcaaatgtgtgtgtgtctctctgtgtgtttgtgtgtgtgtgtgcactcaagacctctaacagcctcgaagcctggggtggcatcccggccttgccattagcatgcctcatgcatcatcagatgacaaggacaaccctcatgacgaagcaacatgaattagggggcctcttggccttggtccaaaattgtcaatcagaaatgaacataaaggactccagagcagtgggactgtctgtcaaaagactctgtatatcttttgtggatgagttttgtgagagaacagagagaccattgtacctggcacaagggctsttcatgaaaagggagacttactgggaggtgcaagacagtggcatttctcctctcctcttgctgctcagcacagccctggattgcagccccgaggctgagaccagacaaagcccgggaggcagaaagatgctccaagaaccaacactatcaatgtctttgcaaatcctcacaggattcctgtgggtccagctttggaactgggaaacctttcttcggatccgcactcattccactgatgccagctgcccctgaaggatgccagtactgtggtgtgtgagtctcagcagccgcccacacgctcctaactctgctgcatggcagatgcctaggtggaaatagcaaaaacaaggcccaggctggggccagggccagaggggaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgattataatgaagatacacactrtaactacaagaaattataaatgtttttcacatcaaaaaaaaaaaa

SEQ ID NO: 1657 - DNA, 738 bp, Homo sapiens
  misc_feature (1)..(1): n equals a,t,g, or c
ncacaaaaggagccgaggcaggatctgacccttgttctctggcctcactgccctcactttgccatgacccgaagttatgtccctacaaagcaatgcatggtccaaggctctttttattgtatttttatttttaagggtcctgttcaaaactggtgtgagctctgaggagtcctgaaccctgggtgcagcatcctagcatcctgggagtccttttctgcccacactgagctgggctcctcgaggggtggggctgctgtccctggaagcctggcagcagcactgtatcgggttggctgaagctgagcgccgtggggtgcagggctccaggaatcccgtttggctgaaggggttcctgtagccagggatgtttatgaggtctctctgatgccccaggcgcaggacatgtgtgcgggtggagaaaagcaggccctttcagtgccagctccactcaatttctatgtggaccaagaacgataaacttaaaaaattttttttcctaaggtatcttcagaatatggtgtatttttatgtggaaaagaaaagttatgaaggcagctgttactttaagagaaaattcattaaaagtcctcgaggtatgaagatgacggcgtgcttctcaatcattttgggcataacttgattgtggctgtaaatttttttttttttttttgtcaagcatgtcagacaataaagtcctttgttaaaaaggggaaaaacctcgttgccgaatcttgggcc

SEQ ID NO: 1658 - DNA, 1069 bp, Homo sapiens
  misc_feature (20)..(20): n equals a,t,g, or c
  misc_feature (92)..(92): n equals a,t,g, or c
  misc_feature (886)..(886): n equals a,t,g, or c
tcctcaccattcccctaggncaggtccctgcaggtcccacacttctcccaggtccctaaacttgggtcggtcctttccctggagtagctggntcctccagtcgaggtccctgttcagtcggttcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagartacaagcccagcaccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggnactccgtggtggtcctgcccttctccctgcatgcctgtgggtctgctctggtgtgtgaaggtcggtgggttaactgtgtgcctactgaacctggcaaataaacatcaccctgcaaagccaaaaaaaaaaaaaaaaaaaaaaaaaaaaaaaaaaaaaaaaaaaaaaaaaaaaaaaaaaaaaaaa

SEQ ID NO: 1659 - DNA, 1589 bp, Homo sapiens
  misc_feature (1550)..(1550): n equals a,t,g, or c
  misc_feature (1578)..(1578): n equals a,t,g, or c
cccacgcgtccgcccacgcgtccgcccacgcgtccgtttcaaagggagcgcacttccgctgccctttctttcgccagccttacgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccgtggaaggcgggcacagagccatcttcttcaatcggatcggtggagtgcagcaggacactatcctggccgagggccttcacttcaggatcccttggttccagtaccccattatctatgacattcgggccagacctcgaaaaatctcctcccctacaggctccaaagacctacagatggtgaatatctccctgcgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtatccctgttgatccgccgggagctgacagagagggccaaggacttcagcctcatcctggatgatgtggccatcacagagctgagctttagccgagagtacacagctgctgtagaagccaaacaagtggcccagcaggaggcccagcgggccmaattcttggtagaaaaagcaaagcaggaacagcggcagaaaattgtgcaggccgagggtgaggccgaggctgccaagatgcttggagaagcactgagcaagaaccctggctacatcaaacttcgcaagattcgagcagcccagaatatctccaagacgatcgccacatcacagaatcgtatctatctcacagctgacaaccttgtgctgaacctacaggatgaaagtttcaccaggggaagtgacagcctcatcaagggtaagaaatgagcctagtcaccaagaactccacccccagaggaagtggatctgcttctccagtttttgaggagccagccaggggtccagcacagccctaccccgccccagtatcatgcgatggtcccccacaccggttccctgaacccctcttggattaaggaagactgaagactagccccttttctggggaattactttcctcctccctgtgttaactggggctgttggggacagtgcgtgatttctcagtgatttcctacagtgttgttccctccctcaaggctgggaggagataaacaccaacccaggaattctcaataaatttttattacttaacctgaagtcaaggcttcacgtgttcatgaactgggtaactggcagcaagcatgcgcacgttcacatgtgcgctcctgggtctgtctttgtgtgtgccagcagggggcgcaaaagaatctggctggggcggctaangggaagcaaggcctgggctccgaaacangacccaactgg

SEQ ID NO: 1660 - DNA, 1643 bp, Homo sapiens
gaattcggcacgaggaaactgttagcccttaatatgcatcacatttgtggttccatagtgcttctcctttgcttgtttgatctctgcatggcagcagtggggcagctccacatttggagcccatactccaaaatgcagagcactcttctcacagcacacattcccagccccaaacaaaacctgaattttcaactctgcccattaaagtgaatgtatccctgtaatttagtatgtacttattatggaaaatgtaacaaaagcagagaagtgtgatttcattctgtatcacaaattgaagcaaatcaacagcaaatacagcaggattcagggaggcttagtttacaacgtactttgtacctcctgccatttaaattattttgccactctgggcttctgaaaacacaaagggagatacagccctccaactatgagccttgcagagagagacaaaagggccagaggtcctgggatggaatactagagcccccaccttctcatgctttggaaacctgccagagcrcttaccctgctggaagattaatgaagactccattctgtgtttcataacagtagcgttgttttctccatcaaaaacagagggtcacagaaatgtgctgaaaagatgtggtccagcaaggttctgtagtcccacctcagtgcctgtgggctgtgtttttcactgtaacaagcactttggtaaactagaaagaagaaaggattctcaggatgtgttcaaagctaagagagttttcattttaaaaagaaacatacatactcactccatggctttcctcatcctcctctcttttttcttcttggtgggaagctggatgcggggcatgcatcattctgtatggacaaatgtgttatgtccacccatactcttgtgacaactccccagcactgtcctgcaataccatgctggccttggtagtaaaactccttggtatctgtgagagtcctctttttctatgccctagactacttttaaccacttttctctggaatgactcccacatttgattgggtattgaaagggtaacagcaaaatgatgattgtggagatggatctattaggtctcatgttggtcccctggttgaaactatwttcaaaaaagccccaacaatgggcctgtcmccttgctagtcatccattcttaatgcctatttatcagccctctgaggtcatataaaagttgccaccttttgaaccaagtatttgtatttactatgggaaaggtgtggactacagattcgtattatattattttaatggattttaagtaatttataagtatgctgagtgtaaattttttttaaaaactgtattataaaaggacatatcctgtgaaatataacattttactgtttaatagaataattctataagaagaatgatttatctcacccacggaactgattacattccggatgcaatcaataggcactttgtaatttcctttttgtttttttttctttgctggggggttgaggggtaacaagataccatctgtataaagtgcagtttgtgtcactcaaaatatgcactgtatggctacacaaaagcagcttgatgaacaaatcaccccatggctcattaaagaacaaagcttccagaaaaaaaaaaaaaaaaaaaactcgta

SEQ ID NO: 1661 - DNA, 1183 bp, Homo sapiens
  misc_feature (266)..(266): n equals a,t,g, or c
  misc_feature (426)..(426): n equals a,t,g, or c
  misc_feature (1170)..(1170): n equals a,t,g, or c
  misc_feature (1178)..(1178): n equals a,t,g, or c
gtgattcaaagccatcacaaaacactataagactgaccaaaatttagataacctttgaaccacgatttttttccacatctgtytgtgagacacagcgcaatgctactgcccttccagaaactgtgctaaaaagagaaagtccaaaagactctaaacaaaaacctcgacgccgttgaggatgtgtttcattctggtggtctgttttgcaagcttgataacagaatgtccgtgccattgtaaatgttgtagagatgtgggccgtggcncaaccgtcctatatgwgtgtagcatggtacagaacaaactgcttacacaggtctcactagttagaaacctgtgggccatggaggtcagacatccatcttgtmcmtctataggcaagaagtgtttccagatcctttggaaaggtgggcatggggcaggtsnttggagagtggcgtttgagcagagcgaccccatttccgtgtgaaccataggcacaacccaggaagtttccccacttgtaggagtgtgggtattccagagcaagactgtggccaccatcttcccctcttggtgttttccgaaagtgacagtgttggtcatcccatgaccactgaagcttagtaaccagcgccaaaaagtagattcatcaaactagagaccccagctccccttctcgccatcttctttctcaagttgaccgtggtgctgtttctggaaggcatctgcaactccaagtccatgcagaactctggaaggccaagttcatcgcagcatgttcaccatatcccagcctccaaatctatcctcctaccttccaacgcatgacctgttggggagcagagacttaacccccaactcagaggaacccttcctccagcgtctttggcatggtttctagggtgagagttcccaatttggatagaacggccaccatattggttactgaatctctctcccttgtttttattacgtttcctttttcaaactgtccatgggaaggctgaattgagtgactccccagaatgaagatgagaaggtgaatataatcaatgccaatgtaatgccagcgggtgargatggccgatggraggttttcaaagatgtagctagcattttggaaaccatatgggcaaaacccgggcaaccagaggggggaacaggttaagggaccgtttcccaggaaantccccaanttttt

SEQ ID NO: 1662 - DNA, 1684 bp, Homo sapiens
gacccacgcgtccgcgcgcgcccgccccagttatcatggcggctcccttggtcctggtgctggtggtggctgtgacagtgcgggcggccttgttccgctccagtctggccgagttcatttccgagcgggtggaggtggtgtccccactgagctcttggaagagagtggttgaaggcctttcactgttgggacttgggagtatctccgtattctggagcagtatttcatggaaactccattaaataaatatacctctttcatttcctaattgactatgctgaattggtgtttatgataactgatgcactcactgctattgccctgtattttgcaatccaggacttcaataaagttgtgtttaaaaagcagaaactcctcctagaactggaccagtatgccccagatgtggccgaactcatccggacccctatggaaatgcgttacatccctttgaaagtggccctgttctatctcttaaatccttacacgattttgtcttgtgttgccaagtctacctgtgccatcaacaacaccctcattgctttcttcattttgactacgataaaaggcagtgctttcctcagtgctatttttcttgccttagcgacataccagtctctgtacccactcaccttgtttgtcccaggactcctctatctcctccagcggcagtacatacctgtgaaaatgaagagcaaagccttctggatcttttcttgggagtatgccatgatgtatgtgggaagcctagtggtaatcatttgcctctccttcttccttctcagctcttgggatttcatccccgcagtctatggctttatactttctgttccagatctcactccaaacattggtcttttctggtacttctttgcagagatgtttgagcacttcagcctcttctttgtatgtgtgtttcagatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatccaggaatgccaactctaatttcttttatgccatcacactgaccttcaacgttgggcagatcctgctcatctctgattacttctatgccttcctgcggcgggagtactacctcacacatggcctctacttgaccgccaaggatggcacagaggccatgctcgtgctcaagtaggcctggctggcacagggctgcatggacctcagggggctgtggggccagaagctgggccaagccctccagccagagttgccagcaggcgagtgcttgggcagaagaggttcgagtccagggtcacaagtctctggtaccaaaagggacccatggctgactgacagcaaggcctatggggaagaactgggagctccccaacttggacccccaccttgtggctctgcacaccaaggagccccctcccagacaggaaggagaagaggcaggtgagcagggcttgttagattgtggctacttaataaatgttttttgttatgaagtctaaaaaaaaaaaaaaa

SEQ ID NO: 1663 - DNA, 1570 bp, Homo sapiens
  misc_feature (7)..(8): n equals a,t,g, or c
  misc_feature (10)..(10): n equals a,t,g, or c
taccggnnanggaattcccgggtcgacccacgcgtccgattttatgctatccagtwtttacgtacccatgtgtcaacatttcatatatccagttctttgggtgctggttcactttttttcatttattcaaattcagaaaaatacggacggatctaatgttaaattaaccagaaaccctggaacattcatatcttgagagggaatttgctactcttttacttttgggatttcattataaaataggctcattttatacatatgtcctgtggtctgtcttccagagtgtgctgtaatcataagtctctagcaaagagtggagggtggagggtgtgtagaactccactcagcctcatggatacatctacaagtctctcaacccatcctgttacagttctccatgagagtcacctcacacttggaaaagaaggaggtttaaagcagagtattgttggcagccagctatgcccatcctcttgtaaataactttccaacacacccatttccttgccttaaggtgcaggttcctacttctacaaaatttcaaatgattgcaggtcaaaaacctttggagttactcacaaataataataaaatttcaaataactagggtctacttgtccatcaagatgacattaccagtggaacccacctgttaattttaaagtagcttcagaacccaacaaaaattatgtaagcctggttaaatgtccttttttcttcttgcctctaataraatcaggatcttcggccttgatactaaatatgtgtatatttagttatgatggtacttgtagatgctcacatttccagttccaaactcgcccgtactttttatgtgcttcaaaatattggacacatttctgttaatatatgatttctgtatccacaaaccgctgtttgcttatgctgagtcaatttagaagttaatttccaatctagtctcaactgcaatgcatttaaaataggtaaaacaagtaaatgagtttgggacattttgagattaatgttactgcccacttgactgtcaatttcaaatggctcctaatgcaaccaaaattataaccaatgtagcatgtgtaggaaaggtatttttaattatttaaaatcattgtgtatattacagcagtatgaggaatgcctggctaaagaggattttttaaaagatgaagaatggttttgcttgtattatataggcttactgagtttgtgagcagcataaaaacaatcattccttaattcttcattgtggaactgaaatatttctgkaatgcattttttaaaaggagactcctagacacagcygtaataggggaatagaaatgtagagcttttctcataacacaaaaccagaaaataattttcagcactttgacttactctatgtaataaggaaaaaaattgtttccacaaagttgaactatgtagtaatatttggtaacatatggcatggccactttatatcacagaatgtgtgtcaagttgcaaagcatacttgggccatagtagacactaagaattaaaactcttaaatcagtgaaacaaaaaaaaaaaaaaaaaaaagggcggccgc

SEQ ID NO: 1664 - DNA, 1233 bp, Homo sapiens
  misc_feature (491)..(491): n equals a,t,g, or c
  misc_feature (493)..(493): n equals a,t,g, or c
  misc_feature (497)..(497): n equals a,t,g, or c
gcagcgtgagccaccgtgcctggctggtttggggattttcatattgcatgtgacagaaaacctatctgtaactagctaaatagccctttcccctactgccccccaaaaggcggggtttattgtatcatctgattcagaaatctacgctgggcttggtagtttggtttcgggaacatctggattccaggtctcaaatgacatcatcgctattcatttttctctttctctggttctgccctccaccacgtatcagctttgttctgtgttggcctcagccccattctcaagttcacattcagcatgaaaaggctgatcacctcttccagtcactcaagcaaaaagccccaggtttgctgcaatgggctagaatagtttgactgtaatcacatgaccacctctaagccaatctctgtgggccaggcaccccagtggttggtttargcctggatcttgtgacacactcctgaacacatgactcgagggtggggcanangcanatcctcacacagaactggtgcgtgattccaggtggctgatcaatcacctgtgtccactgtggttgtatcaarggcgtgtgggttgtgctgtgctgggcgtacactagtgtgtgcattggccagctcggkktgccacgttattggctttgggatgctggttcccaggagtggcggtgggaagattccacctgctttctatggtaggaaggcaggtcctggggtgagggtgagccccgagggggaccagtggccactgtggcttgacccgcaggccttgacctgagcattgcaggcatagtttcctgcccctgtaactgccagatcgagacccagtgagacagtggtttccgtcgccagagactgaaatagtgtattccctgaggacccctgaagaagcttggctttgctacgagccagacgtccaggtcacaagtctggctgggacccaaggctcagtccctttataatagctgttgagttcacggagtgagtacaattatgcatccccactgaggctcaagaggtgaagtcacatagccagttagtggtagagatggggcttgaacctgggtcttcctgactcactcagctacctttccatagaaatagggactggaggccgggcgcagtggctcatgcctttaatccccagcacgttggaaggccgaagagggtggatcacttgagggcaggagttcaaacaaaaaaattaaaaaaaaaaaaaaaaagggcggcc

SEQ ID NO: 1665 - DNA, 835 bp, Homo sapiens
aaaatattttggtagtaatttaaaatacaagaacgaatatttatttgtccacagttggagatgttggataaatgtcttttctcaaagatcacaggacttttgtctttcatttttgcctttttatttaccatttataaaagatctggtctggattatggaatttaatgtttatcagctctatgtattcctttatagaggcttgaggaagtatttcacataacatgttttataatacttaaccatttatccaaagatatatttacattgggttgtgcccctttcccttagatcatggtaaatttttcttattgaggtaattatgtactacttatatttgaaggaagcttatgacattttacagtagctaaaatgttgagattagaggtacttttactattcttctcaaaggtaactgatcagataattacccaaattattcaagaaaatagatcagaaataaagaacaacataattttctaagaattcattgaaatttatggaatcagctctcgcactgcccatctttgcagttttgaaaaagaaattgcttaatcacaaatgttctacagtctttaaatgtagtagaattagacagtgagatcatctgagtaaattgattggtgattccagagataagactaatattttaaattatttatgatactgattagtataaaaacgtactcatcacagaatttgaagcaaaatacatgtacacttcaaagagtaaatgacaaatgtataaatgctgtagctcaggattatatgtacctttaaaaatacactaataaagattattgttcaaaaattaaaaaaaaaaaaaaagggcggccgc

SEQ ID NO: 1666 - DNA, 2238 bp, Homo sapiens
ccacgcgtccgtgctcggagaatgaaggcgcttctgttgctggtcttgccttggctcagtcctgctaactacattgacaatgtgggcaacctgcacttcctgtattcagaactctgtaaaggtgcctcccactacggcctgaccaaagataggaagaggcgctcacaagatggctgtccagacggctgtgcgagcctcacagccacggctccctccccagaggtttctgcagctgccaccatctccttaatgacagacgagcctggcctagacaaccctgcctacgtgtcctcggcagaggacgggcagccagcaatcagcccagtggactctggccggagcaaccgaactagggcacggccctttgagagatccactattagaagcagatcatttaaaaaaataaatcgagctttgagtgttcttcgaaggacaaagagcgggagtgcagttgccaaccatgccgaccagggcagggaaaattctgaaaacaccactgcccctgaagtctttccaaggttgtaccacctgattccagatggtgaaattaccagcatcaagatcaatcgagtagatcccagtgaaagcctctctattaggctggtgggaggtagcgaaaccccactggtccatatcattatccaacacatttatcgtgatggggtgatcgccagagacggccggctactgccaggagacatcattctaaaggtcaacgggatggacatcagcaatgtccctcacaactacgctgtgcgtctcctgcggcagccctgccaggtgctgtggctgactgtgatgcgtgaacagaagttccgcagcaggaacaatggacaggccccggatgcctacagaccccgagatgacagctttcatgtgattctcaacaaaagtagccccgaggagcagcttggaataaaactggtgcgcaaggtggatgagcctggggttttcatcttcaatgtgctggatggcggtgtggcatatcgacatggtcagcttgaggagaatgaccgtgtgttagccatcaatggacatgatcttcgatatggcagcccagaaagtgcggctcatctgattcaggccagtgaaagacgtgttcacctcgtcgtgtcccgccaggttcggcagcggagccctgacatctttcaggaagccggctggaacagcaatggcagctggtccccagggccaggggagaggagcaacactcccaagcccctccatcctacaattacttgtcatgagaaggtggtaaatatccaaaaagaccccggtgaatctctcggcatgaccgtcgcagggggagcatcacatagagaatgggatttgcctatctatgtcatcagtgttgagcccggaggagtcataagcagagatggaagaataaaaacaggtgacattttgttgaatgtggatggggtcgaactgacagaggtcagccggagtgaggcagtggcattattgaaaagaacatcatcctcgatagtactcaaagctttggaagtcaaagagtatgagccccaggaagactgcagcagcccagcagccctggactccaaccacaacatggccccacccagtgactggtccccatcctgggtcatgtggctggaattaccacggtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaataataggctaagaagttgaaacactatatttatcttgtcagtttttatatttaaagaaagaatacattgtaaaaatgtcaggaaaagtatgatcatctaatgaaagccagttacacctcagaaaatatgattccaaaaaaattaaaactactagttttttttcagtgtggaggatttctcattactctacaacattgtttatattttttctattcaataaaaagccctaaaacaacaaaaaaaaaaaaaaaaaaaaaaaaaaaaaaaaaaaaaaaaaaa

SEQ ID NO: 1667 - DNA, 955 bp, Homo sapiens
ccacgcgtccgggggactctgcaataaggcagtgaaagccctagcccagtgcctggcagctgctgtgatgatgattattattattaatgtcacccccgctccccgccacgcacacatgggctagaggggtgacttccacacccctggcttagactgtcctgcaggctgggtgttttctttgtgattcccaaggccccaagcccagtgggaaatttccgccacttccatgtgccctgccacgacttcctgccatctgctgactcggtgtgacatgacacacggctgcctctccctggccagcatggccgcggggcttgggtctgtctcactgttcttgtttgttcaacagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaaaaaaaaaaaaaaaaaaaaaaaaaaaaaaaaa

SEQ ID NO: 1668 - DNA, 1699 bp, Homo sapiens
cggaattcccgggtcgacccacgcgtssgcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcggscttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctyagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcmaaaaaaaaaaaaaaaaaaaaaaaaaaaaaaaaaaaaaaaaaaaaaaaaaaaaaaaaaaaaaaaaaaaaaaaaaaaaaaactcga

SEQ ID NO: 1669 - DNA, 2078 bp, Homo sapiens
  misc_feature (1)..(1): n equals a,t,g, or c
nctggagctctggtgtctcgaattgtgttatgagataagccactagcagggacttgaacattccattttctttagattttgttgtatcagcatgtgaatatgctgaatacaacttgtatcctaaagcatacaagctataacattttcacgttggactcaaatttcttcatcatctgtattgtatgaattttgtatactgttttgttggtggatttctaacataagattgccagttcctgctagctttttaaaaagatcctcaggttgctgtagctggatgatcacatgtcatttaatttccgatccttaaaatggagtgcgggctacctaagtttgcaggctgtctttttatgatcctgtgtttatggaattgccctgaagccatggaatgtgaggatgggtttcattgtagcagtgtgggtttgttggtttttgccagtataatttataaccaagaaataggagacttgttggataattcaaggctatattttggccagttgataaagattatatatttgtgagtaacatcttttaagttggtatatcctaaagttgaaatactctgctgtgtgttactttctcattatgtttgggctcttttcttcactgtcaatatttggattacctgaagatgatatcccaattctctgtaaacacattttagatgcttctttaagagataagaattaggtcaaactttttaacatctaaataacaatgactttgattctcaagagttaggggaggataaattgctataagcttggacaaaattctaattggatttgaaaagcagaagaaacttactattgcttggattatggagccctgtttgggagtctaacacagaacagagaaggacagaattgtgaaacactgtgctatgaattcattgattcagtagttatagtaatacttcctagaagccactgaagaagatacaaagtggggagtacaaaggttggatggaaaagaaataagcacagtgctatagaactagacagtgtcgtaagacctgtcacaagtcaatattctatgaaatgacagattctgataagtgtttctcagtttcagtgggtgtaaatcttttgtttgtgggggttggtttcctttaggagaagttaattgaactgatcctcaaaggatgaaatttaaacacctcaaagtcagcatttctccgtgttgtccagtgcctagtgaagatgaagacttttcttgccattgcttgactccaagtaaagctgtgaatgtagttgagcgattctccagacctgccagctgcagtttccctcctaccggaagacagaaagactttcagtcctcaagctgaaatgagagagccatcctaccttgaataaatgggcccattgttaattttaagctcttgagtattttcttttatattccctccaagctaccctgtcattatgccaagttagaaaattaatttagtttgtataactatatgatgtatatttcacatgtgtgttcactctgctttaaaaatattaattaccttttgtgtgaagttcagagacctgtcttttcccatgtggcagttttatatgttttgtggtcacaaatgtcaggaatctcaatgtaattctggataaatttttctgctctatgatttgtaaagaaatgaaaatcttatattttttaattgaaaattagtagttttagaaaaaaacgcacttatttgattttagtaaacgttgggcattttgaaaagttattcagagaaatgttactggtaggcaggacttttgtatctgatggaggaaaccgatgtagggtttggataaaataagactagcaggctgggcacagtggctcactcctgtagtctcagcattttgggaggacaaggtgggaggatcacttgataccaagagttcaaggttacagtgggctgtagtcatgccactgtactccagtctgtgccacagaaccagaccctgtctcaaaaaaaaaaaagaaaaaaaaaaaggtaagaatagcactttagaccttgggaaagaacgttttcatgtaactattcatctactcgtgagttaggtatatctacctactta

SEQ ID NO: 1670 - DNA, 1269 bp, Homo sapiens
cgcgtccgggcgcgcgggtgaaaggcgcattgatgcagcctgcggcggcctcggagcgcggcggagccagacgctgaccacgttcctctcctcggtctcctccgcctccagctccgcgctgcccggcagccgggagccatgcgaccccagggccccgccgcctccccgcagcggctccgcggcctcctgctgctcctgctgctgcagctgcccgcgccgtcgagcgcctctgagatccccaaggggaagcaaaaggcgcagctccggcagagggaggtggtggacctgtataatggaatgtgcttacaagggccagcaggagtgcctggtcgagacgggagccctggggccaatggcattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggcacttgttcagattacccaaaaggagatgcttctactggatggaattcagtttctcgcatcattattgaagaactaccaaaataaatgctttaattttcatttgctacctctttttttattatgccttggaatggttcacttaaatgacattttaaataagtttatgtatacatctgaatgaaaagcaaagctaaatatgtttacagaccaaagtgtgatttcacactgtttttaaatctagcattattcattttgcttcaatcaaaagtggtttcaatattttttttagttggttagaatactttcttcatagtcacattctctcaacctataatttggaatattgttgtggtcttttgttttttctcttagtatagcatttttaaaaaaatataaaagctaccaatctttgtacaatttgtaaatgttaagaattttttttatatctgttaaataaaaattatttccaaaaaaaaaaaaaaa

SEQ ID NO: 1671 - DNA, 997 bp, Homo sapiens
aattcccgggtcgacccacgcgtccgctacctggaacccttgaaggatgcaggtgatggtgttcgatacttgctcaggtggcagatgcctttgtgttccttgctgacctgcctgggcctcaacgtcttgttcctcactttgaatgagggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagagttcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgatgaggatgatgagggcgccccgtgcccagccttgtttctctaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaaaaaaaaaaaaaaaaaaaaaaaaaaaa

SEQ ID NO: 1672 - DNA, 709 bp, Homo sapiens
gaagaaaaggaagcagtaactacgaatagtgcttatacatgctggggtctgtttgcagggcccttcatgtattaacctgtttactgctctccagtaaccctgtggtgcaggcaccatgttccctcaatgaggaaagtaaatcacaaggggtgacatgtgctgtgctcccagctggggatttgaacccaggtagtctagtatcagcatgtgtgcccttaaccgtaaccctataacggttagaagagcttcagggaccttcgtcaggacatacatcttgtaaataattggtttgggagtaaaatgcatgctgagtcaccagtgaatcttctgtgttctcatgttactttgggcatatcttcatcaaaacattgcagcagtctcttacaagttttgtttgtttcctagtcatgaggactgggattctgcttttcatgtttgattactcagagtacatagtttggcatattttaggcacggtaaatattgatccaatctgattcctagttcagtggttttatgctgtaacagctttttcctcctcctttacgttgtcaagccactttctcatggtttcatcttttccttcttgctttgtttctggagcacacattttttacttttttttgattgccttctatttggttttctttaaggtggtgcatttaaaaagcagccccctcttcttcaaaaaaaaaaaaaaagggcggcc

SEQ ID NO: 1673 - DNA, 926 bp, Homo sapiens
  misc_feature (17)..(17): n equals a,t,g, or c
  misc_feature (28)..(28): n equals a,t,g, or c
  misc_feature (72)..(72): n equals a,t,g, or c
  misc_feature (102)..(102): n equals a,t,g, or c
  misc_feature (900)..(900): n equals a,t,g, or c
  misc_feature (917)..(917): n equals a,t,g, or c
  misc_feature (920)..(920): n equals a,t,g, or c
  misc_feature (923)..(923): n equals a,t,g, or c
gcagtggcgattcattnagcagctggcncgacaggtttccgactggaaagcgggcagtgagcgcagcgcaantaatgtgagttagctcactcattaggcacnccaggctttacactttatgcttccggctcgtatgttgtgtggaattgtgagcggataacaatttcacacaggaaacagctatgaccatgattacgccaagctctaatacgactcactatagggaaagctggtacgcctgcaggtaccggtccggaattcccgggtcgacccacgcgtccgggctgggggaytgcccagtgttacttgtcagrctgtgctgcccagccctgtttatctgtgtaattatttttgtaaacattgtattctctgtggtcgccacctcctcgcccccagcctcgggttcagtctgtcttccaggcctgcttgcacctcactgggctgctccggggtctctgcccctcattccaggcctggctgtcaggcccagccagcaggggcccgtgacccagcagcctgcccaaagcatttgtttctgggggatggggtgggggctgctccacaggaggtttgagcccarcaccctggggaaggggaccctgcacgacacccccttgccctccctccatgaggctaaaggcccagtcttcccaaatgtgctgccctcgttcatgtgccaaatggccccagcccacatgcccctcccytctstggartgggagccccttctgaagtgtctgaatccctgaagtgttcatttgtccgtcctctgtgcagtgacagccccggccaagccacctctaatcctctgtagcaataacggtgcgccgcccatccctgcccattgtgcaccactaggattttaaagtccatagattttaatgaaatttctattcctgncaaaaaaaaaaaaaaanggncgnccc

SEQ ID NO: 1674 - DNA, 2245 bp, Homo sapiens
  misc_feature (38)..(38): n equals a,t,g, or c
  misc_feature (2189)..(2189): n equals a,t,g, or c
  misc_feature (2213)..(2213): n equals a,t,g, or c
cccgcaagtaccggtccggaattcccgggtcgacccangggtccccgcctatttttttttttttttttaaaaccatgattttaatacgcaagctgtttctaaggcgctgccactggggagggtggctgttgccgcctgcccgggcatcctgctctggcaagcacagcctgagccattcctgcaggggtcccagggtgcagagacctccccacccccggttctgggctgggaccctggctccagggccatgtccagggctctggtgtttgcctgggttggtgcaggttgatgtgctggctgcaggcaggtgtgaccatctctcgtgcctgccacctctttgcccccaggcttttttgctgtgagggagccaccagggggtgatttaaataggtttatttcttcatttacaagaggaatatatttggcttctctcttaagactctgagattcacaatcagcagctctaaaaaataaaggagcagtttggcttccggaaggaagaggaggcaacactcggacctggttcttgtacaacaagaaaacatcgctggggccccgctgaggctggagtgggggtggaggctggtctttggaggatgccacccccaccccatcctcttgtcaggccctcggggtaccccagagcttggtgggtgagtattccacctgcttacacaccactgaagccacagccagccagtaactaaggggcaagaagagcattgtccaagctggctcttggggggtcccccattggccacaaggcctcaccccccaccccacccccgcaccagaaccaccttgattgcagcagaagtgcagggagtgggtgacgcagggggctaagctcccccaaagcgggttggggctggtgtgaagttggcagctgcatcctggtgtgtgcatggatgggaggtgggtgatcgaaggcctggcccctggggtcacttggtggaatgccagcagccagtgtttgggtaggggccgcctctcccggggcctcagcctcagctctggggcaggaagctttgtggatagctgcttcctccagcagccggagccctggctactgccccatggattctgggaatggtctcctgggccctgcccctggaaaaggctcagctcagcctcggggaaggagtggggtcctggcttggggggtggtggcagggaragaagccctgcagagttgggctggtgtgcacctgccagagaccttgagcctgggggcacaggtggtgtacagctgcagccagggccttcacccctggtgatgccagcttgtcagaacagtccccatctgggacctccaggctgggagccaacccgagacagtgagacagtgtcctccagggagtacccagagacttgggcgcccagcttcatttgccaggttgcgtccaatatccccaaggtccgaggcccagctgagcagtggtccctgcataccaggccctcgcgtgagcctcaaagccgggactgccgccctgaggcctgggccacctgctctccgtatggtccagggtctgttgagtcttcaaagctgcagatcgtgctttgcccagcaagttgtgtgggaaagtccagccccctggcccttcgttccagggagggcagggacttgcccaagatcacataagctggtggcaggccaggctctccccggacacccacttggggctgtcttcttccttggccccagggcctgcggcccaaacctagggctgggaacctgtccaaccgtgtggctccaacacacacatccttccagggtaactgaggacacagcctcttcttgatgccagggccactcagcaggcctgggccagagagggtgggtgcctagccgtggatcacacagaaagctttggggcagcccagccggtcccggacgctgtaggacacctcccagacgaggtgggagtgtgggttcttcattgtcccaatggcaccacctcaractttcacagatgcgggcggcatcgccagctggttcacctgctgctcagccctggcgcggtcgctgacgaagaagagcgcagtggcgaggaagaacatgccgcccaggaccacgacgaaagggcagagcatgagcgcgtagcccaggctcaggaactcccagagcggggagtccttagtgctctggcggatcaggtctgagatctgcgaggatttgggggtgtatngtgcaggcagagcccacctgtcgncacccagcctcccccggccagccccaccccgg

SEQ ID NO: 1675 - DNA, 1957 bp, Homo sapiens
acgcgtccggaggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtggagcgtcgggccgacctcacctacgcggagttcgtgcagcagtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagcctgcaccgtctgcacggccctggagtgtaccatccgggctggtgaggtgctgacttcccgaccgctggtggcatgctacgctcaaccttgacaccagcgtcttcatctcaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcaggcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcgataaacaaaaaaaaaaaaaaaaaaaaa

SEQ ID NO: 1676 - DNA, 946 bp, Homo sapiens
  misc_feature (5)..(5): n equals a,t,g, or c
  misc_feature (23)..(23): n equals a,t,g, or c
tcgcnactatagggaactggtcnctgcaggtccggtcggaattccgggtcgacccacgcgtccggtaaatgttttatgtgttcgcctactgatcccattcgttgcttctattgtaaatatttgtcatttgtatttattatctctgtgttttccccctaaggcataaaatggtttactgtgttcatttgaacccatttactgatctctgttgtatatttttcatgccactgctttgttttctcctcagaagtcgggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatggaaaaacaatgcttccagtggscacttcctaaggaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaaaaaaaaaaaaaaaaaaaaaaaaaaaaaaaaaagggcggcc

SEQ ID NO: 1677 - DNA, 416 bp, Homo sapiens
ggtcgacccacgcgtccgatttagacaagcaaactccagataactactctaagttcaccagtgtttatagtaactaaagcagcaacatgcataaaattgggcactgtttcatgagtttgttttctattaaaaaacacacatacgatgattgcaaaatgaaatgaaatttgtttgttttcctcttctgtctagcatggatatcagctgagggtttgttggctgtttctcattcaaatgcaatagaaccattgtcctttggttttcatctgctccaaaaaaaaaaaaaaaaaaaaaagggcggccgctctagaggatccaagcttacgtacgcgtggcatgggaacgtccatagctcttctawagtgtccaccyaaattycaattycactgggccgtcgttttaacaamgtcgtgaac

SEQ ID NO: 1678 - DNA, 604 bp, Homo sapiens
ggtttggggagtcgggtcgacagkacttgtttatggattggatgtggagagtgacgaggagaggagagttaacttcatgtctgtctggagccacgtacctgtttttttatggtgtctcaacaccccatgcacttgccacctacttgagaaaactactagaccttaaaagtgagagttttaaacaaatgaatgtttgttttgttttacatttaccgtgggaaattttaaatatatacagaaatagagtatcatagcaagcctgcattcatctgtcacccagctccaaaaattataaactcatagctaatcttgtttcacttttactcccacttctttccctccccactccactggatcattttgaagcaaattccaaatgtcacgtcgtttcattagcttctatttctaaataaggtgtctcttaaacataaccagaatacccccttttgaaaaggaaggctgggtgaggtgactcattcctctaatcccagcactttaggaagccaaggtcaggatgatcgcttgaggccaggagttcaaggccagactgagcagcatagtgagatccagtcttaaaaaaaaaaaaaaaaaaaaaagggcggcc

SEQ ID NO: 1679 - DNA, 2609 bp, Homo sapiens
  misc_feature (2597)..(2597): n equals a,t,g, or c
  misc_feature (2603)..(2603): n equals a,t,g, or c
ccacgcgtccgggatgacaggaacaggaatgctggcccatgagggctcctcagttcctcacaatcccaataagccctcagccgcccgctccaccgaagggtctgccatcttagatattgctggtctcgctgcagtgactgacaacagatacgagccactgatgctgagaaagcctgaccgcaggcgaacacaactcagacgtggagtttccgagaaggaaaactgacctgtgggttacatgggttggtcgtccaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccagataacagatttctgccaccggaaaagcagccgttcatatgaagtggatgaacttcctgtcaccgaacaagagctgcagaaattaaagaatccagatacagagcaggaattggaagtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctggcaagtttgctggaacattatcagatggcttagggaagacgatggacaatcggcatcagtcagagcgggagtacatcaggtaccatgcagccacaagtggtgaacaccttgtagccggcatccatggcctggctcatggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgaccttctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacctttctgaacagggaaaaaaaaaaaaanaaaaanaaaaaa

SEQ ID NO: 1680 - DNA, 1085 bp, Homo sapiens
  misc_feature (6)..(7): n equals a,t,g, or c
  misc_feature (10)..(10): n equals a,t,g, or c
  misc_feature (12)..(12): n equals a,t,g, or c
  misc_feature (56)..(56): n equals a,t,g, or c
  misc_feature (653)..(653): n equals a,t,g, or c
ccgggnnttngntcactatgggggggctggtacgcctgcaggtaccgggccggggntccgggtcgacccacgcgtccgcggaccgtgggtaaaaatataatagcattcggtcaagcttatcattcagccatatttgtattgtaatggtttttcattgcaagcaacagactctgactctagttatcacgaacaagaagaaaaggtcttccctctgttgggaagatgtggagaaacttaccgaattgaagagaaagccgaagaaccaggtctggaaagggacagcattcaggacacgtctggcaagaacaaaatgagtggctcttcaggattccctgctaggaatcatggccgtggcctctccagtctgacgccttatattgtgctttgtgtttttatcatgttgtcttgtgagactgactccctgtstgtctggcggtcgatacaagttatgattccaggccgggcgcggtggcttacgccagtaatcccaaagtgctgggatcgcaggcgtgagtcaccgcgcccagtgaaaactgttctcttaaaggggtgccttccctccggtggctgtcagtcccctgggaccccgcccggagtttccgctttcattccctcctgtgggaggaagtgcagtgtcaggaatcgcatcctanacgtgcggttatctgcaggctacaggatgggctgaagggaaacagggacgtcactttaagggtttgggatgggggctttgctggcaaaacttactttttgaggttctctctttggcttgtctggggttgtttttaatatgttgggattagaaatcaatgtgattccaagtgtcttgtactcagaaaattttaactgtcttggtttgctgctgctgcattctcctggcttcccarcarttaccarcttatttatatatataaatttatataaataataaatatatacatatacaagtttatatataatcaataacaaatatatatatttatatatattttyyctttttttctttttgagacaggtcttgcactccagcctggatgacagagcgaactccgtctcaaaaaaaaaaaaaaaaaaaaagggcggcc

SEQ ID NO: 1681 - DNA, 795 bp, Homo sapiens
  misc_feature (3)..(3): n equals a,t,g, or c
cgnaccatttttttttttttgaatatcatcagcttacttgactggcaagggcagaagctggggttggcctgaactctgccaaacaaatatcaaagtgtatttaatagttaaatttgtgccctttcccttcttgctgcacccatgttgtcacttaacccccaggagttatttattatctttttgttaaagtcaggctcatttggggtaatgtgatgactgtttaggtttacatgaccctcctctcctttccctacccccaaatatgtatatatacatatataaaatatgtatatattttacctatataaaatatatatatatacacatatatgtatctatattcctttgtttctttgcctgcttatactggccataaaagagggagctgccttcaatgtataaagtataagaagagtgccagggaatgccataatggaggcttttggatctgaatttggaccatttcactaaagagaacatgagtttgctcagccctttcctcacaagagggagggccccggttccccagacttctccacgcgctggctccataaaggccagctttggccrggctgccacaggggcctgaggagctcactctgggcctacctggtttcagttagagggtcctcctgttatttttccatttaaaaagtatgtcctcagaaaactgtactggaaggatgggtggcaggaacttgtatagttcagcttccaacactttggaacagattaaaaagggaatcttttaaataaaaacgtataaaaataaaaaaaaaaaaaaaaagggcggcc

SEQ ID NO: 1682 - DNA, 824 bp, Homo sapiens
  misc_feature (759)..(759): n equals a,t,g, or c
  misc_feature (791)..(792): n equals a,t,g, or c
ggtcgacccacgcgtccgagagactgggtttcactgtgttagcctggatggtctcgattttctgatcttatgattcacccacctctacctcccgaagtgctgagattatgggcgtgagcaccgtgactggcctgttttttgtttctttaacaaaaagttatggggatttctatgagtattgtgttgaatctaaatcacattcggttatataatcattgagcaatactaatttttccaatcaatatggattgtatgtgtatttatatgtttttaatcattttgatcaatgtttgtagatttcaaggtacaaacttctcacctttatatgtttattcctaaatatttcttactttaagctctttagcaaatggaagtggtttttaattttattttaaaattatttaatgttaatgtatggaaattcaactaatttttggtgctattattctattctgcaaatacactgaatatgtttattagttccagttgtattttggttgactgtgatattcttcacagatcatgtcatctacaaacaaataaaatttgacttctttctttctgaaaaaaaaaaaaaaaaaaaaaaaaaaaaaaaaaaaaaaaaaaaaaagggcggccgctctaaaggatccaagcttacgtacgcgtgcatgcgacgtcatagctctyctatagtgtcacctaaattcaattcactggccgtcgttttacaacgtcgtgactgggaaaacctggcgttacccaacttaatcgccttgnagcacatccccctttcgccagctggggttatnncgaaaaggccgcaccgatcggcccttccccaa

SEQ ID NO: 1683 - DNA, 1335 bp, Homo sapiens
  misc_feature (1287)..(1287): n equals a,t,g, or c
ggatatatccagggctgcggattttccccccttcaggtttaaatgttcctgtttttctacctttccctcgcagtatacgctcaacggcaagawagtggaagttgccgtcaaacagatcatcgctggaaaagccgtggagcaaggaggtgctttctcgaaccccgagaccctggatctgtaccgggacatccctgagctgcagggcttctgagtcagactggctggcgtgtcactcagccgcacccgtgtgcactgtaacttttgtgtgctcaagaaattatacagaaacctacagctgttgtaaaaggatgctcgcaccaagtgttctgtaggcttggggagggatcgtttctctgttttgttaaatctggtgggtacctggatcttccacacgagtgggattctggccttcagagaccaggagggagtgtctgggccgcagtgtggcactgtggtgagagtgtgtgtctttgcacacacagtgcagcgggaacggtggggctggctggtgctgaagacagacacactcctgagccaaggtcttgtcttcaacctccccgtcccgttgtcccattttgctctgtgaaggtgcaaatccctttcttcccttcccatctcaggctctcctgttttccctcagggtccagtatgcctttgagctttagctgttagaaaggaacccccgtgacttgacacagctttcacagctggctgctaggaccggcgggctgggtgttcacgtgtgtctgtgtcatggatgcaatgcaggccctggaggactgtgcgtcacccgtcaaccagagcgtgcctccgggccagcttccctccaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcattttccttttggattataaaaatatgggggaaagtgctatgatgaattttatgcaataaatgtatacatgtntgcacatgcacccatgctgaaaaaaaaaaaaaaaaaaaaaaaaaaaaa

SEQ ID NO: 1684 - DNA, 1036 bp, Homo sapiens
gcgcgtaatacgactcactsatagggcgaattggagctccaccgcggtggcggccgctctagaactagtggatcccccgggctgcaggaattcggcacgagtgaagtactgcgtggtgtatgataacaacagcagcaccctggagatactcttaaaagatgatgatgatgattcagactctgatggtgatggcaaagatcttgtgcctcaagcagccattgagtatggcaggatcctgacccgcctcacccaccaccccgtctacatcytgaaagggggctatgagcgcttctcaggcacgtaccactttctccggacccagaagatcatctggatgcctcaggaactggatgcatttcagccataccccattgaaattgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccagggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtcwmaaaaaaaaaaaaaaaaackcgagggggggcccggtacccagcttttgttccctttagtgagggttaatttgcgcgtccg

SEQ ID NO: 1685 - DNA, 1420 bp, Homo sapiens
  misc_feature (524)..(524): n equals a,t,g, or c
  misc_feature (585)..(585): n equals a,t,g, or c
  misc_feature (596)..(596): n equals a,t,g, or c
  misc_feature (1042)..(1042): n equals a,t,g, or c
  misc_feature (1062)..(1062): n equals a,t,g, or c
  misc_feature (1144)..(1144): n equals a,t,g, or c
  misc_feature (1171)..(1171): n equals a,t,g, or c
  misc_feature (1286)..(1286): n equals a,t,g, or c
  misc_feature (1350)..(1350): n equals a,t,g, or c
gtctgcatcccgggcgcggctgggttgagtgttctcttaggaatggtggagaactgggtccttgaggagtcaccggggagactgctcgcactgtttgtggtgcgacgggcactggcccagggacagagggaagagaagggccagccagcggcagtggagtcggcaggctggctgcccactcgctttctctcctcacaagactcgcttcccctgtcttcgaggatctcgaacggactatagtctggactcgctgggctggaggaaacttggccgctggccacccggaggagactgaaaatcctttggtcaacagggcgcctttccttgaaccaaaacaaaactttccgaagccggaaaggaaacgcccagtgtcgcctgagagccctggagctgcgcgagacccaggcactgagtgcggcctcggcctctgacctctaacacgccgggaacaaaccatctggggcggcccgcaggcctgcgggagcggaatgtgacccgaaaccgaccgacttcctgacccatantccatagttctcttcagcaacttgaacattttggaaaaagaaacaatcttaacatgccacnacctaatgganaaactaaatccccttcctacaccttgctttccaaaagttaaaaaaaaatagttaaacgctattagaggtctcaagttcactgtcaccagatcagctaggtccagaatcttcagttcttgaagccaagccctacaaatagatttattgtagcatatcacacctcttcaggtgacttaaaacaatgagaattcatgagaaattatcttcatcctcaagtaaaaatcatgaggtgcctttcacatggatgaaattgtaagtgcttgttgaacaaggaataattggataatggtattgtggtcatactttttaagaatatctgttagaaagatataggatgcagaacatctaggatttgctgaaagtcatttattatggatagggggtatgagtaagttcatagatgaaaagggatgaaacaagattggccatagttgctctatttttgngtatcttgtttctttatttngtttctttaaaaagtcctcatatcactgacatttacacttagttttagggaaagtcaaatttagaaataagctacagctctntaagctatcggtctaactggatttttntcgatgctgaagaactttttaaaaaattcagccatttaggtcacacagcaaatacatttggcattaaattcctagtatcactaaagtactccctcccaccgccgcgccccccccnttccccccgcacccttagacctgggcaagagagacttctatcctggactccatgctttaaaggnacttacatatcacacacacacattaatttaaaaaggaaaaaaaaaaaaaaaaaaaaaaaaaaaaaaaaaa

SEQ ID NO: 1686 - DNA, 1457 bp, Homo sapiens
ggcacgagccggacttcaaggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcactgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaaaaaaa

SEQ ID NO: 1687 - DNA, 1923 bp, Homo sapiens
ggcacgagcctaaggcacccttttcctcgtgcagcccagcctgactcctggagattgtgaatagctccatccagcctgagaaacaagccgggtggctgagccaggctgtgcacggagtcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccggaggcaactgggaggtcaacgggaagacaatcatcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacaaccagcgctgcaaaacccgaaaccgttacatctgccagtttgcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacagggtattaaattatgaatcagctgaaaaaaaaaaaaaaaaaaaaaaaaaaaaaaaaaaaaaaaaaaaaaaaaaaaaaaaaaaaaaaaaaaaaaa

SEQ ID NO: 1688 - DNA, 888 bp, Homo sapiens
  misc_feature (347)..(347): n equals a,t,g, or c
ggcacgagaactgccgtccaatctatgagctgggcccttccttccctcttctttcttcttttctctcccttccttcttccttcaggtttaactgtgattaggagatataccaataacagtaataattatttaaaaaaccacacacaccagaaaaacaaaagacagcagaaaataaccaggtattcttagagctatagatttttggtcacttgcttttatagactattttaatactcagcactagagggagggagggggagggaggagggagcaggcaggtcccaaatgcaaaagccagagaaaggcagatggggtctccggggctgggcaggggtgggagtggccantgttggcggttcttagagcagatgtgtcattgtgttcatttagagaagtgggtgaaggttcctgggatcttaggtaaagactagacgccgcctagtactggtctctactgtgctggctcaggagttctgagaactggaaggacttagcctcaacctgagttctgcacacaccccttccccttaaggaaggcagctctgagaggcagcaggacttgatccaaacccacagtcttgtcctggaggcagcaggggtgaaggtggagggtccagggccatgaggagcccccttgccatcagagcctggcctaaccaccctcttctctacttacacacacatgcattttataatagctctgacccaacctggccactctgcagagactgggacagacaggtgcaggcaatgggccctcccacacccagtcacctacaaggaattttcaaatccacttttaaaacagaaaccggtaaatgcgccgtattgtatattttatttaaataaaaaaaattccagcaaaaaaaaaaaaaaaaaaaactcgta

SEQ ID NO: 1689 - DNA, 1491 bp, Homo sapiens
  misc_feature (1425)..(1426): n equals a,t,g, or c
ggaagtgtaggtacagattcaggtcatagaaaggcccatatgtcccaatattatttytyttacagagaaaacagatgaaattracaattttttttktytttccacagaccatcaccggcctcctgcagaktttgatgtccaggcaagtagaggatgtggctttccttccccttcctcatcccgtcttctctttttcctttttctttccattggtttaagtagatcattgtgcaaacattgcgggcaaggggagagaaggcagtggtctcagctaggtcctcaccctcagctgctgctcccagacagaagctgacttgagtgctggccagagaatcaggaaccagtcacttcccacgaaagcaggacagagacaccgcctgtttcagtcccaaagagctggccagaacggtggggcgtgtgtggggaaaatggtgtgatgctgggctggcttgggaccctgtgaggggagggaacggaagcaaaagcttgatgttcttggctccacttgggaaactgaaaccagccttctctgtggtttactggcccagaactgaagtatctccattcccactcaggattgcagggtgggccagggggtgcagctcagctgtgtccaagaataggctctcaggagaacgggctgggctctctcagccgagggctgggtcagaacttcaggaaatctaagtcctggactcgttagccccaagctggggtgggtcccatgctgtgctggcctctggagggtggggcaraaagcctgagcatatggcgagcttgtggtctccttgaaggaggagaggcgcactcctggaccagccagagagccagaggtggctgacggtgttctcacctgaacsgytacccatgtgttgcacaggtgtccccagtttgggacccattctgcactctgcatctcactcctctattctacctccttacctcaaaacaactccgcttttcctcttgaatctctgatttcatgaatgctcccccatccatcccgaggcgaggaatcttgcactgtctttggaaggaaaggaaaggatgggagaggggctggaagcattggctagtagatgatcgaggctttctataccaccaccaaggtgtgtattttctcatcatcctggttgtgtcaggctgtccctagagatcaccctgacctcagtgtttaagaagaagggccagatgcagtggctcatgcctgtaatcctagcactttggaaggccgaggcaggcagatcacctgaggtcaggagctcgaggccagcctggccaacaaggagaaaccctgtctctactaaaaatacaaaaattagccaggcatggtggtaagcacctataaccccagctacttgggggctgagacaggagaattgcttgaacctgggaggcagaggttgcagtgagccgagaccacgnngttgcactccagcctgggcaacaagagtgaaactctgtctcaaaaaaaaaaaaaaaaaactcgag

SEQ ID NO: 1690 - DNA, 2633 bp, Homo sapiens
  misc_feature (526)..(526): n equals a,t,g, or c
ttctctaaaaaagcaaacaggcaaaacttcatgagaatcttgatcatgttaaaattttatgtccttcgatttctccctacacacacacacacacacacacacacacacacacacacactcaacatttcctccacccatatcatcactccttagcatctttattccatcaaaactttctaccccttgacattctctgtgcagttttgaaaattaccctctcagcattctctgttcacccccacacctagaccctgacctctagtcaattctactacccaggggtgtccacggttccagcctcctccatgaagcccagttctatgggctcactcctctgggtaagtgggagcccccagctatcatcctcattgtatagaaaaccaactctgtgatgctacctgcccctcttccccttctctcctgaaagagggctggggtagaggtgggaggactggttatggccctggccgggtctgtattcgtactgggaggagtattggtactctgtgtagaaagaaatgggganggggaaatggggtggcctcagcatctccctaagtcccagctttaagtcctcctgttgcagttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctgctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagataggggtctttcatctgggggtgcctgtggaggccttgttcttcgtcgggaaccagctcattgctacaagccacacagggcgcatcggggtgtggaatgccgtcaccaagcactggcaggtccaggaggtgcagcccatcaccagttatgacgcggcaggctccttcctcctcctgggctgcaacaacggctccatttactacgtggatgtgcagaagttccccttgcgcatgaaagacaacgacctccttgtcagcgagctctatcgggacccagcggaggatggggtcaccgccctcagtgtctacctcacccccaagaccagtgacagtgggaactggatcgagatcgcctatggcaccagctcagggggcgtgcgggtcatcgtgcagcacccgragactgtgggctcggggcytcagctcttccagaccttcactgtgcaccgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggcccctacggtgagcgggacgaccagcaagtgttcatccagaaggtggtgcccagtgccagccagctcttcgtgcgtctctcatctactgggcagcgggtgtgctccgtgcgctccgtggacggctcacccacgacrgccttcacagtgctggagtgcgagggctcccggcggctcggctctcggccccggcgctacctgctcactggccaggccaacggcagcttggccatgtgggacctaaccaccgccatggacggcctcggccaggcccctgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcascctccccaataaagtcctcactgccaaaaaaaaaaaaaaaaaattcgatatcaagcttatcgataccgtcgacctcgag

SEQ ID NO: 1691 - DNA, 1941 bp, Homo sapiens
  misc_feature (561)..(561): n equals a,t,g, or c
  misc_feature (1414)..(1414): n equals a,t,g, or c
  misc_feature (1422)..(1422): n equals a,t,g, or c
  misc_feature (1427)..(1427): n equals a,t,g, or c
cttcagctgaagcccagggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaaytagtgtggacatgatgcggcgggctgcccgcgcgctgcttgccttggccaaggtggacgagaaccactcagagtttactctgtacgaatcacggctgttggacatctcggtatcaccgttgatgaactcaktggtttcacaagtcatttgtgatgtactgtttttgnattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcgnctacgtcnawcgntgtgtatatatatgacgtkgtacattgcacatacccttggatccccacagttkggtcctcctcccagctacccctttatagtatgacgagttaacaagttggtgacctgcacaaagcgagacacagctatttaatctcttgcccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaagactttaaaaaaaaaa

SEQ ID NO: 1692 - DNA, 1183 bp, Homo sapiens
  misc_feature (1053)..(1053): n equals a,t,g, or c
ggcagagcctcaagctgacttggattatgtggtccctcaaatctaccgacacatgcaggaggagttccggggccggttagagaggaccaaatctcagggtcccctgactgtggctgcttatcakwyggggagtgtctactcagctgctatggtcacagccctcaccctgttggccttcccacttctgctgttgcatgcggagcgcatcagccttgtgttcctgcttctgtttctgcagagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgctggagaacagtgtagcctggcctgtacaggtactggatgatctgcaagacaggctcagccatactcttactatcatgcagccaggggccgctgacatctangacttcattattcwatrattcaggaccacagtggagtatgatccctaactcctgatttggatgcatctgagggacaagggggkcggtstccgaagtggaataaaataggcgggcgtggtgacttgcacct

SEQ ID NO: 1693 - DNA, 1326 bp, Homo sapiens
  misc_feature (352)..(352): n equals a,t,g, or c
  misc_feature (1324)..(1324): n equals a,t,g, or c
ggcacgagtgcaggcccagagaggactcattgaaaggactgaaaggggaggtggcgttttcttcctacccaaacttacccctgtgagctggacagcttggtagcacctgcctggacttagatggtggtagccaagaagactgacattttagggaacaggacggggaggagaaggctctggcacacacacatgtgtccatatgtcctgcaatggtctggggactattgctaggctaggagccctaagtgtcttcttcctcatgtctmttctcccctgtstcatgggccctaagrtctctttcactgggcctgcctcaatgaacgtgctgcccagctaccccgaaacacggcanctgccggctatcaatgccccagctgcaatggcccatcttcccccaaccaacctggctgggcccgtgggctccgcactgagararaaasttggcacartcaactgggcccgggcaggactgggccyccctctgatcgatgaagktggtgarcccagagcccgagcccctcaacacgtctgacttctctgactggtctagttttaatgccagcagtacccctggaccagaggaggtagacagcgcctctgctgccccagccttctacagccgagccccccggcccccagcttccccaggccggcccgagcagcacacagtgatccacatgggcaatcctgagcccttgactcacgcccctaggaaggtgtatgatacgcgggatgatgaccggacaccaggcctccatggagactgtgacgatgacaagtaccgacgtcggccggccttgggttggctggcccggctgctaaggagccgggctgggtctcggaagcgrccgctgaccctgctccagcgggcggggctgctgctactcttgggactgctgggcttcctggccctccttgccctcatgtctcgcctaggccgggccgcagctgacagcgatcccaacctggacccactcatgaaccctcacatccgcgtgggcccctcctgagcccccttgcttgtggctaggccagcctaggatgtgggttctgtggaggagaggcggggtaatggggaggctgagggcacctcttcactgcccctctccctcaagcctaagacactaagaccccagacccaaagccaagtccaccagagtggctgcaggccaggcctggagtccccgtgggtcaagcatttgtcttgacttgctttcctcccgggtytccagcctccgacccctcgccccatgaaggagctggcaggtggaaataaacaacaactttattaaaaaaaaaaaaaaaaaaaaaaaaaaaaaaaaanaa

SEQ ID NO: 1694 - DNA, 881 bp, Homo sapiens
ggcacgagattttgctccggagcgtccagagtcctggccctgagcgggaatcgcagtggccgaggctgagcggcaggcggatcgccccgaccctcactcctggcgtctgagtctctggcgtagcccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgctagagcttcgcaacgagagcggtggccacgcggtcccgcctggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggaggaccaggatccgaatgggctgggtgagcacgaattaccgaggccttccctttgatacagtccaggatttgtaagggatgaagacccctgggccccattctgttggggtccatacatactctccgaagatagcaacttgcttcaggtcaaagtgaacccgagaaaagagaagaatcactcactactgctcttgccctggactattcaggaagggcagcccggatgttccatgttaaatcgtgacagaattgcaccagacctgatgagttggaaacaatcctatacattaaaagaaattacactatgaaaaaaaaaaaaaaaaaaaa

SEQ ID NO: 1695 - DNA, 751 bp, Homo sapiens
ctcgcctccttgctgcacgatggcctcgctccgggtggagcgcgccggcggcccgcgtctccctaggacccgagtcgggcggccggcagcgctccgcctcctcctcctgctgggcgctgtcctgaatccccacgaggccctggctcagcctcttcccaccacaggcacaccagggtcagaaggggggacggtgaagaactatgagacagctgtccaattttgctggaatcattataaggatcaaatggatcctatcgaaaaggattggtgcgactgggccatgattagcaggccttatagcaccctgcgagattgcctggagcactttgcagagttgtttgacctgggcttccccaatcccttggcagagaggatcatctttgagactcaccagatccactttgccaactgctccctggtgcagcccaccttctctgaccccccagaggatgtactcctggccatgatcatagcccccatctgcctcatccccttcctcatcactcttgtagtatggaggagtaaagacagtgaggcccaggcctagggggccacgagcttctcaacaaccatgttactccacttccccacccccaccaggcctccctcctcccctcctactcccttttctcactctcatccccaccacagatccctggattgctgggaatggaagccaggtggggtcatggcacaagttctgtaatcttcaaaataaaactttttttttgtaaaaaaaaaaaaaaaaaaa

SEQ ID NO: 1696 - DNA, 647 bp, Homo sapiens
ggcacgaggtttgatatatttttttctcatctttttgctgttacttatatgtaactatctttaacaagtttgagatcttgttatatattttcatttgttgctttataaccatttctctatattactaagtttaattaaggtctggaatttttttagatggtgtatcatgggtataatatttatttagttgttttcctcttgttatatttagattgaggcagtgctacaggctttaactagagaggtggttggctgttcaggactgggaggtggaggactagcaggaacagaggtatagcaggagagcatgcctactatgggtataggggcagtaaggagagcagctgaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaaaaaaaaaaaaactcga

SEQ ID NO: 1697 - DNA, 928 bp, Homo sapiens
gaattcggcacgagggcgcctcttcagcttcctgtaccagagcagccctgaccaggttatagatgtggctcccgagcttctgcgtatctgcagcctcattctggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttgaacaagaaa

SEQ ID NO: 1698 - DNA, 2293 bp, Homo sapiens
ggcacgagatgcgctcgggccatggcgcgcctgggcgctgtgcgctcccactactgcgccctgctgctggccgcggcgctggccgtctgcgccttctactacctcggctcaggccgggagaccttctccagcgccaccaagaggctgaaggaggcccgcgccggggctcccgccgcgccctcgccgcccgcgctggagctagcgcggggctccgtggcgccagcccccggcgcgaaggccaagagcttggagggcggcggtgccgggccggtggactaccacctgctgatgatgttcaccaaggcggagcacaatgccgcgctgcaggccaaggcccgcgtcgcgctgcgctcactgctgcgcctcgccaagttcgaggcgcacgaggtgcttaaccttcacttcgtgagcgaggaggccagccgcgaggtggccaagggcctgctgcgggagctcctgccgcccgccgctggcttcaagtgcaaggtcatcttccacgatgttgctgtgctgacggataagctcttccccatcgtggaggccatgcagaagcacttcagtgctggcttgggaacctactacagtgactccatcttcttcctctcggtcgccatgcatcagatcatgcccaaagagatcctgcagatcattcagctggacctagacctgaagtttaagaccaacatccgggagttgtttgaggaatttgacagtttcctgccaggcgccatcatcggcatagcccgggagatgcagccagtttacaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaa

SEQ ID NO: 1699 - DNA, 840 bp, Homo sapiens
gtcctaatggctcctctcctcccatccctccctcttcacctccacacctccctctgtctccgcctgtgtctctctctgtctctctcagcctggctctcttggtctcttcctctctgcgtctcactctctgcctcctaccctgcgtggcggcttctcccccagctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaaaaaaaaaaaaaaaaaaaaaaaaaaaaaaaaaaaaaaaaaaaaaaaaaaaaa

SEQ ID NO: 1700 - DNA, 1482 bp, Homo sapiens
ggcacgagcatggtctggaagaaactgggctcccgcaacttctccagctgccccagtggctccatccagtggatatgggatgtgttgggtgaatgtgcccaggacggctgggacgaggccagcgtgggcctgggcttgatctccattctctgctttgctgcatctaccttcccccagttcatcaaagcctacaagacgggcaacatggaccaggcgctgtccctgtggttcctcctgggctggattggcggagactcctgcaacctcatcggctccttccttgctgaccagctgcccctgcagacctacacggctgtgtattatgtcttggcagacctggtgatgctgacgctgtacttttactacaagttcaggacgcgcccctctctgttgtctgcccccatcaactccgtgctgttgttcctcatggggatggcgtgcgccacaccgctgctgagtgctgctgggcccgtggctgcccctagggaagccttccgggggcgggcgctcctgtccgtggagtcgggcagcaagcccttcacccggcaggaagtcattggcttcgtcatcggctccatctccagcgtgttgtacctgctttcccggctgcctcagatccgcaccaacttcctccggaagtccacccaggggatctcctactctctgttcgcgctggtgatgctggggaacacgctgtatgggctgagcgtgctgctcaaaaaccccgaggagggccagagcgagggcagctacctgctgcaccacctgccctggcttgtgggcagcctgggcgtgctgctgctcgacaccatcatctccatccagttcctggtgtacaggcgcagcaccgccgcctcggagcttgagcccctcctccccagctgaccagaaccaggctgagcgcaggaggacaggcaccaccggatgccacaccaggcaggaggaggtgtggacagtgatggtacggcggccctgcatcagcctgcgggtggcctctggatcctccgtggaccgaaccgtccccccaggaacacaccttcaggtagaccccgaagcctcaaggccggggctggagcggagaccccagggcctctcaggagacagtgaggctgcccctcctaccacctacctcattctgcctactcaggactgtcctgtcaactccagacaactgaataaacaggccgggtacagtggctcgcacctgtaatcctagcactttgggaggccgaagcgggtggaccacttgacgtccgtagttcgagaccagcctggccaacatggtgaaaccccatctctactaaaaatacaaaaattagccaggtgtggtggcacacatctgtagtcccagctacttgggaggctgaggcaggagaactgtttgaacctgggagacagaggttgcggtgaaccgagatcgtgccactgtactccagcctgggtgacagagtgagactccgtctcaaaaaaaaaaaaaaaaaa

SEQ ID NO: 1701 - DNA, 2472 bp, Homo sapiens
gaattcggcacgagcaagctctacgactcgctgctcgccctggacggtcacatccaatcagcgcgggccctgatggtggtggccgtgctcctgggcttcgtggccatggtcctcagcgtagttggcatgaagtgtacgcgggtgggagacagcaaccccattgccaagggccgtgttgccatcgccgggggagccctcttcatcctggcaggcctctgcactttgactgctgtctcgtggtatgccaccctggtgacccaggagttcttcaacccaagcacacctgtcaatgccaggtatgaatttggcccagccctgttcgtgggctgggcctcagctggcctggccgtgctgggcggctccttcctctgctgcacatgcccggagccagagagacccaacagcagcccacagccctatcggcctggaccctctgctgctgcccgagagtacgtctgagctccgcctgccctggccagccccccacccagtggcccccttgcccagcatccagccagcctcgcagcaccctgggcagggccactggggcataggatgggcataggtgctctgagcagcttgtcctcaacacaagcacccaccctgcaatctgagacccagatcctcagagagacaccagaggcaggacccagcccccaggcatacacacagatgcaggtccaggcacggtcttgtctgcacagcctggtgggcaccagcatgcatccctggagacaggccctcaggcaccagcccggctgtttactcactgaagagctgcgtgggtgtctgctacgtgctgggccctagagatagagcagtggccaagacgtaccttagtacccaggtccttggggtgagcagaaaccttcaccctccccagtcccatgggctcctcacagcaaccccacaagggcagtgccgggatgctgaacgttcacacaaggacagggagggtctgagtttaggtctcaggttcttccagtgcgcccagggctgggggccacctacacagatggtgaggtcggaccatggcgcccctgcccccgggaatgggccccaggcagggctgctgtgagggccaaggtctggccacgctggccagtacccatgtccgggcctgaatgcacagcccctgcccccgaccccacagcatccagctgaggtccaaggtctttgtcctagaatcagagtggggaggggacagcctggggctgcccagagactgtgggtggagctgcctgctgcactcagcagtgcggtcagagaagggcttttggtcttgaagtccaggtaccatccccccttagcatacagggggaagggcctgagaggaatgtaaggaaaccagcccagatcagtcccaaggccagagtcctttgtcctacatctccctgaaccagagtgtgccctgcccctcatgctcagacctctcccaccccaaaccctctcccgggactcagtctccctggccactgcgtatcaggcttctggggaaagcatccatcacagaacctccccttccctgccacgcaccttccttggccagctccattctggcctcctccaccacctgccttgtgaccacatctcccaccacgtccccagatctcaagaacgcagctcagcttctccttcgagcttgactctgagagggaaagtgacggaaaccaagtcagatgagatgactgccatgtacactgcagtcaagggcagggaggggaggaatgacacaaatggcagggagctgctgggggactgacccctcggcgcctggcctggccggtgctgcacatccaccggggcacaacagggacttgtccagcctctggtcagaggatgtggccacctgaccctaaataggttccccagagtcctgcccctctaatgaatgagaactgcaggagtttctcctctgggtgcctgaagctatagtgcaatggttcccaaccctgcatgcacattcgaatcacctgggggcacaatgcctaggctccaaccccagacactcttatttcattggtctgggtggacctggcatcagaagtcatgtagctcctcaggggactgtagtgtgtggtcagcactgagggctcctctatgaggcctcaagcccaggtgactctgtgaggtctgcagagggagaaaagaacccacaagggaagaggtggaggtcaggcacggtggctcacgcttgtaatcccagcactttgggaggccgaggtgggtagatacctgaagtcaggagttcgagactagcctggccaatatggtaaaaccccgtgtctattaaaaatacaaaaattagctggctgtggtggtgggcacctgtaatcccagctactcgggaggctgaggcaggagaatcgcttgaactcgggaggtggaggttgcagtcagccaagatcgtgccactgcacaccatcctggatgacagagcaagactccatcacaaaaaaaaaaaaaaaaaaa

SEQ ID NO: 1702 - DNA, 669 bp, Homo sapiens
ggcacgaggaaacaaagaaacaaaccgtatatatatatcttcagagttaaaaaatggtgagaacaagagcattgttttatatattttttcaactctctttaacttctggcttaatagaagacagctgcattctcattattatttatttatttttttttagatggtgtctcgctctgtcacccatgctggagtgcagtggcgtgaccttagctcactgcaaccaccacctactcgggaggctgaggcaggagaatcgcttgaacctaggaggcggagattgcagtgagctgagattgcaccattgcactctagcctgcgtaacgagcaaaactctgtcacacacacacacaaaataataacaataataataataaaacattgccgggcacagtggctcatgcctgtaatcccagcactttgggaggctgaggctggtggatcgcgaggtcaggagttcgagaccagcctggccaaggtggtgaaaccccatctctactaaaaatacaaaaattagccaagcgtggtggcacacgcctgtattcctagctacttgggaggctgaggtaggagaatcgcttgaactttggaggcagaggttgcggtgagccaagatcatgccattgcactccagcctgggcaacaagagccaaactccatctcaaaaaaaaa

SEQ ID NO: 1703 - DNA, 1680 bp, Homo sapiens
  misc_feature (1673)..(1674): n equals a,t,g, or c
  misc_feature (1680)..(1680): n equals a,t,g, or c
cgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagaaatacccgcagcccaaaggggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggaaaaaaaaaaaaaaaaaaaaaaaaaaaaaaaaaaaaaaaaaaaaagggggnncccccn

SEQ ID NO: 1704 - DNA, 1710 bp, Homo sapiens
  misc_feature (1702)..(1702): n equals a,t,g, or c
  misc_feature (1704)..(1704): n equals a,t,g, or c
  misc_feature (1709)..(1710): n equals a,t,g, or c
ccaggaattccggggtcgacccacgcgtccggaaacatttcccatgtcctaagttcttagaagcaattactttagcgttggggagcattgttctaccagacccatttatgcaggggagatgaagcttaaaagacgggatgtggggtgggagtgtgtttcttaagccgaagctgttgcaggctgggggatttttgcattttctttttgttttgtttttgactgcagattctgtacatctgtctgtgggaggagagttgctactcaggacaggatttaagagacacattccagtgacctttaagaatctgcatggcgggaggtccttctccaggagtgtgggttggtccactctgggacccaccacactaagaagggggagatgataaaataacattaaaggaagaatggcctccagcctgcaggttttgttggaaagaaataaaaagggagtcattaagaccataaattcagattgaggcctcttgaaaaggttgatgtgggctagcaacctgcctgtcgaaacagtccttggttcatcagcagtgtgggaaggcagccaaggctcctgcagattcctggcatcgaccttggaaagcctctgcgatacttgtgtgtacgaatacagcagaggacagggaggtccttgttctgtggtctctgtttagtgactgaaacttaaacccaaaggcaagcccagattgtctggccgttcatccccatgctttgataggggttaggaggaaccctttccgtatgaaagacaggccctaytagggyttacaaccaagccaaaggaccatctcttctttcttccacctcccttcamccctgccccgcagcagagccgagatgtgagacattcattgtcacggagcaaggagacaaaggcaagttcaagttgagaagcatatggcagcaaacagaaatgaaaaccatatgtcccagcaaggggaaaagcagtcatttccagattataaaaatcaatgaagtactctccacctaggtcagctgaaattcgagccctcacagtcaggcctgtcagagaagttaagcagaaacatctcggggggacttctaaaatttagtgaagacaaggccttgcaactccaaagaaactttttttcccccccttgaaacagggtcttgctctgttgcccagcctggagtgcagtggtgcagtcacggctcactgcagcctcaagctcctgggctcaagcactatccccacctcaacctccttagtagctgggactacaggtgcacaccaccatgcccagctaaccacagaaactttcatctcttcattttttctttgggcaccattaatacctaagacaggtagaaagggtcccagaaagacaccattggtaatggccgattgccggctgcagtcatcgcccccagatcaggctggtacaggatgccttaaggtgatgagaggtgagggtgcatgaagaataatgagcacagggaagagagaagcaggacaaagtagcagataaaatgccggcaaagcacagatgaatgtcttcaagaagctcttgtatttctctgcacagtgtaaatatccttgctatttcaggatggcggctggcctgctcagtaacatacatgttccaaataaagattttgcatgaaagtaaaaaaaaaaaaaaagggcggccgctctagaggatccaagcttacgtacgcgtgcatgcgncngtcann

SEQ ID NO: 1705 - DNA, 441 bp, Homo sapiens
gggggcatgtgatttttagtatggacttaagagctccatggcttgggttcaaattccacttctgccgttcactagctgtgtgaccttgggcaagtaccttaacctctctgtgccacatttttctcatttgcacaaggagaataatagtttactacttcatagggttgtgatgagtctgacaatgagtcattatgtgtaaaatgtttttcacagtgcctgacacagaatgctatagtagatcaacatttgctgtaactattactatttgttattagtgcaattgctgtattttgtttaatgagaggaagtttaataacactaggattaaaacattccttctggtcatgtcttcctgacaagtaaaaaagttgctacttgttttccttggctaatcattgaaaaaaaaaaaacaaaaaacaaaaaaaaaaaaaaagggcggcc

SEQ ID NO: 1706 - DNA, 794 bp, Homo sapiens
acccacgcgtccgcgcggctcatgcccccagtatcccggtccagctattccgaggacatcgtgggctctcggagaaggcgacgcagctcctcggggagcccaccatccccgcagagcagatgttcctcttgggatggctgttcccgctctcactcccgcggccgtgagggccacaggcctccttggagtgagttggacgtgggcgctctttacccctttagtcgctctgggtcgcgagggcggctcccaagattccgcaactacgccttcgcgtcctcctggtcgacctcgtatagtggatatcgctaccatcgtcactgctatgcagaagaacggcagtcagcggaagactacgagaaggaagagagccatcggcagaggaggctgaaggagagagagaggattggggaattgggagcgcctgaagtgtgggggccgtctccaaagttccctcagctagattctgacgaacataccccagttgaggatgaagaagaggtaacgcatcagaaaagcagcagttcagattccaactcggaagaacataggaaaaagaagaccagtcgttcaagaaacaagaaaaaaagaaagaataagtcgtctaaaagaaagcataggaaatattctgatagtgacagtaactcagagtctgacacaaattctgactctgatgatgataaaaagagagttaaagccaagaagaaaaagaagaaaaagaaacacaaaacaaaaaaaaaaaaaaaaagggcggccgctctagaggatccaagcttacgtacgcgtgcatgcgacgt

SEQ ID NO: 1707 - DNA, 938 bp, Homo sapiens
ccacgcgtccgctgccagcagcgcgcagagggagggatgggggcgggtatcggcgtagggccctcggaaagaacggatattgctgtgacaccgcggggacgctctgaaggggcgagtgtcggtgtggcaccggtgcacgctgaaggagccggcggaaccgggtggccatggggatgtgggcatcgctggacgctttgtgggagatgccggccgagaagcgtatcttcggggccgtgctgctcttttcctggacagtgtatctttgggagaccttcctagcacagcggcagagaaggatatataaaacaacaactcatgtaccaccggagttaggacagatcatggattctgaaacatttgagaaatctcgactctatcaactggataaaagcactttcagcttctggtcaggactctattcagagactgaaggcactcttaatcttctctttggaggaataccttatctctggagactttctggacggttctgtggttatgctggctttggaccagaatatgagatcactcagtccctggtgtttctgctgttggctacacttttcagtgcattgactggtgtgccatggagtctttataatacttttgtgataaaaaaaacatggcttcaatcaacagactttggggttcttcacatggaaatataataaaaataaaaatctagtttaatactgcattatttattttcctaaggctaaagaggagcagtcctatgcttttattcagcatcctttatctgtgacttcatgctctgataactgcctttccttccttctgtgcctttgaatacaaatttcagttctgcaaaagtgaaacattaaacattgccaacgcaaattaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1708 - DNA, 3172 bp, Homo sapiens
  misc_feature (148)..(148): n equals a,t,g, or c
  misc_feature (1013)..(1013): n equals a,t,g, or c
agcttcccgggtgaggctgggacccggcaccagggcagtactgtggccgctgcggcttcatctgccgactgggtcaggttgcggagactccaggccgcttccagggmgagtactcctgaattgtgaacatcacattcatcccctgggncgatggagcttgtcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagntggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttatacctgagccacacatctccctgcccttctggcactgaagggccttggggtagtttgctcagcctttcaggtgggaaacccagatttcctccctttgccatattcccctaaaatgtctataaattatcagtctgggtgggaaagcccccacctccatccattttcctgcttagggtccctggttccagttattttcagaaagcacaaagagattcaatttccctggaggatcaggacagaggaaggaatctctaatcgtccctctcctccaaaaccagggaatcagagcagtcaggcctgttgactctaagcagcagacatcctgaagaaatggtaagggtggagccaaatctctagaaataagtagtgaggccgttaattggccatcactgatggcccttagggaaagactggacctctgtgccaagcagtatccctgttcagcccaccttaaaggtgtaggcacccactgggtctaccagtatgcaggttgggatactgaaaatttccagatgagctcttctttcctacaagttttcataattagggaatgccagggtttagggtaggggttaatctgttgggggttgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgcccccccccctcttttttttaagaatggcctgatcatggctatctcagccacattgttggcaatttaatttatttacttccttttttttttttaagaaaggaaaaaagaaaaaaaaatcaaacttgaaacttttcttttgakgttcctattgtgggggttctggatagggtgggacagggatgggggtgtgttttatattttttccttttcagcacaacctttggctttaatataggaagagccaagggagtcctcggctgaacttacgatatctgccccaaacctctgtaaccccaactgaaatgaggagcttcctctcttcctgtgaaggatatgacagtccagcatcgatgcctgtgccctctggaaaaatttcctcctagcccttccagggccttatcataaaactctggatttagagtattcattttgaaggcaactcccccttccccaagtttccttggagctgtatagctgggttctaagcttcaccatgcaaatcagaaattttatctctaagtacaggctgtgccgtgtctcacccacacccccctggggacttcagttccatttcaggttacctggggtataccttgatccctagagtgactggcagagtaagagaaggggagagataataggtgtgattattttaatatggaggtgggagtgtggttggagatagaaaggctcctccccascatgtaatggcttckctcagaatttkattccaggctagcttgctsmaggtctgggtagttggatcatgcgtcactggaattggggggaagcttgaggaagtaggtccagtctggaaatggctccgaatttaaagctgatactagctggtacgaatcttcctccgttccgagtgcgtacaggcataagctgtcgtcccaggggccgggagcgtaagtccgcctgtcgagcctcaggagcgggttgtggtcagggtgtgggaaacaggtgtgcgtcctagaagaattggggctcttgggtatggcggggtaaggagattgccaagtgaccctcggttaagccctcctggtggcgccgggggtgggcccgaccttcctagggtcaaggcgctccccttcgg

SEQ ID NO: 1709 - DNA, 718 bp, Homo sapiens
acgccacctgggcggacagccaggagctctccatggccaggctgcctgtgtgcatgttccctgtctggtgcccctttgcccgcctcctgcaaacctcacagggtccccacacaacagtgccctccagaagcagcccctcggaggcagaggaaggaaaatggggatggctggggctctctccatcctccttttctccttgccttcgcatggctggccttcccctccaaaacctccattcccctgctgccagcccctttgccatagcctgattttggggaggaggaaggggcgatttgagggagaaggggagaaagcttatggctgggtctggtttcttcccttcccagagggtcttactgttccagggtggccccagggcaggcaggggccacactatgcctgcgccctggtaaaggtgacccctgccatttaccagcagccctggcatgttcctgccccacaggaatagaatggagggagctccagaaactttccatcccaaaggcagtctccgtggttgaagcagactggatttttgctctgcccctgaccccttgtccctctttgagggaggggagctatgctaggactccaacctcagggactcgggtggcctgcgctagcttcttttgatactgaaaacttttaaggtgggagggtggcaagggatgtgcttaataaatcaattccaagcctcaaaaaaaaaaaaaaaaaaaaa

SEQ ID NO: 1710 - DNA, 2474 bp, Homo sapiens
cccaggcggctgcccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgcttcagcacttggccccattgtagattgccctgtgcagtaaactttcaaggtgtcagctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaaaaaaaaaaaaaaaaaaaaacaaaaaatttcatttttgagtccagaggaccctcctattactcttgatttcatcttcagagtgtagttaaaaaattattttaaataattatttttttaaatcagttgtaggttcacagcaaaagtggacaaaaagaaatttctcatatatcccctgccctcacacatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaataggttcactggcctaaaacctccccaaggcttaacctggttcatccctttcttccctaatcccctggggaaccacttt

SEQ ID NO: 1711 - DNA, 510 bp, Homo sapiens
  misc_feature (2)..(2): n equals a,t,g, or c
gnacccccgggctgcaggaattcggcmcgagaaatgaggcttcagcctgacatctgtaacctccccaccaaccctctgagtctgaagttgggcttgatgctgttatcactgaccctttgtttggagaaaacagtccaaggtttgaaattgggtctatgtttattcaaactaagcttctctgagcacatggtctgtcccactcatcctcagagtatccgttggttttacttcatgttcagactgcagtgttgttaaagaaataaagctacagtgttttcagaaggatttgttatattatacttcatgttcccactgctccaggctaagcgtctcctctgggctccattgtttaatgcaggacaaagccaggttttctggcagcttccttttcatagcaattctcagtagaggtatagaatgagacctgcctaccttcttgggtgtttattaccccatttgtggattttactttaacttctgttaccttaaaaaaaaaaaaaaaaaactcga

SEQ ID NO: 1712 - DNA, 1018 bp, Homo sapiens
  misc_feature (1014)..(1015): n equals a,t,g, or c
ggtgcccccgggggcacggcgctggggaggcgatggcgccggccgcgtccaggctgcgggccgaagccgggctcggggcgctgccgcggcgggcgctcgcccagtacttgctcttcctgcggctctacccggtgctcaccaaggcggccaccagtggcattttgtcagcacttgggaacttcctggcccagatgattgagaagaagcggaaaaaagaaaactctagaagtctggatgtcggtgggcctctgagatatgccgtttacgggttcttcttcacagggccgctgagtcacttcttctacttcttcatggaacattggatccctcctgaggtccccctggcagggctcaggaggcttctcctggaccgcctcgtctttgcaccggccttcctcatgttgttcttcctcatcatgaactttctggaggggaaagacgcctcagccttcgccgccaagatgagggggggcttctggccggcgctgaggatgaactggcgggtgtggacgccactacagttcatcaacatcaactacgtccctctgaagttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaaaaaggcagtcrctgccttcaggtggtgctgccccagaaacttaaaatttagtcgaggcagtttcaattgttactgtggaccgaattaggatcacaataaacgataatgcaggttcttcaaaaaaaaaaaaaaaaaaaaaaaaaaaaaaaaaaaaaaaaaaaaaaaaaaaaaaactcgagggggggcccgtacccaatcgccctgatgatgatctgnncac

SEQ ID NO: 1713 - DNA, 766 bp, Homo sapiens
ggcacgagcttttgctctcatttgccttcacagaggccactccacctgtccggatccagctgtctggtcatggtttggtttatttattttgtccttcaggggctgttttgccctaagaatgagggggcttcccctggtctgcagttcccaactttatcccttgctggccatgcgagcccagccctggtgcctcatgggatgggggggtaggggtccccaggatcttctggaggaaggtgggcatggatggatgggctgtatctgtgttttccctctgggagtctcatgggtccagcatcaggcctgaggtcagcaacagggaaagagggtgggcacggggagggcttggccccgcctatctagaggcttgcctcgggcccctccttggggaaggtttgcgtgcagagctgcaagggagagggttccagaagcattgccttttgcctcgtctaataggatccttaggacactgtgggctttaggaatgactatagatgctcacacgtgtttaaagtgacatttggagatgctctcagtcctgtggcatctggcacgaagtctccaagaagccactttgcctcttctcccttcaagcacaagctttactgcaaaagggccagtcgcgtttctatttctctcgatcccaggcttctgcggaccgacgatacgtttaaatgttgttctagtaaatattcttgaatgtattaaaatggctgaaacaacaaaaaaaaaaaaaaaaaaaaaaaaaaaaaaaaaaaaaaaaaaa

SEQ ID NO: 1714 - DNA, 1377 bp, Homo sapiens
ggcacgaggtccagtcctgattccatcttcttacaagttagggagctgggtccaggcctggatccatgttattatgaatcaggaagttgggtccaggcctggctccatgttcctgcaggtcagggcaggtcttcccccgagtgatggctcttggactgtgctcctctggggccctctcaactctgtgtctgtcatctgtcacctgcctggccattatggttttgatggcagtggatgggctccatgggacttcaggcctggggtgagactcaggaccctggggtgggcatggatggggatattggacccctgaaagaagggaagctgagagacttttttcctttaaagacttttccatgttatctccactcagagaattcttttctgcaaagtcacgggagggaggtgacattgagccctccaatgtgacagaaactgtgctgggaactttacatgtgttacctaatttgtttaattatcccagcaactccacaaagtaggcatttttattgttgaggaaacagaagcttagagactttgtgagacttgcccgagaccccaggtcacacaccagcaaggatgaggtcaagcttttaatccaggtctgcctggctccaagtccacaccctttcacaacaatgaactttctttatgattgcagatattatttggggaactttacatcaaacattgactacataaaacttcaaccatagactatattctttgttttggaaactgtgaagactcaaattttttataaactcagaacagcttccagttttctctagatatcggaagatgggctgtgttttttgtctgttgtccagtgaggctgatttgtagtcagacaggtgagtcagtttggttggagtaggctattgtggttctctctcatcaggaaagaggggatgcacttggcccctcaactccaagttggtggtgcgatgatttttccatattctcccttaacaggctgtgagggagtctgggccaggcactaggccatgagcagggcagactggggtaaacccttagcgagcctctctccagccacgaggaaacctggagtgtgtgcgtgcctgtgtgctgctggtgtgtgtgtgtgaatgcacacgtgtgtgcatgcactgtgagctggtgtgtgcatgtgcactggtgtgtgcgtttgtgtgtgtgtgtgtgtgtgcatgtgtgtgctgggtgcacacatgcatatgtctctgtgtatacatgtgtatgtgtgccagtgggtgcatgtgtttgtacagtgtgcgtgtgtgtgtgtgtttgtgcacatgagctgctgcacacatataagccttgtgaattaggggaagaagaaaggctccggcttacaaaaaaaaaaaaaaaaaa

SEQ ID NO: 1715 - DNA, 1148 bp, Homo sapiens
  misc_feature (887)..(887): n equals a,t,g, or c
gaattcggcacgagctgaatcttaaactaccagtggggaaagctgaaaagcagcctaatttacattgcagatgcaaagcctcagaaattggtggaaattgaaaataaggatgaacgtgggatgaaaagagaagatatgattatacatcttccctttaagagaaaattgaaggtttattctctgcagagtcaaagacagtgtctctggactagaaaaccctaggtgcacaactgtctggtggtgctgaattgaaaaatgaggaaaaaaagttttcatgctgaatattataactctcttctactgctcctatttctcccagaaaacaatgacagtaggcaggatataggaagagtcatctttggggaatcagaccagcctaagagcaaatatctaaaggtattaatattggagatcccaaggaaatggcttagccagacgtactaaaaggaagaccatatttgacaagcttcacacacgtttgcaaattccaatcaattttttagtgttcacttatacatatgaacagatggcaaaggatgaccaggcatttgaggatgaaaacattatgaaatatgggaatgtgcacaaacaagaaaagtgggttcgagtaagtagaatttatatagagagaacatttcaaaaaactgttaaagagtatcctcmaagagataagagaaggtgttactttcatgaataaaggcagtaaactacttgaaaagaaagaacgaaaaaaaatgagttcttggaaaataagaatatagtagttgaaatgaaaaatttagttttaaaaagatgataaaatagargcmaactcccagaaagtwkagcagaaagacmaagaatwgaaaatttgaaagaaaagaaaggggtcatgttcaggaggcccnatatccaaataataggaaattcagaaagagagaacagaaaaaagtagaggatagcaaatcctcgaacagtattttctagaactaaattgatgagttttcagttgacaggcctctcaagagctcaatacagtggataaaaatattcccataccagcaggtatcattactaaaatgcagtgctgcaaacagtggaagattctgcaagcttcctgagaaaaaaaattaaagcttcctgaggaaaaaaaaaaaaaaaaaactcga

SEQ ID NO: 1716 - DNA, 1180 bp, Homo sapiens
gtctgcctagagattctgactgggtcgtagggggaacaggtctgctgtacccatggacagccactcatctctgagttgactttgctgaggtgcatgtgtgctgatagggtgagaggggcaagctcgccttctgaatggctacactcctccaggtcatgcctgcttcctgtccagggccagggggtggtaatcagggactgttgctgttttttgtttgtttgtttgtttgtttgtttttaacagcttggggttctcgaaggacactgaaggctgaattttgctgtcccaaagggtggacagcaatgatccctaagtgacccctctctagatttccctctgggaaggcagggcctctaccccacagagaccaccccatccccccaggaccagctcctcacctgcttgcctggatgcttcttcccaggaggaccatgcttataatgaccaccacagctgccagggcaaggatggaatgattccagggagatgctggggaaggacacacaggacagagccctgaggaatggccaggcacctctcaagcccgctaacagctggggcctgggctcagacccagcttacagcatcaactgtcctttgcgtggagaccctaatcaaagatgggccccttgccctggggcactcccagtctaacaggtgggagggtggaagacagtctctactctggagaagccctaatctaatggaggagacagtactgcagttaaataatagtggggcaacaggggtgaagggcagaggcctacggagggcaggagacaggtgggccaagataaacttcacaatcttcagttttgccagcctgggctggacctgcggagcacaaggaaaagaaagaaggctgggctcagtggctcacgcctataatcccagcactttgggaagccgagtcaggtggatcacctgaggtcgggagttcaagaccagcctggccaacatggtgaagtgctgtctctactagaaatacaaaaattagctgggtgtggtggcatacgctgtaatcccagctactcaggagactgaggcatgagaatcacttgaatccaggaggcagagcttgcagtgagccaagattgcaccactgcactccagcctgggcaacagagtgaccctgcctcaaaaaaaaaggcaaaaaaaaaaaaaaaaaaaaaaaaaaaaa

SEQ ID NO: 1717 - DNA, 2656 bp, Homo sapiens
  misc_feature (2652)..(2652): n equals a,t,g, or c
gatgagtgcctagaagctgcaatgattgaaggagaaattgagtctttacattcagagaattcaggaaaatcaggccaagagcattggtttactgaattaccacctgtgttaacatttgaattgtcaagatttgaatttaatcaggcattgggaagaccagaaaaaattcacaacaaattagaatttccccaagttttatatttggacagatacatgcacagaaacagagaaataacaagaattaagagggaagagatcaagagactgaaagattacctcacggtattacaacaaaggctagaaagatatttaagctatggttccggtcccaaacgattccccttggtagatgttcttcagtatgcattggaatttgcctcaagtaaacctgtttgcacttctcctgttgacgatattgacgctagttccccacctagtggttccataccatcacagacattaccaagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagagatttgcaggaaagcatatccagaatccatcgaacaattgaattaatgtactctgacaaatctatgatacaagttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaagaggagtttaataaagaaactgggcagccccttgttggtatagaaacattaccaccggatttgagagattttgttgaggaagacaaccaacgatttgaaaaagaactagaagaatgggatgcacaacttgcccagaaagctttgcaggaaaagcttttagcgtctcagaaattgagagagtcagagacttctgtgacaacagcacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtgtcacaacataatgaaagttgctcaagccaaactggaaatgataaaacctgaagaagtaaacttggaggaatatgaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaatgtttgctaaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaaccacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataacygcaaargacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctaaaaaaaaaaaaaaaaaaaaaaaaaaaaaaaaaaaaaactcgagggggggcncaaa

SEQ ID NO: 1718 - DNA, 950 bp, Homo sapiens
ggcacgaggttaccagcctgtttaattacagcagacttcccacttttctcccacttagtatttccaatttgctgcttcctgaaacctaggaagaattgaaaattgtctagagaataagcatgccagatttgttaaatcagcgaccttattttatatatatttctaagtcatggccatgggcatagaagcttcttttttaattaagaaggaaaaataaaaatatgtgaaaagaaagccataaaggtcattttacacacatgtaactccatgcacgaatgccagtccttccccttgtgtgtgcacttgagactagttctactactatccttcaaaacccaagtgcatgaattccatgaagtttttccccattattctcattttaattttccttctctgaacaactatgacattaatttattacttaatcatgaattatggcatacaactccctaattgatgtttgtgggtttttttctcccccagctagattttaatttccttgaagacagaagccatgctcttactgtgctagaatatctgtctcccgtagctcctgacacagtgctctgtgtatagagggtgcttgttggctcaccaatttgttctttacaccaaatgcccagggaaatcttacatagagtttataccaggcaagaaaaggatatgctagattctccagctgccaaagactggaatgtcactggtatccagtcaccacaatctctaggtccctcattttgttcttggtgagaaaggagcactaaggagatttcgtccttgaaaaggcagaaagcaagtgtagtatcatcttgccatctagcttggaaattaacacttgatcctaaattaggtaatcttcccttcacatctcagagttttccaggcaacagacactcagtacgaacaacaacaacaacaacaacaaaaataccaaaaaaaaaaaaaaaaaa

SEQ ID NO: 1719 - DNA, 1268 bp, Homo sapiens
  misc_feature (2)..(2): n equals a,t,g, or c
  misc_feature (15)..(15): n equals a,t,g, or c
  misc_feature (23)..(23): n equals a,t,g, or c
  misc_feature (368)..(368): n equals a,t,g, or c
  misc_feature (479)..(479): n equals a,t,g, or c
gnaggaccgctctanaatatggntcccccggcgcagattcgcacgagcaataatgcgggtccaccttccataccatcttgcaaccaattatcagaaagagaaggcctgagcagggggatgtgcattttgctttctttcggcgtacatctcatgctagatttttatctgggggcctttgaagagccagccggcacagaagcatggtggcaacgctgtgcctggaaaactcatcagtgtcactctggtttattttcctctcctctttgagctctttcccatggtgtggggctctcagtgacaactggccaagcggcggggcggttgctcgttgtcattctggtaggcgctggtttccggagggctccgantgcttgtgatatcgcattgtttctgagagcgggagcacgttggcactggtcccatttcggatgaagaaactgaggctctggggattaagatcgtgaactgtggggatggangaggcayagctggagtgaattgggtgtccagggttctgtttcgtctcacagaggatgtgcgagggtgtatgtgtgcatttgagaatgtgtgaggttgtgtgtgtttaagaaaatgagaatgaggctgggcacagtggctcatgcctgtaatcccaacactttgagaggctgagctgggtggatgacttgagcccaggagttcaagaccagactggggaacatggtgatgaaaccctgtctctacaaaaaaatacaaaaaattagcagggcatggcaatccatgcctgtagtcccagctacttgggargctgargtgggargattgcttgaacccaggagataaaggctgcagtgagccatgatcgcaccactgcactccagcctgggcaacagagtgagaccctgtctccaaaaaaagaaagaaagaaaataaaaaggagagaggttagaaaagggggctgggcgcggtgctcacgcctgtaatcccagcactttgggaggccgaggcgggcggatcacgaggtcaggagatcgagaccatcctggctaacacggtgaaaccccgtctctactaaaaaaaaatacaaaaaattagccgggcgtggtagcgggcgcctgtagtcccagctactcgggaggctgaggcaggagaatggcgtgagcccgggaggcggagcttgcagtgagccgagatcgcgccactgcactccagcctgggcgacagagcaagactccgtctcaaaaaaaaaaaaaaaaaaaaaaaaaaaaaaaaaaaaaaaaaaactcgta

SEQ ID NO: 1720 - DNA, 1355 bp, Homo sapiens
  misc_feature (7)..(7): n equals a,t,g, or c
  misc_feature (12)..(12): n equals a,t,g, or c
  misc_feature (111)..(111): n equals a,t,g, or c
  misc_feature (113)..(113): n equals a,t,g, or c
  misc_feature (1332)..(1332): n equals a,t,g, or c
ggaattngtgancgattacaatttcaccacaggaaaccagctatgaccatgattacgcaaagctcgaaattaaccctcactaaagggaacmaaagctggactccaccscgntngcggccsctctagaactagtggatcccccgsgctkcaggaattcggcacgagatttgccgccctgtcttttcctgggttggggggtggcatctgatggtggcagagtgcctgttggttcgcccgtgggtctcatggttcagacagagggaggtggacggcagggatcagggagccaggagcgcgcctcagacttgcagcaaccattgtgatttgggttgttcggaatatttaaattactgatcagaagatgaaagtagcttttctcttgggaagtcttgcagcccgtgggagtgataccaggagcaacacagagctcagcagcggcgccaaggtgttccctgtttcctcagcacgtgagccttcaccgcctgcttcattcaggagccagtgcagcagtaatacagtctatacattgttctgttttcaaatttatcctgaggctttgttgagcataaatgattatacgataaaggtatccgttattttggaactcatttcagttgggatctcctgtatgcagagtgttgcatttagaggtttgagtcccatcttggtttcttgccgtgctgactgtagccttcaccttgacttgaatgaaggtctgtggttggaatgtgtgaggagccgctgaggtgttcaggaggtgctgcctggaggtcggtttcttcctgggtgttacgggcaactgctcacacagttgtttctctgtgaacatttccagtgtttaatccaaaatgaaaacccaccaatgcttttgctaacttcagtgccttttataaatcatttttaaatttcctgaacttgctttttgaggatatacagggatattaagtagacgcaggattgtttttgtttgtaaaaattctgaattgaaactttgttttaaaaaaaggcttctttctttcatatgacaagagataggtcaggaatattggaatcaagatttaaatgttaaaattcgattttgttacacagggtgtgttcatttgttttgtagcagacaagatctagatcccagacagaaacaacacatgctattctaaaaagccgcattttaaaaggcaccttggttctcaaaagaaatcagaatatggatattcgtagtgatgatctgttttctctaaaatcttaccatattgtctgtatatggttgtaaattcaaatggaaagtaaaacgttttggccctgawaaaaaaaaaaaaaaaaaaaaaaaaaatnactgcggtccgtcaagggaattc

SEQ ID NO: 1721 - DNA, 1262 bp, Homo sapiens
  misc_feature (12)..(12): n equals a,t,g, or c
atcctgcagttnttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcacttatttcatttcctccccatacaaatttgatgagcaggtacacactttctttaaaacattccaagtgtatatagattcagtgcttatttctcagctttttctttcttaagttcatctctgtcacctagcttttatttttaatactcaatttctgaggcttaggaaatacttgttaccttaagcgtttttttgttttttttttgttgttgttttgtttttttttagtgtatttgctattgatactttgctattgatacctttacttgccaagatttatttaaagttggccaagataccaagaaggtggcttgcaggggcatctttggcttctcataattttaaacagtcattgctttcaagatcatcctaaacaagaattaatagagagaaaaaaatctataaagcatgtgttgaaaatcctcaggctcatgataacttacgggataacaatagtaggtaacaccgagtgcttacaattcagtgggcacggtcaaagtgctttttgtaagttctatttaatacttgcgacaaccctgagatagtaagtattattattgttctcattttatagatgagaaagctaacacatagggaaattaggtaactttccccagataactcagtaaacagtggagctggaattcaaacatgtacggtctgacttcttgagcccatactcaataatcatgccatcctgcctttccatggaataactgatggatggttagaaatgttaaaaacaaagcaaatgcaaacatctctgcttctgctcctctactaagcccagttaacttttgattttatatgtactaagtatacatttttattaatttatgtgagctgagtgtttttattaattactttttggctattaatgtcaattattttggtgatcaatcctagttatccaaggagtcacatcactcgtaaaaattacaagaaaaatctctaagtccctctcaccctccctctaaccagattgcatcccaagcttctatagaaactctggtaccactcgtgcc

SEQ ID NO: 1722 - DNA, 577 bp, Homo sapiens
tagtggatcccccgggctgcaggaattcggcacgaggctgcacgaggttgttgagaggatcaagtaagataatgaatgaaagtgtctatgacgacagtactagttcttacacaccatccctccacattttgggatgtctgttgctgctcttccttggggtggaaagagcactggagcccttctctggtctttgtgcttctttacatgatgtgagacctatagtaaaccccttaacctccttcagcctcatttattagagagagagagaaaaaaaaaggtgattttaaaaaaatctgttttcggccaggtgcagtggctcatgcctgtaatcccagcactttgggaggccgaggcaggtggatcacctgaggtcaggagttcgagaccagtctggctaacatggtgaaaccctgtcactactaaaaatacmaaaaaatcagctactcgggaggctgaggcaggagaatcctatgaaaacgggaggcagaggttgcagtgagccgagatcgtgccattgcactctagcctgggcaatgagcaaaactttgtctcaaaaaaaaaaaaaaaaaaactcgta

SEQ ID NO: 1723 - DNA, 752 bp, Homo sapiens
attgaaggatgatgttaattttgtattatagtgttatatatgtaactacctgtccctaaatataacactgtatgtatcatttcaacatacttgccagctctactgattatgaatattaatcacagataaggaaattgtaaaatatccttttctcaaaaggcagacacatttatagccctgtgatcctgactgacacagtatgaagagctttcctagtacatatttcaaaagttctagcttccagaataccaaataccagactggtgttataagtgttctgatttcttatgaaatagagtatgctgctttctatcatttgtcttgtaagatcactcttccatcatctgtgagcagraattgtttcatttctgaayccttagtggcctcacagtgcctggacacataaaggtactcaatgtttgctgaaggaaaaataagttacagtattagccaggtgtggtggctcacactgtaatcccagcatttgggaggccraggcgggcggatcacgagktcaggagattgagaccatcctggctaatgcggtgaaaccccgtctctactgaagatacaaaaaaattagcctggcgtggtggcgggtgcctgtagtcccagctacttgggaggctgaagcgggagaatggcatgaacccaggaggcagagcttgcagtgagtcgagattacgccgctgcaatccagcctgggcgacagagtgaagactctgtctcaaaaaaaaaaaaaaaaaactcga

SEQ ID NO: 1724 - DNA, 2460 bp, Homo sapiens
actgcaggaattcggcacaggaggcatagggctgcgtgtgaggagtggtccattgcatgggcttcctccagtttggctttggatttttgagctctctgaatttgttgtttgtgtcctttgcacagtgtccctcccaggttgcacccatgcctgcccctcagggtcccccactcccagtgaatttcacaccatgcagcatgtactttaagccatacatcttacgtatgttccagacatttggtaaaacgccgtttatgtgtttttcagtgactcacaaacattttatttacgtagatgaggaatgtactcaggcacccttcgtgataccttgccctcagcaggcactcaacagcaataataactttcattccttttgtgcttctcttaacagttcgtgtttagtaggagcacagtagctgtttggggaacgaccttaagtgaatagatgtctgaaatgctgtgtgaagtggggcgcttaataggtggtgagatggttttagaaccagggttttccctctttgcttcttgactccttaaccagttttcattaggagacccctttggaggtttgcagtcagtcagagttgagtgcctactgagtgtactgaattatgaaatgagcacagttcccattaacctgaattttttgctcccaagtaagtcttgatttctgatttatgactgctttttgttgtaccccaatagtcgtctaagaaaggtgattattttgagaggcctggggagacacacatgctcattctcgagggtggcggtggtgcagagggcagagccatgctcgttcttgctatcctgagattggttgctatctgtttcctttgctgctgtgtttttttctgtcagtattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagaggagtcctgccaagcccagaagttgtgctcttggccttgcgtgctcatctcggaggcggcagcaacacttcgctttggcttgaatttcagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttgggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctcaaaaaaaaaaaaaaaaaaaaaaaactcgagggggggccc

SEQ ID NO: 1725 - DNA, 867 bp, Homo sapiens
  misc_feature (862)..(862): n equals a,t,g, or c
ggcacgagctctctgccattggccctgtgtctatcatgaggggagagctaagaaagaaattctcctaggaagagctcatggcccagtacatcctagtaattattttaattagtttttgttctgacagcttgtcaggaagggcacagaatgggacagagataaaccagacagtcattttgatctgctctctacggtttttcaagtcagaggcaattgatgcttgtctaatgcatccacacactgcatgtctgactggcgatgccacgctcctaagtagttctgccatgaaacataaaagacaaaggaaaagccgttacacatcacacagagaacattttcgggtcccacagcggtggtggcaggaagctcactctcgcgtcagtattagagtgtgtgtgtgggtctcggggatctcggtggctcccatcttccttcattgttctgaacatcctgtattgtaaaccatggctggggtgctaaagtgcctgtgaatcccgatgtggaaaaagctggaggtgaaagctcagcataccatgtatttactttaaaaacagaaaaaaagacatgtatggatatgtctattttttttttattggcacattgtatttttgtgttgacttgtttttagaaatgatgtgtccacacacgtacccgtgtctcttctgcatttctgtgtcatggttctgtttcttaatcacgtgcggcggtgtctaagtggtgttaccagtgtacgcgcagtgaccttggatgacagtggctctttctcacagcctcccctgagctgtgagaaacagctttctctgtacatatgcaactcctaataaaaggcatatttcttcctgttaaaaaaaaaaaaaaaaanaaaaa

SEQ ID NO: 1726 - DNA, 2394 bp, Homo sapiens
  misc_feature (1049)..(1049): n equals a,t,g, or c
  misc_feature (2392)..(2392): n equals a,t,g, or c
gggatttcaatggaggagatggtgttgaaggcgagttggaagaaagcacgaagttaaaaatgttccgcaggcttgcctctgtggcctctaagctcaaggagttcattggcaacatgatcaccactgctgggaaagtcgttgttaccatcttactgggctcctcgggcatgatgttgccgtctttgacatcatctgtgtatttttttgtatttttgggtctgtgcacctggtggtcctggtgccggacgttcgacccattgctgttcagctgtctctgtgttctgctggctattttcactgctggacatttgattggactttatttataccagttccaattctttcaagaggcagttccacccaatgactactatgcaagctttggccagagtgaagaattcttctactctactgggactgagctaatcataccgtgaaggttactgcaggcccatcacaacaaaacctataaacaagcctactaggataaagctgatgcaagtaacttaacttcctgccagtataaaactcaacactttttaaatgacaacaaaatcgagacactcgataatgtagaaataacaatgttcagcatccggatgaaaatttttagacatgtgaaaaagcaagagaaaactcaagcaatgaaaatcaaactataagtgaaacctccttaaaacagctttttaaaatattttcaagattacagaaaatggacataatgaaaacaggaatggaatttataaaagagaattgatggacaaaaagaacaaatgaaactgaggagctacaaaaataccatagctataataatctactgaatgagcttaagagcaaattaaataccacagaagaaaagatagatgaacttgaggatagaatgataamtcctacccaaattgaagcacaagaagaaaagaaattgaggaagaaaaaaaaaaaaccactgaaccacataagctataggacagcttcaaaaggtctaacagaagtataactggagaaagatgtgggcatagacaaatgtatattaagaaataacagccaantgtttcccaaatttgttgaaaaatataaacaccctgtccaagaagtttaacaaactccaatctaaacaaacaaaaagaaagtcccacaaaaacmcaatataattaaaaaatttgaatatcagtgatagagaaaaatatttaaaacagtcaaataaaaagacmcattatgtgcaagggaacagtggtaagaattatcacactcttctcaccagaaatgaatgccattcaaaaagcaataggataacattattaaagttgcttctcaaagggaaaaaaactatgaacctataattctgtatctgagaatgtaggtagaagaaatgaaggtcaaataaagatattatcagatacgaaagactgagagaattttgcaccagcagacctgcactacacaaatattagaggatgctcttcagacttaaggaaaatgatttcaggtagaagcttagctctacaaattacaagctcttgaaatgagattcaccttttttctatctctgtatgaagttttgtgaagatattatgtcttcatgtaagaagctgcagcagtttcttgcgaccgtgagagaacaagcatgaaggtgaacaccgatgatgcattgagaacaacattgagaaaacacctgtgtaattgtgcattgaattagctaacctggaactgctcatctttggatttttttgttaagtgacatgttcgacattgatagagcagtcagcattaaaatctgatcaaagaaacaggcagtttcacatccttcatagctgagtctttggaatacattggtatgcttatatcttcagcattattctttccattgattaataactgtaatctaaaatctttaattcttttttatttttgaatagatattcattagaataatgaaagagaaaatgtacactttaagaatttcttctacttaacgtttttaaagattgcctctttatccaaaaaacagtataccatttataaatatttaactgtatatcatacaaatgcctccagttttatccaaatccactgttaaattacccatgtaattattccagtagaaatcattatacctttttattgttaatttcatcaatgctttactgtaaagagtctaggtgtacttaaatgcagttctcagagttcttcttatgacaattaaatggaacatttccatattattttggtgggggacgatgtgtatatttactgtttaaagtgtaacaaaaaattattagccactaacaatatagataaaaaataaatggccaatagacttaaaaaaaaaaaaaaaaaaactcgagggggggcccggtacccaattcgccctataggagtcgtagtacattcnag

SEQ ID NO: 1727 - DNA, 1379 bp, Homo sapiens
  misc_feature (665)..(665): n equals a,t,g, or c
ggctcgctcctggggctcggcgggctggacgccgagtgcggccggcccctcttcgccacctactcgggcctctggaggaagtgctacttcctgggcatcgaccgggacatcgacaccctcatcctgaaaggtattgcgcagcgatgcacggccatcaagtaccacttttctcagcccatccgcttgcgaaacattccttttaatttaaccaagaccatacagcaagatgagtggcacctgcttcatttaagaagaatcactgctggcttcctcggcatggccgtagccgtccttctctgcggctgcattgtggccacagtcagtttcttctgggaggagagcttgacccagcacgtggctggactcctgttcctcatgacagggatattttgcaccatttccctctgtacttatgccgccagtatctcgtatgatttgaaccggctcccaaagctaatttatagcctgcctgctgatgtggaacatggttacagctggtccatcttttgcgcctggtgcagtttaggctttattgtggcagctggaggtctctgcatcgcttatccgtttattagccggaccaagattgcacagctaaagtctggcagagactccacggtatgactgtcctcactgggcctgtccacagtgcgagcgactcctgnaggggaacagcgcggagttcaggagtccaagcacaaagcggtcttttacattccaacctgttgcctgccagccctttctggattactgatagaaaatcatgcaaaacctcccaacctttctaaggacaagactactgtggattcaagtgctttaatgactatttatgcgttgactgtgagaatagggagcagtgccatgggacatttctaggtgtagagaaagaagaaactgcaatggaaaaatttgtatgatttccatttatttcagaaagtttgtatgtaacaattacccgagagtcatttctacttgcaaaaggattcgtaacaaagcgagtataattttcttgtcattgtatcatgcttgttaaattttaatgcagcatcttcagaacttgtcctgatggtgtcttattgtgtcagcaccaaatatttgtgcattatttgtggacgttccttgtcacaggaagattcttcttctgttgccttattgtttttttttttttaagtctcttctctgtctttgtactggaatcgaaatcataagataaacagatcaaacgtgcttaagagctaactcgtgacactatgcagtattgtttgaagacctgttgttcaacctctgtctctttatgttaactggatttctgcattaaatgactgcccccttgttaaaaaaaaaaaaaaaaaaaaaaaaaaaaaaaaaaaaaactcgta

SEQ ID NO: 1728 - DNA, 1108 bp, Homo sapiens
  misc_feature (1088)..(1088): n equals a,t,g, or c
ctacactatagccctcagaaggacgacttttttctcttttagcaagatggcagttatagccagaggacagctcaggttggtgctttgctgggatttagttaatatgatgatgtatacatattttatattcagctctttacagtgaatgtaaaacaaatgtaatttaagggattagtaatatatacttgtacagtcattattgagtcttagccatttatactctgtcagagaaaatctgcctttgctgttcgtgtgtacctagaatgaaaacaattacttagaatgaaaccattttcttctccttttcaataggttttatttcgtctcaatttcctggtagtggtgttatgtatagtaatggatcgaccttatcaattctattactttgtccccttggtcactgtatggttcatggtcatatatgttactttagcactatggccacaaataatccaaaaaaaagcaaacggaaattgtttctggcattttggcttactgttgaaactaggctttttgctgttattcatatgttttttggcatattctcagggtgcatttgagaagatcttttctctttggccattgtccaagtgttttgaactgaaagggaatgtatatgaatggtggttcagatggaggttagaccgttatgtagttttccacggaatgctgtttgcttttatttatctggctttgcagaarcgtcaaatactttctgaaggaaagggtgaacctcttttttcaaacaaaatttcaaattttctgktgkttatttcagtagtttctttcttgacctattccatctgggctagcagttgtaaaaacaaagcagagtgcaatgaactccatccgtctgkttctgkggtacagawtttagccttcatcctaataagaaacatccctggatatgcccgtcagtttacagttcattttttgcttggtttggaaaaatttcattagagctatttatttgccagtatcacatatggctggcagcggacacaaggggtatcttggtactgatacctgggaaaccctatgctcaacatcattgtcagcactttcatatttgtttgtgtggcacatgnaatttctcagatcactaatg

SEQ ID NO: 1729 - DNA, 465 bp, Homo sapiens
  misc_feature (446)..(446): n equals a,t,g, or c
gattttttcccatcgtggaacagagtcttgccaacttatacctctctctgagccttagtctcctcgtttgtaaaatgagagttaaaatctacctcatggaatcattgctaagattaagcaagatatataagtagagcttgtgcacatggtaggtacttggagaatgttatttctccttccctcttactcatctggacaagtttaactagaattctaaacagttaaatatgtatcaatcctttgtattaaatatcttggtggtaaaatgttaaaatattgatgtgaataacagctggtattgaatattcaaattaggggaactctttcattgttttaagataacatctgtacatttaatctgtgccatgcaataaaacagcttttcctgaaaaaaaaaaaaaaaaaaaaaaaaaaaaaaactcgagggggggsccggtacccaattngccctatagtgagtcgtat

SEQ ID NO: 1730 - DNA, 1269 bp, Homo sapiens
gaattcggcacgagarataacgagatgctactagtctgggtaccagctgtacgaggaagcatacagctaagtaggtcagtgattaccaatcagtgtggtgagtacatgaaacagcaggcaaggtttgggacagccctgtttgaaatttggaagtgaaaatcatggtgcacaaagccatccttgctctgcttccctggggattctctgctgatgaattactggcttccctaatgatgtktcttacagagaagtatcagaactgcagttctaccacagacatastgaatcaacaactcaggagcttgggccagaactttatgtttcaacaaaatctccagttgattctgatgtagcctaaagtttaagaaccacattgctatagagcataaattatttgagggtagtgctcacggattatttaaactgatatttctagtgtccagtgcttgacctaaagtaagaattccagacatgtttatgaaagagtgaagagggtcaaagattttgcttttgaaccttttgagtttctgtatgactcctttgggtcatctaggaagatgggattatgaagctgtcagggtccatatwacaacsaaaagtaaatgtccaggaaagacctgtgactgaaaaagtcatgctattcacccttcaagtcccactccaagtcatacctgctttgcagatctttctaacttaaaccccgkgtcctatgatcctcctgtctgcgtccattctttattatttaagtgaccatatcctaactgaatattgaccatcattactcatttttataccttcaacagctggcacactttttagaatagtgttaatgcagaacaaatctttcctcattaataaggatttgtggcatacctatgttaatgttgaattaaatcagtgttgaaattattagcaaagctattcctatcagacttagtcctgaagacaagccaggtcttggtaattttacaccttacattattttcaaacagatcagggtacagtccargagccaggttttattgggcaccttccttctcttttaacattattgtttgttctctccctgctgtctcttgaccagggaaatgtcttcaatatcatttattttgagatcttgctcgaaactgtcattggagatgttagctgttaatgaatgcaaaaagttgataagttttagctttctttttttgatatgttggctttagaaagtcaaaattctaagactaaaagaccttcaagagagaaattaataaaaaaaaactcgta

SEQ ID NO: 1731 - DNA, 811 bp, Homo sapiens
gaattcggcacgaggagcttccatcttttctgatgtgagtggtgtcaggaatgactatggtggtggtagtggcagtggcgatggttttctggaggctgaaaggttaaagtcccaatgcagaagtgatgtcagggctagtgggtggcggtagcaggtgcagtaaagtcaggttcagatgcttcaatggtgactcccttctcgtgttagtcctacagcatcatttcagactttgttcttggtgcttagctccaagcctcttcctcctgctgtcctgtcaggttgtgtccactatgatggagcaagaccctgtcatctatgatgatgatgacgacttgcctaattatttttctgtttaagctagccatagtggatcctgttatttgtgcctaagagctcttactgacaaagaacgtgttaccggaagtgggatgctacaagtaacaacactaaaagtagaattgactaagtgcagcaggcaggcctttgagcaaggaggggacacacattacaggctggaaagctggtgactcttgtaatgcagtggcaaaattttgcttcaactactatatacaatacttgaagatgcacactgcaagctgagtgaggctgtgataagaggggaaatagtggggagcattcagaatgttggtttacattgatgacttcttgctctttcagcagtcttgatagagcagctatacccacaccagagtcctccagctgacaagagaggtaaggagagaaactgctttgccaggaggggccctctgctgcagctggaggtccaagttgaccgagagcccaaattttg

SEQ ID NO: 1732 - DNA, 789 bp, Homo sapiens
ggcacgagcctccttccagaagttccagggttttctttgatggttgccattctgcttagagaacttccattagcctttcttttggtggggtcttctggtgacaaattctgtttcacttcctctgagaatgttttgctttccttttcattcctgaaggacatttttgctggatataagaattctgggttaatggttcttttcattgtttaaaaaatattttgtactttcagctgggctccatggtttctgatgagaaattcgctgtcatttgacttgttaatgcacgatagttaaggcagtttttgtttagtggcttttgaaatgttttgtcttttgttttttggagtttgattattgtatgtcttagtttggatttctttgggttcatcctgtttagggtttgcttacctaagatctgtagatttatgtctcttgccaaatttgggaacttttaagccatcattcgtagagtacagtttcaaccccaccttctttctcctgtcccttcgtgagttcagtgactggagttgttatagtcccataggtccccaagactggttttttttttttttttttttttttttgctgggacatttctttctctcttcccttcccatcccgtcccatccagtcccgtcccgtcccatcccttcctgtcccttcccatcccttcccgtcccttcccatcttcggagtctctccctgtttcccaggctggagtgcaatggacgttctcggctcactgcaaccgccgcctccctagttcgaatgattcttctgtctcagcct

SEQ ID NO: 1733 - DNA, 560 bp, Homo sapiens
gaattcggcacgagttggcacatgatgcaaaatgcatttctcagagtagattgcagtcaaaaatgttggaaactactaagcatgtgcaratagcatgcatgctgctgctgacctgccagatatttctcccttcctccctttctccctcatttattcattcattaactgattcattcatcccattaaaaaaattatatgtatgttttgtgcaaagcaccctactcaaggctgcggggtacaaaagtatatcagaagccttgggctttgacmwacttctctgtagtagtgctagatttgtgtggatctgccacacttactccaggcctcttgtgacctgtgctttgcattaatctcttaggctaagccacataccttttcattatacaatctttgctgatgctaaggacagattccaaagtgccctccttataatttttgtatttaatgcaaagtgtaatcaagaataggccattgttaggtcaattgcttttctgtatttatcttttcaaacaataaataatcagtgggatgaaaaagggccggaaaaaaaaaaaaaaaaa

SEQ ID NO: 1734 - DNA, 1002 bp, Homo sapiens
  misc_feature (19)..(19): n equals a,t,g, or c
  misc_feature (29)..(29): n equals a,t,g, or c
  misc_feature (948)..(948): n equals a,t,g, or c
  misc_feature (955)..(955): n equals a,t,g, or c
  misc_feature (969)..(969): n equals a,t,g, or c
  misc_feature (973)..(973): n equals a,t,g, or c
  misc_feature (990)..(990): n equals a,t,g, or c
tgcccttccctgccctgtntccgccgttnttcccccacccccgccccatagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgcaaaaaaaaaaaaaaaaaaaactcgagggggggccggtacccaattcgccctatagtgagtcgtattacaattcatggccgtcgtnttacaangtcgtgactggggnaaancctggcgttacccaatnaatcgcttgcag

SEQ ID NO: 1735 - DNA, 710 bp, Homo sapiens
gcgaaagagaaaaaggctggagctcccgcccccggggctgtcagatggcttgggtttctgcgacgcgattggctcgcggagggcagaaattactcagcaaacatgactattattagctgcttagcaacagctcaccaaagtagagagaccacccaggtaggcaacccagtgtgtgcatcctcggcttcggggcagcctctgagagcgccaaccttctcgcatgcaatacttccattaaggaatgctccccctcctttctctcttattccttttcttttcaacagtgtcttctttttgtgggatgcctttgcgcgcacacacgcgcgcgcasgcacacacacgaacatttgcctcgcggtagacacggggggaaatgtwatatttttttaagcgcttaaacaatttctgaaattcctcaaagaaaagcctttcagargcaccttggcctcaagctgcaacaaatactgggargtccggctcgcattcccaggcctgcaccaataatgacagcgtgctggatartgcgccagtgtgtgccagatttttttttcctcttctcttttcttttataactaaagggaagacttaggctcttgcagggaacaacgcctcgcattaagataaacagaatggaaagttaaagaggaaagcaaggacgttgggaaaagccatctttcttaaaatccgtctgccccccagccgctttctcc

SEQ ID NO: 1736 - DNA, 829 bp, Homo sapiens
  misc_feature (32)..(32): n equals a,t,g, or c
  misc_feature (772)..(772): n equals a,t,g, or c
  misc_feature (829)..(829): n equals a,t,g, or c
aggtcaaaaataataataaatgttagcatctnactcagttctgtgtgatccagctcctgccaacccatctgatgagctcctggttcactctccttgcttcctgctttcacctcctgtggcccctgtcccgttcttcccatgtgccaagctcattccagcccccagacctgtccgctacttttctcctccagatcttaggttaggtaacactccagccccctctgagatcacctacacaccttctgttcacttctgtcatcctattgctaaattactttgtctcaaggttcgtaatctctgtgagggagtcctctctgctgcttttcccaaggcctgacgcacaccgggcacccagttaacatctttaatatattgggctttcgtgctacctgagggcttctagaaagctctctacatccaagtgagaggctggctctccaggaggtacctgtgctctcagcacaaatggagcccctctgggaacaggaacctgcttcagccctttagcatacacaggcctgccacatgctggggacagggccacctgagtcccttgcctggtcccatgtgtggtgccagctccctcccctgatgattgttctctctctttcccaggaccgagatctcactcagcagacagcagcagcccgggagcctgagctcaggaggaactcttacctggaaattgggaactgtatggagactccaaactgacttctttcaaaaaaaaaaaaaaaaaaatttttttagctttgacaaacacacaaaagtngtaataaagagagccctccttgtcaacccaaaatgtgagccccctgtggaaaaccan

SEQ ID NO: 1737 - DNA, 1188 bp, Homo sapiens
gatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggcagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgstgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgttttttttttaaaaaaaaaaaaaaaaaawcycgggggggggcccc

SEQ ID NO: 1738 - DNA, 4244 bp, Homo sapiens
ttcctgaggccttcccagccatgctgaactatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcccgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatggaaacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctctgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctctgatgtgctcccagtgcagtgaaaacaatctattaggagaccagactcatatccaacttttctccttttcttgtaaatgaggcaaacacttgatgcaagggcttcgtacagaacagagtttcatgagatgctcgttgctcctcccatgaagtggataatacttccactccttgacatgtcacggtgacgtcagtgggaagagttgctgtgaggtccttatacagcaatctagcacagaacgggaaggactgaccccctggatccagtttgtaagtaaatgacagcaagttacacagtgggtttctctgcaagggcccagtcaggagggctgcaaagtcactctgaagccggtctgcctggtacttcctcccagagtaagcattcaggtactcgcagagactgaacaggaagtgctggatgttggtctgtaaatattttgcagctatctcttccaggggaatgaagactgggactgaatggtgatgtatccggagtggtttctgtaaaatgatatgcctgcagaatggctttcacattttccaatttctcttccaatgcttcttgctcattgatctccactgtttggttgggttctacattggcaatacatgctttcaccttctactcacgctggctcgccggtgccgcaccacagccctcagctcatctcgcagacgccttagtttatgaatcttggttccaagagcaccttcctgggcctgcacgctctgcagctcttcagactgtttacgggatctgctcacttgggtctctagcctttccaagtgagctaaaacacctcctttggactcgccatctggacgtaaagggttcgcctgctccatctcagattcccaagggccttcccatgaa

SEQ ID NO: 1739 - DNA, 1089 bp, Homo sapiens
ggcacgagcggcgccgggccgggcccggccctggagatggtccccggcgccgcgggctggtgttgtctcgtgctctggctccccgcgtgcgtcgcggcccacggcttccgtatccatgattatttgtactttcaagtgctgagtcctggggacattcgatacatcttcacagccacacctgccaaggactttggtggtatctttcacacaaggtatgagcagattcaccttgtccccgctgaacctccagaggcctgcggggaactcagcaacggtttcttcatccaggaccagattgctctggtggagagggggggctgctccttcctctccaagactcgggtggtccaggagcacggcgggcgggcggtgatcatctctgacaacgcagttgacaatgacagcttctacgtggagatgatccaggacagtacccagcgcacagctgacatccccgccctcttcctgctcggccgagacggctacatgatccgccgctctctggaacagcatgggctgccatgggccatcatttccatcccagtcaatgtcaccagcatccccacctttgagctgctgcaaccgccctggaccttctggtagaagagtttgtcccacattccagccataagtgactctgagctgggaaggggaaacccaggaattttgctacttggaatttggagatagcatctggggacaagtggagccaggtagaggaaaagggtttgggcgttgctaggctgaaagggaagccacaccactggccttcccttccccagggcccccaagggtgtctcatgctacaagaagaggcaagagacaggccccagggcttctggctagaacccgaaacaaaaggagctgaaggcaggtggcctgagagccatctgtgacctgtcacactcacctggctccagcctcccctacccagggtctctgcacagtgaccttcacagcagttgttggagtggtttaaagagctggtgtttggggactcaataaaccctcactgactttttagcaataaagcttctcatcagggttaaaaaaaaaaaaaaaaaaaaaaaaaaaaaaaaaaaaaaaaaa

SEQ ID NO: 1740 - DNA, 536 bp, Homo sapiens
  misc_feature (4)..(4): n equals a,t,g, or c
  misc_feature (20)..(20): n equals a,t,g, or c
cctngctacaaggagctggnagctccaccgcggtggacgggccgctctagaactagtggatcccccgggctgcaggaattcggcacgagctcaacatgtggggattacaattcaagatgagatttgggtcaggaaacagagccaaaccatatcaagagcctctggtaaccactgttctactcaatacttctatgaggtgaacttctttggattccacatatgatcaagatcatgaggaaggaggagcaagtcttctttgtcatgctattaagaaaatacccagagtcacagcaccatgatctccttgtgaagcagaacaagtaatataaaactgatctaaagaggcctcccctctactcttatctgtctggtcgagtcatttgggtccaagtgggcaccattgtgggagggtgggaggactcatcactgggggcccaggcatcattggcatgtggcctcctgtgttagtttgttctcatgctgcaaataaagacaacttgagactggataatttaaaaaaaaaaaaaaaaaaaaaa

SEQ ID NO: 1741 - DNA, 788 bp, Homo sapiens
  misc_feature (290)..(290): n equals a,t,g, or c
  misc_feature (768)..(768): n equals a,t,g, or c
aggggcmckgmctcccacccaccccatcaccagctttccacttggaggccccctgtgccctgcagcctcagggtargccgtgggtcaccaggctggagarggcccctgccttggccaggggtgcgaggtgacccggctgcattgctgggtgggagctgctgtctgttgttcaggggcctggcccccgccctcccccccgaccccgacctcgcaaagsgcactcccgggcagggtgtggtctggaargcggggctggcggggacatgggtgttctgcatctcctagcgcanttcctgctggtggktggaagggtgcctggtttaggcggggtcccaggagggggtgaggggtgacaccttggggagggggcctkcaaaggrcactgcctgtggccacgtggtgtctgtgggaattggtcctggggactttgatgggtgtttgcggccccagttgccgccctgctccctcttccagggctcctggcttgggccccccgacccccctgctcagctcgggaaaatccccgtgcggctccagccccgggtcacgctcaggagcgatgagaggggcgccctggccacgcttcaggaaagcctgtgtctgcgcgcggggcaaggggctccacgacaaaaggacaagatttgacttaaattaagtttttcccttgaggatattttcattttctttaaaagaatataattttcttctaagatcttggwaaaaaaaaaaaaaaaaaaaaaaaaaaaaatacgtagggggggtcccgtnacccaattgtcctgacgtgg

SEQ ID NO: 1742 - DNA, 831 bp, Homo sapiens
gaattcggcacgagaatttcttatggctgaataatatttcattgtgtagataaaccacattatttgtcagataatagacatttgggttattgctgtcttttggctattatgagtgttataaatatttgtgcacaagtatttgtgtagacatgtttgcatttctcttgggtatatacctaggagtgaaattgctggataatatgtttaactatttgaggactgatagactactttgtaaagtggccaacatgagtaagttttcatcacatttataaaatgttagtgtacttacattagcttgcaaagcatttaataagcagcaagagttaaaccacgttggtccaagtgaactgaaagcagacttctgtgttacatgtgtatgagttactgaacatgttccataatacaggagtgtgagcacactaacaggtaagtgcaggaaamcaagaagaaatattttcagagtatagtcaaaagtacactgagcatgggagaattgttttgacattttgctcaaaactatttctgaagaaaattcaacatttctttcacggaaagttttaggaacaggtaaatacaattatataaagtactggtagaatatgttcgttcagatgaccttgaagtgttttttcagacttatctgaacttgagatctgaactgaatttttattagaaactgttaaagcctctggcattgaaggttagttcataattggtgagttctgaatcacttcatttcckgcagtggttcctgagagaatcttagttmaaaggactgcccccgccaacccctgccccgccaaaaaaaaaaaaaaaaaaaaaactcga

SEQ ID NO: 1743 - DNA, 675 bp, Homo sapiens
ggactactccattcctctggatgtaaaatctacattctcttgcctgaggtggatacgtttgcttgggttctgtttaaggagatggggccagcagtgtgtttcagggcctgtgaaatgtgttctctatccgggcttttgcttaatctctgttttcagtcttgcctatcagtcccactgtcgggggtacctcgtgtctgagtctagaacctttccaggttgctgtgggacagattagcctccttgttctcagtatcccctgacctccacctttattgctttgctccatgaattaaccatttccatgtactgtcatgtctaatgaagatgaattctcttctgttggtaaccccattccttttttgtaattgtgtgcttatacaatgtttattcttcactgtatttctattggagcctcaggacaaagagcagatggtgagaatctgtgttcagtgttaagttttccttctgtaagacatgtgcaacttgtgtttttcactgaatagatcatggacttaatgcatatagagctactttgtttttcatgattgtgccttcaattatatgtagaaatataatttgtgaattgcctgatgaaattttcctaattttgaattatctttgcattcctataataaacactgttagaatggcaaaaaaaaaaaaaaaaaaactcga

SEQ ID NO: 1744 - DNA, 461 bp, Homo sapiens
  misc_feature (77)..(77): n equals a,t,g, or c
  misc_feature (437)..(437): n equals a,t,g, or c
ctaggagcaccgagcagcttggctaaaagtaagggtgtcgtgctgatggccctgtgcgcactgacccgcgctctgcnctctctgaacctggcgcccccgaccgtcgccgcccctgccccgagtctgttccccgccgcccagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggtgggaacaaggacagggggatttaagcagtcaaaaggaaaaacatgttaagaccctagacttgtatattgacacacttgtaccttgtaaggcagaggaatgtaattaaaaagcacttatttggcwnaaaaaaaaaaaaaaaaaaaaaaac

SEQ ID NO: 1745 - DNA, 956 bp, Homo sapiens
  misc_feature (404)..(404): n equals a,t,g, or c
ggcagagcagtgaaaatgcatcctaaaaattcaatgtttataccaggctcatgacactaagatgtgacatctggacacgaggggtcagccacgtggatacatccctcccagattgcatctccaggaatcactctgctagcagaatgggcgccccatcccttactatgctgctcctcctcaaagtgcagcccagaaggacccaggcctttgatgcacattgggtgggtctcccactactttagttgaaatgggagcatgctggagtcggcgttctgttgcttctggtgagaaggacatcccattgacccctggccaccaggtccagtattccatccttccttctgtcccagcctatcgccctccccacyaggcccacccccacaacttctcctcaagggaggttntcccgcagctggagggcttgcacagaccagcagtcacagaaatcattcttcctgctgtactgggccttaactgcctgcaaatgtccgagcactactgcataggatgccagagccaccgaagataaacacagccaagtttaataataataaaaggaaaaatctcagcctgcagaactctggttttgacccaccatcggccagatgcacatcttcagggcctgttgagcaccttctgaaaagcagggctcgtaatagactccagcacattccatcagagtcaggaaaactgcggtgagtcccagagaatctagggtgcagggcagggagcaggagtcataaggagtgataacctaaactgtgtgtagtcagcggggagggtcttatgttatcaggtgaaatgagagccagtaagttagttgatcctgtcacagatataaccctgataacaccccatagatacgcgacacgtgtgtcctgcccctgctttccccatccaacatggttcttctgttccacagacattaaaggggctttctgcaattacttaaaaaa

SEQ ID NO: 1746 - DNA, 808 bp, Homo sapiens
  misc_feature (748)..(748): n equals a,t,g, or c
  misc_feature (767)..(767): n equals a,t,g, or c
  misc_feature (776)..(776): n equals a,t,g, or c
gaacctgtcctctgcctccgtcggctgaattgcggccgtatgcgcggctctgtggagtgcacctggggttgggggcactgtgcccccagccccctgctcctttggactctacttctgtttgcagccccatttggcctgctgggggagaagacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggcaccccatgaacgaccctaccaggacttttgccaatggcagctggcttcagggtccagccttttcaggtcagcgataagccaacccctcgctctgacacagaacacctgcactagagtggcctggtgagctttccgggaaacgtcctgtggctgaggagcaatgggcaggcctgatgcctatgangacagatctcacataaatnacgcgctcntgacagtatggggtctcatagttgaagggaca

SEQ ID NO: 1747 - DNA, 619 bp, Homo sapiens
tcaggccccgctgactccgccccgcaacactctcactcgcccttcgtgtcccatcaggtcccgctgactccgccccgcaatactctcactcgcccttygtgtcccatcaggtcccgctgactccgccccgcaacactctcacttgcccttcgtgtcccatcaggtcctgctgactccatctcctcagcgtctccaacatgtcccttccttgccacctcttgcctggattactacagcagcttctaacgagtctccctgcctttcagttctccgcaccgcttcaagtgttcagtctggatggtctgtcactcccagcgccaaaactgctgacggcttccctttgccttcaggacgaagtccgtgctgtctgacataacttataggaccttttagccagcctgggcaacatagcaagaccctgtctctaccagaaaatacaaaaatgagccaggcatagtggtgtgcacctgtagtcccagctacttgggaggctgaggtgggaggatcacctgagcccaggaagtcaaggctgccagtgagccatgatcacaccactgcactccagcctgggccacagagtgagaccctgtctcaaaaaaaaaaaaaaaaaaaaactcga

SEQ ID NO: 1748 - DNA, 774 bp, Homo sapiens
ggcacgaggcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtggatgggaaggagttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaagaggcctgtgagctgtccaataactgacctgtaacttcatctaagtccccagatgggtacaatgggagctgagttgttggagggagaagctggagacttccagctccagctcccactcaagataataaagataatttttcaatcctcaaaaaaaaaaaaaaaaaa

SEQ ID NO: 1749 - DNA, 1657 bp, Homo sapiens
  misc_feature (6)..(6): n equals a,t,g, or c
  misc_feature (343)..(343): n equals a,t,g, or c
cggacngagccgccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacantgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtggggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgtaaaaaaaaaaaaaaaaaactcgrgggggggcccggtacccaaatcgcc

SEQ ID NO: 1750 - DNA, 1123 bp, Homo sapiens
  misc_feature (78)..(79): n equals a,t,g, or c
aatccctatggtctctaatttcagctcttgctgtaaactgcaagccaaatgctctttctcagaaagagctatattttnntcttcttacaggcaacccaatatttatttcataaagtgttataaatattgagaagatacactggggagatagcatataaaaatgatgctccaaaatgagaattctatatggggctttccctaagaagaatccatcccagcacatattttgaaaaggtgctgaattaaaaagtacaagagtttgctcatataaatcaagttgcccaggaaacctgaggtgatgctatcatttgtctcataatttagaaacgtgatctcttgagagagagactacgcattgcctgggcactttcagattccttaggaagtgcccctttgatatttggaatgtggatatatttataaaacaaatggattgttattccaaatccacatggatttataaccaagccccagaagaataggcagctttgaaatagctagttcgtggaattgaacagaaccttgatggaatgcagttgcctgtgtgaggacagaaaacaaagaggctgcctcagaccasatgcctatctagagattaagtggaatttgtgagggacattttgtggatgccttaaagatgaccagtggtgggttctgatgggaatatatacactcatctggactaggccaatggaagcagtctctttcagttcacctccgtacagcacaagttgttcctgctcatgacctcattgaggaaaatgagaattgtggtgctggtgactttcatgtgtcttgggaggttgaggtgttcaacatcgttaaggcactcccaaaacgcaaacctccttttttaaatgccaattgtacatctacattaattcatctatgcaaacttgtgttttcatggtttgttttttacactatatttctcattaggttctttaaacatcaggtttaatattgatattatgaataatttttaaaccaaagtattctataagtctgtgtgctttgttttcctggatggtttgaccaaggtaaacatcagtcttgtccttctctcttaataaagtcatccatttgttaagaaaaaaaaaaaaaaaaaaaaaaaaaaactcga

SEQ ID NO: 1751 - DNA, 1378 bp, Homo sapiens
ggcacgaggtcctttgtgactgatgtctttcacttagcatggtgtttacaaggttcatccatgttgtagtatgtatctacttaatttttttctatgattgaataatagtccattgtatgaaaatacaacattttatttatctactcatcaggtgatggccatttgggttgttttcatctattggctattattagtcttctgtgaacactcatgtataagttttcgtgtggatgtatgtattcatttctcttgtaacaaattctacctgggagtggaattgctggatcatatggcggctcttttgaccttatggggaactgctagattgttattcaaggtgtctgcaccttgttcattatcatcagcagtttatgatggttctgtttcatcacaacctcaccaatacttattttctgtctgtaggtggggtttgttggaacaccaccacattcattcatttacgtattatctatggctgcttttgcagtacagctagagagttgaatagttatggatacagactgtatgactcaaaaggcccaaaatatttactaattggcccttcacagaaaaagtttgctgctagaggtatgttataaagtgaagttagtcatgttatatttgaatgcctgggtgaagtatgctaatacaggaataggctagatatctttcgagacttcctaagtggcctcacagaacctatagtcacttaaaccaaagtatacttgtatggccagtatcttagctatgcaattatatctgttagacagaaattctatgattaaaaaagagaggcaattcattgtcataatttgtcatcaaaagcattataacaaattataaaaatactagaaaaggtaggtatagtatcaaaatgataaataccagtaaacatgatgctccagaacatgtaaaatatatattttggagtatcatagcatagcacggggaggggaaaattaagtttgcaagtcaagaatagtgtgggggagggagtttggagggaaaagacaagttgggtagactttggaggatacggcaggtgctaaatcttagaagaatctgcaatgctcacttggttcccagaagtagctacacccaagtcaacccctggcttgttttccactaacggagccaaatacaaactggggtggctacagatatggaaagctggtatcaagatcttatttttgataagtaaaaaggactatacatgaggagtgccatcaagatggggatggggtgactgggaggaggaagagaaaggtgagtcagtcatgcacaaaacttaattattttggctcctcagcagttttgtttgtcaccaagtgtgtgtagacaaataacattaaatgctcttaaaaaaaaaaaaaaaaaa

SEQ ID NO: 1752 - DNA, 831 bp, Homo sapiens
ggacattagatcactgtggacctaaaacaaacaaacaactataaggaaaatggcattagaaatggtctggggatcagtttatcactgcagttgttacatcaccccatggtctaaaatacagagctttagtctgtctctgtttcagttcattttacaggaggtgaacatcacacttccagaaaactctgtctggtatgaaaggtataaatttgatattcctgtctttcacttgaatggccagtttctgatgatgcatcgagtaaacacctcaaaacttgaaaaacagctcctgaaacttgagcagcaaagtactggargctgactgatgccctcatgattttccaccctctcttcccataaagcatcttcctaaggaaatgamcatggcctgatactcattttgtcacttgtacagagccctaaggatgttctgaattcagtggtgccaaataaatgttgacattccccttttggttgatggaagtatcagtgtgggaactgtttgcttaatggcattttataaaataakaakakcatattagcagggagggagatgatggagggagggagaagtccatttgtcttatttatcctttttgtattaatagagaagcacttcacagtcactggcaatgccatttataggaagaaggttctgcattcctgctgctcccggagggcttaactttttaatgaaagaataaatgctcttccactcagtagataaagtgaaatgtgaattgttaataactgtgcacggtcaataaagcgatgttttaaggaatacaaaaaaaaaaaaaaaaaaaaaaaaaaaaaaaaaaaaaaactcga

SEQ ID NO: 1753 - DNA, 1350 bp, Homo sapiens
gtgacttctatattcaatagatttttgtaaatgttaaaacatctatatttaaatgttaaaacactaaatatagagaggggctttatttcaatcatagagcaacaacaaaaataatgcttatagctaaactgcctgttctagaaagcatctgctttttcatgttattcctaaatcctcttgtcatacttttgtcattgaacaatgctctccctctcgtcttccatcctcattcagaatttttagaagaccacaatcgtggagatacactacccagtattgtttgatacatttttatttgataaacattcagtgcaggaaactgtgatttgctatatgtttatgtatataatcttattctgtagtcatcagaatgttaatgtaaggtacatttgatttttattttttacatgtgtagttttctttcttcacagtcaaagcatttatattattgggggtgggggcagggaattaagttggtgggctcgaaaatccattcatatgtatctgtctacaaatgtctggggataatttaaatttgaaacctaagttatatatagtttggcaatgctcttcttcaatatttacaataataggatgatctacaagaaaataagtttctttttgcaaatttttatcatactaaagttgttcttttaatttagcatatctaaaataggatttagttcagtttagctcacacaggtgtttgctgacattcattggccatttaatacagtgttgagtggttctccgtaaaagtataagtgctaacactacgaagaaatgcacacgatcattcttgctcacttctataacaaacttacataaaatggatttaaaaattcctactcacagcctaaaacttctggagttcactacctttttttcaaattcatagtaagatcacctgtgtattttatattttagtaaagccaattatgaagtacaagtatcatacacgtacttttgagctactattatttgaaaaaaatctgccaaatagcatctttaggatatatttacattttcactcatctaaaaagtatacaaaaataaaaagtggaaaaaggtatcttctgaatgttcaagagcatcctatagtgccaaataataaagcaccatttttttcttcataaccaggattaaaattcatatatactgcagggcagacatacatatgatagcttgtgctgattaatttaaccccatttgtaaacagatgaaaattttattttcttatttcatttataagatggctcaatgtattgggaggcttcttttttattacagaaagtgtatattggtatataataaatgaacttttcaaatgaaaaaaaaaaaaaaaaaaaa

SEQ ID NO: 1754 - DNA, 940 bp, Homo sapiens
tctaaaggaactaagctgagctccccgcggtggcggcgctctagaactagtggatcccccgggctgcaggaattcggcacgagggctgaagacacaggccaggcggaatgaagatgatggtggtcttgctcatgctgtcctcgctcagccggctcctgggcctcatgaggccatcatctctcaggcaatacctggactctgtgcccttgccaccctgccaggagcaacagccaaaggctagtgccgagctagaccacaaggcctgctacctgtgccacagcttgctgatgctggccggggtagttgttagctgccaggacatcactccagaccagtggggcgagctgcagctgctgtgcatgcagttggaccgccacatcagcacgcagatccgggagagcccccaggccatgcaccgcaccatgctcaaggacctggctacccagacctacatccgttggcaggagctgctgacccactgccagccccaggcccagtatttcagcccctggaaagacatctaaagggacagggtcagggcagcccagggctyctggcttcagcaggaagtgaacaggctcagggaactggaggaagcgaagcatcaaggccagaggaggccacatgctgaccagcctgatgaggcaagagcctgcccctgccaccgccccgacccctctcctctctgcaagagcctgcctctgccaccgccccgaccccctctcctctcagcaagggatgggcctctctgcctcgcccacccctcagccctcctcccagccatctcctcttccctaaggcctctgtctccatagctctggtttccctgggcctcagtcctccccaccctccttcctctgtctccctgtcactaatgtgaggtttctttgtgcacattaaagtcttctttcagcawmaaaaaaaaaaaaaaaactcgagg

SEQ ID NO: 1755 - DNA, 2663 bp, Homo sapiens
cactcgtcattctgatgcccgccaaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgtaaggccatgaccctgtgcatctgctacgcggccagcatcgggggcaccgccaccctgaccgggacgggacccaacgtggtgctcctgggccagatgaacgagttgtttcctgacagcaaggacctcgtgaactttgcttcctggtttgcatttgcctttcccaacatgctggtgatgctgctgttcgcctggctgtggctccagtttgtttacatgagattcaagtatgtctccgatgccactgtggccatctttgtggccaccctgctattcattgtgccttcacagaagcccaagtttaacttccgcagccagactgaggaagaaaggaaaactccattttatccccctcccctgctggattggaaggtaacccaggagaaagtgccctggggcatcgtgctgctactagggggcggatttgctctggctaaaggatccgaggcctcggggctgtccgtgtggatggggaagcagatggagcccttgcacgcagtgcccccggcagccatcaccttgatcttgtccttgctcgttgcygtgttcactgagtgcacaagcaacgtggccaccaccaccttgktcctgcccatctttgcctccatggtgaaaacaggagtcataatgaacataattggagtcttctgtgtgtttttggctgtcaacacctggggacgggccatatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgatgtccacacaccaccaaaacccagccaatgggccacctcttcctccaagcccagatgcagagatggwcatgggcagctggagggtaggctcagaaatgaagggaacccctcagtgggctgctggacccatctttcccaagccttgccattatctctgtgagggaggccaggtagccgagggatcaggatgcaggctgctgtacccgctctgcctcaagcatcccccacacagggctctggttttcactcgcttcgtcctagatagtttaaatgggaatcagatcccctggttgagagctaagacaaccacctaccagtgcccatgtcccttccagctcaccttgagcagcctcagatcatctctgtcactctggaagggacaccccagccagggacggaatgcctggtcttgagcaacctcccactgctggagtgcgagtgggaatcagagcctcctgaagcctctgggaactcctcctgtggccaccaccaaaggatgaggaatctgagttgccaacttcaggacgacacctggcttgcacccacagtgcaccacaggccaacctackcccttcatcacttggttctgttttaatcgactggccccctgtcccacctctccagtgagcctccttcaactccttggtcccctgttgtctgggtcaacatttgccgagacgccttggctggcaccctctggggtcccccttttctcccaggcaggtcatcttttctgggagatgcttcccctgccatccccaaatagctaggatcacactccaagtatgggcagtgatggcgctctgggggccacagtgggctatctaggycctccctcacctgaggcccagagtggacacagctgttaatttccactggctatgccacttcagagtctttcatgccagcgtttgagctcctctgggtaaaatcttccctttgttgactggccttcacagccatggctggtgacaacagaggatcgttgagattgagcagcgcttggtgatctctcagcaaacaacccctgcccgtgggccaatctacttgaagttactcggacaaagaccccaaagtggggcaacaactccagagaggctgtgggaatcttcagaagcccccctgtaagagacagacatgagagacaagcatcttctttcccccgcaagtccattttatttccttcttgtgctgctctggaagagaggcagtagcaaagagatgagctcctggatggcattttccagggcaggagaaagtatgagagcctcaggaaaccccatcaaggaccgagtatgtgtctggttccttgggtgggacgattcctgaccacactgtccagctcttgctctcattaaatgctctgtctcccgcggaaaaaaaaaaaaaaaaaaaaaaaaaaaaaa

SEQ ID NO: 1756 - DNA, 1251 bp, Homo sapiens
ggcacgagccaggatctgggaaacagatcagcgactctagtctgaagtggctgcctgtttcgggggctgccttcagcaagattcaggcaggagagacggaaatagccaccttccaggcgtgagtcctggagataaaaatggattttaacctaggactgccgggagctggccctccgcggctgctcagactagggctgtgtgtgctggctctcgcctgtttccggtgtctaactggcttgtttctctttatggcttggcttcattccgacctggggtggggccacatccaacccactgcccactggctgtccgtctggcctgccccgcggttccaaccacagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcatttttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaaaaaaaaaaaaaaaaaaaaaa

SEQ ID NO: 1757 - DNA, 980 bp, Homo sapiens
  misc_feature (918)..(918): n equals a,t,g, or c
  misc_feature (962)..(962): n equals a,t,g, or c
  misc_feature (970)..(970): n equals a,t,g, or c
agctgggagttcaggtgaacactattgtgaattccgtttaaaaggagggctcccactctccttgtctgcatcagccacatatcccatggctgcagcaataactcccctcttgggaaagtcagcagcaggagaagcccaaggcagaagggatgtgaccaggtcccagcctatgacatctcatgaaggctcctcctgtgtgctgcaaggcagcagcagtgcagaggatggggtctcctctacaattcaattattttacaccaaacccagtactacttccctccaggaaagggggcgcatggatggcctggacaaagctgcaaggagggcaaggctgggcagggtactgcatcttcaggctgcttctgggctctgccaggaagcacaggctcaggagaacagagtggggcctgaatgcacacatgtgccatctcggggccctgggccaggtctgagttgtcaaacaagaacagatgcaccactggctacatggtcgtcaatgactccccagtctcaacagagagaaagaaagtgagagtgattgctactttccattccacgcttaatgtacaatttgatcagttaaaccacttaatcctatatgaaacaggaatgtgaagacaccttatgaaatgaaaaatgttaacctcatgggtaaggatggcgatcagcaccgtcattctggtgatgaaccccagaaggccagcgccctyccaacaccaatgatgctggatgtcagcttgctgtttgcatggctaaggtcgcttctggccatttattctgggcttgtcacaaatcccatggagcaagactctgctctctcctattcctgtggagatcccaaggcccaatccccagggaagttgtacctaaaggcttcccagaagatacccagaaacgacgacaccagcttcaaagaanaggctggatgctcccttcttcaaccattcagggtcttgatctangggatacnatgtaagtta

SEQ ID NO: 1758 - DNA, 1330 bp, Homo sapiens
  misc_feature (1006)..(1006): n equals a,t,g, or c
ggagtaagcctgcaccattttccagctatgtcagtccaggccccagttggcccttggccccttggagtccagccacatactgtgtaggatccaagtgccctgctcgccagagatccagcactcttaatggcaagagtcagatggtgggggttcaaatttggactcttacctgctgtgtaatcttggttgtagtactccccttctctgtgcctcactctctcatctgtagaatggggttaatagcaacatctgtccttcaggggcatgggaagagtaaaatgattaatgccacagtgtgcctggcactgggcctgcccagagtgcccagggaagatcagctgatagtctcacttgacccgcagagctcagaatcagcatccctggaagccttgttaaaatacagcttccttggcccgccctcactgtttcccattcagtggtctgggctgggtctgagcataagcgtttcttaccagttccaggtgacgctggttccactggcctggggacccaactctcaggacccttgagcctgtccatccatttcagtgggtccactgggacgttgatatatgggaaaggcaaatgtgacctcagacattcaggaaagcaaagaaatgtaggcaaggaatttctacgggttttaggaaaatgtttcgtcctgcactgggtacccacagtctttcccccggggactcttgcaaatatacttgactcagatctccatgggactcacctggctgaaaacaagctgtcacagcaccttcctctcacttgtcccacagccatttgagggcactccctgtgtgccagctcccgagtactgatggggctcagggggcaaggaaagaacatcactgtccccagagaggccaggktggkacttgyacaggtgcagtgttaracggtcaagaaagcctgatgcttagggcagggggcactgaggaggagtatgcatggtgaggggcttcctagggagcatcagatgcgtaggcattcataakwnacagacacacagggcagggtgagagggaggcatgaagaatggggaggaaggagatggaggaaggaggggagtgagcagagggccccgggaatggcctggaaaaggctgagcccttggatcctctgggttggtgcatctgggctcacctcaawrraatgaacatggtttccaccgagtaaaattatcagcgtgttaacagctgccccccaaacagctggggatgcattcccgccctgcacatgcagacagcagcaacatttgctcaacctgggagcttaagagacaggcatgaaactaaatcttccaaatccattgaggtgagcc

SEQ ID NO: 1759 - DNA, 858 bp, Homo sapiens
ggggacatatgtactgtctgtgtggcctattattacaagctctcctgagactttgtaatggatacaagactcaaaagaaccatagggagctgagaatgtgtggtatcatcgcccagggaaaaagccgttggcagctgcattgttatccagggatgaaaagttagcctgtattttgcctgagggacgtgatttgcccttgttagtacctgtgcctgctttgtcattccagctgcaggttggcatgctccaacagcatcatggacggggcctacacctacgccgaggtgaccaatgtctccaactgttggatctgcacaactcttccagcagcagctggggacagcttgttctggcacgtgcatccagcttctatgcagaagtggacatggctagagacttggggtcctgcagacaacaggtaggatgcaacacggtgagctttgaacaggggttgtcgcagaacccatggcaagcctgccccctggctgacttgtagtgtccatgatggatgagcttggctaatgggagaacatgtagtgcccccattgcaggtaccataatgtatagagcagcactgtggtaaagtcactgtaagatggttgcctgctgaggtttgtgcaaacaaaacacatgtcaccacaacaagggtgtggtggaacaagcagacttgccaaggctggggccccacggattttgtgccccttgggagtttatgggtctgtggggacacagaatggccatctctgccagccaattggactggacgttgtacctggaggtggccctatgtggctgccactgtgcttcccacctcgtgccgaattcgatatcaagcttatcgataccgtcgacctcgag

SEQ ID NO: 1760 - DNA, 1264 bp, Homo sapiens
ggcacgagcgcacctggcctcagaggccccggccaccgaggagcctcctggggactctaggctgggctcttctgcatggaacgccccgcctctctttgggcctcagtttccatcttgttcaccagttgggggctggctcttcccagccttcaggtggcctctctctctgactccagcccccaccctcctttgttgggaccctccagacccatccgctagtcacaggagcgtgtccctgaaaggaactggctgccttcactgtgagagccgggctgcacagatcccctgatggggtgccccttcctgaggtggctcttggaggctctggccagtgaggtcaagcctgtgtatcctaccagggccctggaggggtggacgaggccaacacagtccctgggggaatcctgggatctctgacacctggcgggggtccctgagcagaggggcctgaggggcacccaaggggtgggtgggaagcccctaagccacacccatggtcaggccctggtgtggaagcacctgcagctccagctgggccaaggtactggggcctctccttgtgggtgcaggggccggggcaggaccgatggtgagtggggtcatggaggggatgcagctgggtggcctgtgcatggctgcagagcccctggtgaggggacagcaaggggctaggtccactcagggttcctcctggtcaggggctgggaggccccaccctgccctaccccacctgggctcaaggtcacgagtggagcagagggtcacagcccagcaagcagcagcagcgcagcctgggcgccacccgggtcctcagggctagccaggagccccccgcgttgctgtggcacacagaggtggcgggaggggtggggcagttgcagtgactgccaagtgtatgggtggacggacgggggacagacagactggtggtcagactcggggttggtggggggacaggtgacaggccgggcctgtgcctggcaggtgtcagctgtgccagggccaccccagccacgggagagctggttggtgttcaggggcaccgatgggccgagtccgggttcggaggtcagcctggagctcccccgagcaggacggctgggtccaaaccactagaaatagtctgaaattgttcttccgtgggcaccaacctgcagaggggtgtgggtgctgggctgggattcgcagccccccgaggctgcccaagcccatccttcccaccagcagggcacagcctaccctcccctcattcagcctcgtgccg

SEQ ID NO: 1761 - DNA, 2496 bp, Homo sapiens
ggcacgagatcacacacagccttgagagctgtagacaatggagccctctctggtacacatcctggtttgggtgagtgttccgccccttttcctgtgcttaactcactccagaagcatcaaccataaccaagatggactaaacttaactccactcttgcagatgccccatcaactcacagatgcaagtggtgtcatcaaagccccagcatgtcacccaaccgttaacaccaatccacataaagaaaatgagcatgcattcctgtttgctggatgctgcacacattctttaaacagagtaggcacttgggtgccacctttattcaaggtcttcaggtttcttttacgggggacatctgccatagcaactttcagtgggcatttcttttctgatgaagctttctatcctggggagccagggagactccaaggcaatggagtcccctggcagctcactgtcacaggtcaaggttttgattatgacaaagaagataaaagaagagaagcccctcatggtttgtggctgcagcattacagggctgccagagaccccagagcatgggtgtcttggtggtccacattctgtgatccaggggaggaaccctgaggagtagggaactgcccaccagaagagcactcacaacacactcaagcttcttgacatacaattccagatgtcatctctaaattcacagtgaccttttccctaaactatgttttgatacagggcgagcagaagcgaggggtgatacacagcaacatcggtgagcatctgagctcgcaaggaggcagtggcctctgtgccccctcttcccacccgtatcttaataaaatttcctaaggataattatttagattgtctctcttttgtgtcttatgtatttaatggcagagctgctatgaggcaaaaagaaacaaacaaacagaaagctctttttaaaaaatgcaggaggagaaatatgccaggaaaggctactatttgacattaggcattcctgggataactaggatttagctaacataaaaatttccatgttttaaaaagtatctctgatttaaaaataataacaaatctggctacagcccttgcagtggaaaaatcaatactcttttattcctgtaaaagctagggcattaaaacagaatccaggctagaagaggtgggtatgccggcatcatttcacctgttttgaattatgcggttaaacccagcgtgcatttccctagagggggcacagacgcttcttccttcaagaacatgctaaacatccatctgtcagaaacaattttggggtattgaggtgcagagacggagaacagaacagaccatcccttggggttcctgcccgtacagaacagttgtgtctctgctagatgcatgcacccattatcattgatcaacagtcccctgcacgacaggcatggccacccacgctggggacacggcagtccatgtcctcaagaaactcatcttctcctggcagagccagatgcccagatagaccatcccaagacaataccacattgtgagagtagaatgttgatgaaaaccaaaaccaaacgctacaattaacaatacggatttatggaaaggggtgccattgagagccgacctctggtactaccacaggcactgggggcttaaagtgtttctcacataacacagcagcccctgggggtagctttcttatctttgtgttactgagtgactcctacgatccccagggtagtgaagggcagagatgggatttgaacccagttgctctgattccaaagtccctggtctttttataccaagcaacatcttaagtaccatttttaaaatatcacatttcccgattcccttcactgaattttatttgtacttctcataaggcaattacaggctgggcacggtggctcatgcctgtaatcctagcactttgggaggccgaggcagacagatcacttgaggtcaggagttcgagaccagcctggccaacatggcaaaaccctgtctctactaaaaatacaaaaatcagataggtgtggtggcaggcgcctgtaatcccagctacttgggaggctgaggcatgagaattgcttgaacctgggaagtggaggtagcagtgagccgagatcacgccactgcattccagcctgggagacagagtgagactccatctctaaataaataaataaataaataaataaatagtcaattaccttaatctgagcatggagtcatttatcaattttgctgaactataaacttcaaaggcaggaatggcatctctttacatattttgagtttgtgtgtaattgtttagattaggtgtgccccttggaggtggtgatatagaagcagacacctgaaagaagtgaaagcaatccctgagggtatggggaagtgggaaacctccaggaagaggacacggcagatacaaaggctctaggttaaggggcaagcatgagaagcctcgtgccgaattcgatatcaagcttatcgataccgtcgac

SEQ ID NO: 1762 - DNA, 1378 bp, Homo sapiens
atcttagcaatctccttggcccaaaacttcaccccatcttggaagggaggggagagagaatgttctgatctatatctgatgagggcgtgtggttgggacctgagcatcctcctggttgggctagtgatggggagagagggctgttactcacgactccctccaacagaataccagaaacaggcaggcagctcaggtgtatgtaaggatgtgaggccaagaaaccagccctcaccaagttacccctgtaaatccttgtctccccatgcacctctactttgagtcagaaatggattcattgcaggctcagttgtttgtattatgtgaatgaactgaacgtaaccaagcaccaagagagccctaaagacacagtagacctcctgtagaagggctctgatggaccttcaaacattgctyctccaactttatggtgcacacaaatcacctgtgcatgttaaaatgcagacggtgacttacagatcttgggggaggccaagtgtctgcatttccaacaagctcccagatgatggccacactgctgatctgaggaccacattttgaacagcaatccttaaaacacacaaggctgtgggaccgcactcctgagaagagacctcaytcttggaagggattytaggaggctgcattcaaaccatcccagagacagctcacaattttgttagggacctgatactaaaaattaccaaatcacaatcgtgtgctgagggcttactttgtgcttttcagatgacatttcatttgatgctctcaataaccctgaagggatttcagagatggggattatgatggagcttcagaattaaactgattaaaactggcccagagtcacacaactatgaagaggctgagttgggatttcttttaatttttattttttgaaacagggtctcactatgttgcccagactggtctcgaactcttgagcttgagcaatcctcctgcctctgcccctgagtagctgggactacagatgtgagacagcatgccgagcctgctgagttgggatttgaaccccaggtttgtctggctgtaagtcctccagtgtggaagtacgatagctacccatctcagccacggaaaacagcagagttttggttcaggcaagtagcactaagtagaaagcccaggtatgaaccagatctgcaggagcccaaagtcattgctcagaaccaccccctacccgctgagaagttcttcctgtccctggaagttctctctgagatccacccaaatgtgtcctcactaaggcgaaatctggcttctcctgtttgggcctggggagaaacataaacctagccctttgtacacaccgcctcgtgccgaattcgatatcaagcttatcgataccgtcgacctcgta

SEQ ID NO: 1763 - DNA, 1541 bp, Homo sapiens
ggcacgagtcgcatcaaagtcagaaccagcgccctccgtccttgctctcagcccagtgccaggcttccttgttaggagtattcttctcatgaaattctactgatttcttacattgtagcccagatatgatttgctgagggatatctgagagaaagcctatgtgtcctttccataaagcgtaccttgactgcttttttcaaatctctctcttgctactgatctttctaacttaccttgatattgggaagtgtggtctttggagccatgaatggagaattagggaattagggaaacatgagaggtggtggaattaattcattgtatcttgattatggtggcgactatgcaggaatatgtgatgtcaaaatcattgacttgttcacctaatgtgtgtccatcttaatgcttgtaaattataccttaacaacgttaactaaagaagtaattaaactcccacattggacaaggagggatctagagcactgaatctgcacagattctctgagctcagtctaggaagagaagtggggctgaactatacagaagatgttgaaattagaaacgtactttccaggaataaattaaaaattgagtttttgtccacctacaataatcaggcactgtgccagktcctaggactgtaaagaaaactatctctgatataagcttataatctaacagagaagacaaaaagtagaaagcttaaattcagtgagtaagtgctatgatagaggcaggagtgggttgcaaaggagaagcatcaaatacagatgaatggcacaaaaggctttctgtaggacattcatatagagcctgagaaatcaggagaactcctccaggatcactagctgtattagttcattctcatgctgctaataaagacaaacccaagactggggtwacttataaaggaaagargtttagttgactcacagttcarcagggtggggaggcctcaggcagcttacaatcatggaggaaggggaagcaaacgcgtcctccttcacatgaaggcaggaaagagaagtgcccaagcaaaaggggggaaaagtcccttataaaaccatcagatctcatgagaacagcatgaaggtaaccacctccatgattaaattacctcccaccaggtccctcccactacacctggagattataggaactacaattcaagatagatttgggtggggacacagtcaaaccatatcactagccaaagcagcaggtgtgtgtgtgtgtgtgtgtgtgtgtgtgtgtgtgtgtgtgtgtgtgtgtgtattcagtatcttgaactagaccactgctcttgaagatctcttgaccatgtagaagccaggataacacatttagctggaagctaattgtgaagctgggaaattatgcatgtatagtgatgttgggcacaaactcatgttatgttcaggtaacaagcagagcattttgggttcctttctttaggagttgtctaattttacttcatttgttatttctgattatattggttaccagctcgtgccgaattcgatatcaagcttatcgatacc

SEQ ID NO: 1764 - DNA, 1275 bp, Homo sapiens
  misc_feature (1152)..(1152): n equals a,t,g, or c
ggcagagcctgtccctgctgcccctgcaaaaaaaaccccctctggtgtgagcaggatggttggaggttatgtgagctccttctcctttcctccagtttcctcttcccttctcctccctgcctcttttgcttttccctttcttcctggtaccccctgcccattcctgtattttctcccatcgccattctcccctctcccactgtccctaacccgttcaaactctttcctcttaaatggttgagattttctctcaccaagcacaccccagtattaattaaactagctgcaaacaggcagcaagtggtctaccatgacagatgggttttgtgtgtgtgtgtgtgtgtgtaattgtaataaaacatattgartcactcaataaacacagagtgtctactacatgtatcargcactatcatagatgctaattaacgaaactgaaatggccaggccctcacagtggctcatgcctataatcccagcactttgggaggatgaggcaggaggatcacttgaggccgggagttcaagaccagcctgggcaacatagtaagactccatctctacaaaaaaaaaattttttttattatactttaagttttgggttacatgtgcagaacgtgtagttttgttacataggtatatacgtgccctggtagtttgctgcacccatcaacccatcacctacattaggtatttctcctaatgttacccctctcctagccccccaccccgtgacaggccctggtgtgtgatgttcccctccctgtgtccatgtgttctcattggtcaactctcacctatggagtgagaacatgtggtatttggttttctgatcttgtgatagcttgctgagaatgtkggtttccagctttatccacgtccctgcaaagggcataaactcatccctttttatggctgcatagtgttccatggtgtatacgtgccacattttcttaatctatcattgatggacaagttttgctattgtgaatagtgccacaataaacatacgtgtgcgtgtgtctttatagcagcatgatttataatcctttgggtatatacccagtaatgggatcactgagtcaaatggtatttctcgttctagatccgtaaggaattgccacactgtcttccacaatgtttgaactaatntacactcccaccaacagtgtaaaagtgtttctatttttccacaacctctccaacatctgttatttcctgactttttaatgaacgtcattctaactggcgtgagatggtatctcattgtggttt

SEQ ID NO: 1765 - DNA, 420 bp, Homo sapiens
ggcacgagggacaagaaggcctttctctcgagtcggcatggttccacttctctgactgcatcgggaattacctctcctttgggccaaagacaaaaaagaatgcagacttgtttccaggatgattaaattacattcagcatattcttcccgagtgcgtcccgtcttagtggggtttagagctgcgttcaggccagctgggctccggttacctctaatgaggatgatgatctggaggcttagcgataattctgcactgattctcttgtgcctgcagaacctgtgttggccaacttggatggcaggggaagatcaacagaaggtgccctccacccacgtcctcccagcgctcaccttggtcagcctgggggccaactcgtgccgaattcgatatcaagcttatcgataccgtcgacctcgtag

SEQ ID NO: 1766 - DNA, 1196 bp, Homo sapiens
  misc_feature (590)..(590): n equals a,t,g, or c
gattggttctgtttatgtgatagattacttttattgatttgtatgttgaaccagccttgcatcctagggatgaagccgacttggttgtggtggataagctttttgatgtgctgctgggtttggcttgccagtgttttattagggatttttgcgtcaatattcatcagggatattggcctggaattttctttttttgttatgtgtctgccaggttttggtatcagggtgatgctggcctcataaaataagttagggagggctccctctttttctttcatttggaagaatttcagaaggaatggtaccagatccyctttgtacctctggtagaatttggctgtgaatccatctggtcckgagctttttttttgttggtaggctattaattactgcctcaatttcagaacttgttattggtctattcagggatttgacttcttcctggtttagtcttgggaggttgtatgtgtgcaggaatttattcatttcttctagattttctcgtttatttgtgtagaggtgtttatagcatyctctgatggtagtttgtattctgtgggatcagtggtgatctcccctttatcattttnattgtgtctatttgattcttctctcttktcttctttattattctygctaatggtctatgtattttgttaatctyttacaaaaacaggcttctagattcatggatgttttgaaaggttyttcgtgtctctatctccttcagttcttccctgatcttagctatttcttgtcttctgctagcttttgaaattgtttgcttttgcttctctagttcttttaaccgtgatgtccagtgtgtcaatttcagatctttccagccttctgatatgggcatttaatgctataaatttccctcttaacactgctttagctgtgtcctagagattctggtacgttgtctctttgttctcattggtttcaaataacttcattatttctgccttaattttgttatttacccagcagtcattcaagagcaggttgttcaatttccatgtagttgtgtggttttgagtgaatttcttaatcttgagttctaatttgattgcactgtggtctgagagacggttacaatttccattcttttgcatttgctgagaagtgttttacttccaattgtgtctcgtgccgaattcgatatcaagcttatcgataccgtcgacctcgag

SEQ ID NO: 1767 - DNA, 2304 bp, Homo sapiens
ctcgaggtcgacggtatcgataagcttgatatcgaattcggcacgagctggtactatcaaaactcaacagtataaggtatggatttagtatacttattaaatgaaagatatcctataatatgacctgtgaatggattaaataaaaggtatgtacagttataaaattccataayaacagacatgcaatttatttttttattttttaacttcttgccttttaataatatctttgaatatagatggtttcaattctccaataacaagatgtagagtggccaaatggtttttcatacatgtttccctagtccagacacccaagagtatgtccctctcttgggcataagaaaacctagagttatatttagggcatcatgtgtggtgaatagttgaccaagctggcatgctcacaatgaccaaattatgtttgtcatattttaatccaatacattgatctactatgaactkgtaaataatctatttgcyttctagacacattccmggaagaccagagaaactgacttttatccatatggaataatccactggcaaatttcttttaggacagaccaaagctgatctataacataatctttacatacttrgatccttcccatcagacgagaaagaacatctggggtgaaaggctccattagaagagcaatgtgggatggtsctgtsctgacaactggtagttcctgccctacgtctttgtagaggactggagcccagagcatgccatggtcaactcgtatgttgaagtgaagacctccttcgaggtgtgcatgtgcttattacagatatgccacggtgctaagtaccccaggactmcatgaaaaaataagaatagatgctgtatccatgatcatgaggcacacaggccagagcgccagctgggaatcgcacagcctgggttcaaagcctggctgggccatgaccacctgaatgacctgaggaatggtctcaggcaaatttgtaaaaagtggagaccctgcctgccagggaggcatgtggtaagaggtgcatccagtcaggtcagggcactgcgtcctctctttggaacctgcggagcaaggctggtggcccttgaggccacggcagccatggagaaggcgggcctggctccaggtggcacagaggcactggagaggccccggggaagcctggcgcgatctggctggtcctgcgctctgcttccaggttctggccctgtaacctgggggacagggccggccaaaacagggccactgggtgctagccagcacytgggccaggcgccaggtggaagggctctggcggatcagcytcgcacccccaacagccccacaggggggcccatccagggccacacacttgcccccaggagcaggatatccctgaggctagagtccagctggaccggtggaagggtctcaccctttgccctttgactcctcttgtaggcaccctcgctgggctcctaagcactcctccacacactggctctgtcaccagccccatagtgatgtcataaactcccagatgcccagtgtgcacccagccacagagaagtgggtgacttaggagyatcctctccgcttctgacccttagtttcgtctgtgcacaactcactcaaaatgggcaactcgctaagcgtattttgttcctggttctgccgcaggtcctggccatgccatcggcaacctgctcgtcttgtccgtgaggccttcccagctggccgggctcaccctgcagctcctgcacctgtgcctgcccggggaattgtgggccgtttcccactcctcttcaaccgtcagcgacatyttgggccttyttttccagtcaggtgggacggcgcccctatgaggctgtgtcttatccctcggaacacgggcaccccacagagggtcctgcgtcctgtggtctggagccccccctcaaggaagaaacccgtgctgtctcctcacaactccataatgtttggacacctcagccccgtaaggatcccttgtctcagaggcaagtttaaccttcaacttccttcattagatgatcaggtgatcccagccaggctcccgaagacggaggtgagcgcagaagagcccaaagaagcaacagaggtgaaagaccaggtagagacccaggggcaggaggacaataaaaggggcccctgtagcaatggggaagcagcctccacctctaggcccctggagactcagggaaacctcacttcttcctggtacaatcccaggcccttggagggaaatgtccacctcaagagcttgacagaaaagaatcagactgacaaggcccaggtgcatgcagtc

SEQ ID NO: 1768 - DNA, 1147 bp, Homo sapiens
ggcacgaggctctggccagggggaggaagcagtgcagaagtctcataaggtgaagaggagagggccgctggttagggtagagcagctgaggatagaagaaatgaaagtaattaaattgctagtcacctttgagctaggggttattatcctcattttagagatgacaaaattgaggctcacaaagactcggtgactcgcccaaggtcatacagcttcccagtgacgaagcccgggctccaacttgtttttctggctccccagtcagtgtttgcccagctctgccctgttccctcctagtcccttcacccactgccgcctggattcagcctggctgagagggtgaagccatgtggccttggtggctaatggtagagagaacagttgtcttgcttctcatcacatacttggtgcccgtgggagggagtgctgtgggccccccaggcccagggtgtaatgtcagcacctcccccccacccccagccacccgctgccccgacgagtcggaactataccgagatccgggagaagctccgctcgaggctgaccaggcggaaagaggagctgcccatgaaggggggcaccctgggcgggatccctggggagcccgccgtggaccaccgagatgtggatgagctgctggaattcatcaacagcacggagcccaaagtccccaacagcgccagggccgccaagcgggcccggcacaagctgaaaaagaaggtgggtgtagggagagcccagctctgccgtctctcctccctgaggaccctcgccccaacccccaggacttctggggcatgaatgatgctggctgccaaaggcctcagcttggctcactgttctgggaaggtctgaatgagtttgggaggcatcagggtcagggatcctgggggcaaataactggaggaaaaaacgtgtcatggcctgagaagttgcttgctggattcctccaagctgaggacttgcttcagtcagtcatttattcattcagcaaacacttctacaaatactggcagccaaagtgtgacacagttaagttctcacccagaagaagctgtccagtggggagactgacacaaaactggacaagcatattagcatgtgacctcgtgccgaattcgatatcaagcttatcgataccgtcgac

SEQ ID NO: 1769 - DNA, 1873 bp, Homo sapiens
ctccctgcaactaagtttttcctggggaaaaagcctgcagaccaggaagtgggaggtgtctggtgggacactgccctcaaaaggagcctttctgagtgctggggcttcatctgccagggctgcacctcagcaggcagtgggctcccagagctggctgcagtaacccgcaggctgtgccggcaggatgtggtctttggtttctgtttctgttttagttctgacttgtgccgtggatgtggctgagggcctagggtggggagaagtctccacaggtgggattgaactccccaggcacatggtccttgtggtgctggtggagagagagttcccagaggtttcggacatgctaccgttaaaaccttttcctcaaggtgataggtacgtgtcaaggtgacccctgtccgccatccggcagcttggaagaagccggtaagatggacagatcagggagggttggagggtcccgtttgtgaaggagctggggagggggaggcaaggctgagcacagcagcccactgtgatgctctcagtgcagaggccccggggggagacccaggggggcaccccccaaaaccacaccatacagtgagtttcagttcccccactcctgccctttcacttctcctcggctgcctggctgcctcacaggttgtcagcttgagcaagggcccaagcggcctctactcagagaccctggtggtcagaggggagtggggaaggtggacatgggcatcagcacagaccagcacctctggtccatcctgcctggtcatccacaggggagtgccagctcccacccccagccacatactgttctcagcttctgagtggctgggctgtcccagagggccatgctgggcctgagtgctgtccttgggcatatgcagatggtgttgtatccagggggttttcagggaagctttagcactttcatattaaaacaaaaaatgttggaatctccattaaatagtcaagtcttagggatagtagtaaaaacatggctgtacatggctggccaggcacagtggctcacgcctataatcctagcactttgggaggctgaggtgggagggttggccaagagcttgagaccagcctggtcaacatagcaagacccgtctctacttgatttttttttttaaagtacatggcaaagggcattataaagtaagatttgtattagcttgtagctggttactgatgttcataggaagggcctcaaccataataatggtgaaataataaaatgagatgaataaatattagagaggtagaatagtacgtagaaaggtttagcacacattttgtttttctgcacgaggtggttgttctctgctttcaaagtgctgaaacgaatgtcctacattgtctgccttccatgaggttctgaccgcccttgagaacagatgtacccactacagggtgaaggtgagaatgtaatttgaagctgaatgagaatggagctggattctaaaattatatcccctctcagattcacaagtgttcacacatttaggcaagaagccctaagtcctaaccctggacatgtggattgtccaggaccatcccagacttttgtggctggattaatcagacctgagcaaactggatgcaaagaggagggggtaggttccgggaaggggccctggtggccagggtgggatgagtgtctggtgctgagcccagagcccaggcccttgcaatgtttttcttggatctgctgggggcagtttaagctaataaaagcctcctcttttattcccagggacacatggaagctgcctcgtgccgaattcgatatcaagcttatcgataccgtcgacctcgagggggggcccggtacccaattcgccctatagtgagtcgtattaca

SEQ ID NO: 1770 - DNA, 1658 bp, Homo sapiens
ggcacgagccggcctgccagagccatgcccctgactcctcagcttcaaaatcaggggtctcaggacagaggatgctgggtgggctcagagctcatcaggggggctgtgtgtgagaggggatgccttctggatgccctcatcctcctcggggctggggtctccctcaaggccacccagctccttcctttgtttgctgctgctactcctgccgcctgctgccttggccctgctgctcttcttcttggacttcttccctcccagggcagctgtgtctcccttcttgccggaccactgctctgccaggcaacctagggtgtggaggagagagaccctcaacagaagtgcctcagggctggggtgctgggcaaggagcactgagcagggagccgtgggagtagcaactgggactgtgcttgacatcagcctccctgcctcctgcctctcgctgtggccaccaggcccctctgggggcatctgacttgtctgcccatcattctgcacctggtttcagtgactcttacttcaccatgtcttgccaatcaagcctttcaagggcagagatcctacaatgccctctggtgccctctgtttctcctcctacccacctcccccaagggagagcaaacaaatcatccagagccagcctgcccttgcttccccaaactcactggtgtcttttcccttcagcacgtggttggcgcagaggaattcagtcaggtcttcctcctggtggatcctgtaccagtcctcgatcacctcctcaaactcttcaccagcacatcacacttgttaatcataatacctcatattggcaaagccccagcacctgactcgctcctagaggagctcagcctaagcctcgcaacccactgcaaggtagcagtggcacggttcacctaaggaaactgaggccagagaggtgaaatgacctgaccaaagccaccccggcctgggtggacttcctcagagcagacccaatccccaccagcccttcactgggcacagcaacccttccaagggctgaagggcctgtacctgcttcttgaggtcagccacttctgcagaagtctcgttcaacagctcataggggatgtccatcaccaccttgacccctttgtgtaccaggttgtgtaatgtctcaaaggtctctgacatgccctggaagaagcgaccagatatggcaggcggagctcccttctctccctcccaccctcgtctcccagtggtggctaagaacccagctataagaccaatgctcaacgccctctaaggatcctcatccttttttttttgagaaggagtctcactctgtcgcccaggttggagcgtctcagctcactgcaacctctgcctcccaggttcaagcgattttcctgcctcagcctcccaagcagctgggactacaaaggcgtgccaccatacccggctaatttttgtagagttggggttttgtcatgttggtcaggctggtctcgaactcctagcatcaagttttccactcacctcagcctcccaaagtgctgagattacaggcgtgagccaccgcacctggcctcatccttgacctgaccttcctcttccctcttttaggcctgcttcccacaacccctgcacatataccccctgatctgcctctgcacacctcatcgcttcaaaaa

SEQ ID NO: 1771 - DNA, 1277 bp, Homo sapiens
ggcacgaggaataatcctagctctatctgcagggttttatcgtggtttccctgagtttaaacatgtaacaggggagcagaaggagggataaatgatttgtttatgctcaataaagatgttgctgctgttctgtcagctaacctttgctctcataacctgcataaacttgcaaagtctttatttattctcctaccagcaaattattggaattcatagtcatgtctaattttagttagcttagggatggcactcaacagggttataaaagggggagaacatctctctcattcctgaatttccaaggctgggattacggtaaagctgtgggagatcacagtaattgaggtttcccaggacactcccatagtgggttatgcttcccaaatctggctttctaagcataatggaatctggcctaacctgtcttccaatatttgagtctcttctatagcacccctgtcagagtggtttgtgttcttcacttgataaaaacttttttggggatgcatcattacagtttgagccaggtgatttcatcttcaggcagctgtgatagataataatacacaataaggaaacaacgaaacactttttaatggattagtaagtgggaatagatagggcacctgtcatttcattgttgtccgcatgacctgatgaggtagttaactgttagtgtcacttccattttcaggccaaaaactgggggcttggaatagtggagcaactccggcagtgccacacagctatgaaatatcaggtcagaaccccagggatactggatccaaaaacctgagaggaagctatatatcctttaacttcttcacccaaagctgaaatctgcttcctagttctatcctccaatgacccaaggaaaagaatctcttccgctacttgctcttcagatatttaacacaactttcaggccttcttttgcattcttttcaggccacaggacactgtttttcggtgttcgttcccccaacccccccaaaccacgtatttttctcatttggcttattgcagtagctctctaaaggtctgcctgctctgttccctattcttcacccagcagccaaggccacgcttaaaatacaagtcaaatcacttcattcctctgctcagaacacttctgcagtttttcctgtcacttgaggtaaaaccttaagtcaacttgaagattacagaattgaattgtcttactgaaattacctttccaaaatcgatggttcccaactcgtgccgaattcgatatcaagcttatcgataccgtcgac

SEQ ID NO: 1772 - DNA, 587 bp, Homo sapiens
gaattcggcacgagcttctttgcaggaagcccccccaggagtttgcatagtcaatctgtcatttgaaatcatttattcagtttaaagcattaccatcagagagtaagaaggaatctgtttataaggagattttagataatggggaaaaatccagaaaaaaaatttacaataatcttgctactgattataacatcatctcttgctgacatttctttaaggggttagtctagtatgtcaagcatatgcagctgcttggagctcttgatttttagaaatgaataatacaagagaaccaactaatgttccttagctcttcaaaccagtctagtacctgcatgaaaacattggttattttggtatccagttggagagcacagggccatgcagcaggatttctgaaaatcaaagctctcttcctgaaatatatggccacaaaggatgcatttctgggatctgatgtttcctggcttattcaaataataatgatggtgttaggaaacttttacaactataggcctcttcttttctttatgctcaatgcctcgtgccgaattcgatatcaagcttatcgataccgtcgacctcga

SEQ ID NO: 1773 - DNA, 1685 bp, Homo sapiens
  misc_feature (396)..(396): n equals a,t,g, or c
gcaaagatcacggttatggcaaggttagtttctggtggggatgctcttccttacttgcagaagcccacattcttgctgtgtcatcacatggtttttcctctgtgcttgtgcacttgtctcttcttcttatcaggacaacaatcctattggtttcaggcctgagccttataaccctatttaatgttaataacctttgtaaaagccctatctcatatcacattgggggttagagtttcaacctatgcattttggggacacaatgtagtctatatcaccttgccttatcctttgccacttagatcatcacatggtcgatgccttttcattactcaggtgttattctaatatcattccttggagagttctccctcaactattgcttaatcacagtgtatngtaactctacaggacatgtctgaccctgttcactcatcactaaaattactatatacaaccagaattgtgcttgacacatataatgaagcattgagaaaacatttgttgaataaatgttttcttctaatactggtttatgggcataactatttctgaatgtgtcctttctcaaaggtagacacctgagctttatgatccatggtgttatcctaaaaaacagaacacaatattattatattaagtataccactgaatatagcaattggtgtcttgaggagttacaacatgtcattmtttawataggttatcatattttttccagtaatcaccccagctatattaaaatgaaacttctcccctttttctctctaggtagcatcttccttgactctttcttagacagatgctataacttttcagctacttgagttattagtttatttcattatttattgattttaaaatgccaatctcaaattatactcaaaggtttttctacatttcccatctgtgatgacagctcttatagctttaarartactaggttgtgggtgggcttcaagacatctcttttcactcccacttctagatgccagctccatctgtgatatgacaagagcgggtaaatatcttcttacttgactcaatcagattgcagtcttcttttccttggttgttgcttctcaggctgacacttactctagatgtcctctgcatggttgggctcctaattcctgtaattctgaatggtctccakgtacttycttttagaatcacctaagaggtgttccacttcttgggtcactgaaagaggctggtcaagattcaaatccacttatttaatcactttattcttggttaaaatccaacaaagactgatcctagcataccttttctttgttttctgcctgaatgagtattagcaggccagcttgagcacagcagcattatttacatccatcatgcccaagagtagttcatatccttgcttcatcaaataggaggacaagttaattaccagaattccttatcttagcacctccatctctctgttggtcattgctttcatgccggggcagcaataaagtatctgtggatccaatgcctcactaactcttttttgtttctgagatggagtctcattctgttgcccaggctggagtgcagtggcgcgatcttggctcactgaaagctccacctcctgttttcaagcaattctcctgcctcaacctcctgggtagcctcgtgccgaattcgatatcaagcttatcgataccgtcgacctcgta

SEQ ID NO: 1774 - DNA, 1897 bp, Homo sapiens
ggctcttgtgagatgtggttgtttaaaagtatgtgggacctctcccctagcactctctctctcttgctcctgctctcaccatgtgacgtgcctgctcttgctttgccttctgccatgagtaaaagcctcctcagcctcctcagaagcagatgctgccatgcttcctggacagcctgcagaactgtgaatcaattaaacctcttttctttataaattacccagtctcaggtatttctttatagcaatgcacgaattgcctagtacacacagagactggcaggagctaccttaggtaacaaacaacagaaaaacaagaaaacagtgggaaaagaatatgcacagtaacttttgcacgttgacggacatactttgagaattaacaacccaaatcgagtgaaaagcctttaaagcaaagtatgggcatggagagaactgacctggctgactctgacccttctcaaactctgatctgtgacgtggatgcaggcaatagaaacatggagtgtggctgcctctgaccccaaggagagtgaccctggggtcttaagagaggagttgtggtgtctggaaagagtctgatcattggaggagacaggctagggtggagtccctgctccccatgctctaattgtgtttaccctgagaaaaagatttaacttctctgaacctcagtttccccatctgtaaaagggaggccataaaaccccacagaattgtcatgaagattaaaaacaacataatgcctgtctggcagctagtatcagtcaggcttccttttctcttttctttgtcctttcagggagccgtacccttggcctgactgaggccaggtttaggggaaaaggaagcgtgtctcaagtgccccggccacaaggtcaggcattgggttggccggccaccccagctccccacatgcagccagtctgcgtcagtgggcgtgggaaagagacgtaaacgctgaagggcactaaacacgagttagacatgccattccgaccaccaacacatttcaaaagtgcacatcacaaggctcttgttgaaccctggcggagccagggtcagaccacaaaaggaagtgtttcctcgctggagctgctgggcggctgggcgtggtcagagcgcccatcattgcagaatgcagggctctttggtgacttcctgtcctcccatccatttttttctcctatgggccctgctgcactgccctggtaatgccccagccagccagaaaagtcagcattcacctgacctttccctatgtcacagaaatggaaggtctgtgatattcacatgggccctgttgcagtggccaccacagccttccaggcctctaccttggctttttctccccttggagtataaggaaacggttattttatccacagttggtagcaatcacatttcgtctgtatcattgaggtctgaaaggcagccacgggccccagaggtggcagaaggtctgtgatgcagctggagtaagtcaggcctcgttcccagcagacaatctgcaaatatttattgagggtctgctctgcacccagggctgcggggcacacagagacgccccgtgtgagacaaggagcttgtgttctgactgggaaggccagactgacacacaggaaaccagggggtcctgttgaccctgagctatgcttttaatgcacgattgtgtggtaaggtgtaggccaaataccaagacattggtcttaggctccgtgatctggtgcattctcagaatctggagaagattgtagaagttaatcttgttttgcccaggggctttcctccaagctgcactaaatccactaaatccccacatggtctctagccccttttctctcattggtctttttgccctcgtgccgaattcgatatcaagcttatcgataccgtcgac

SEQ ID NO: 1775 - DNA, 1610 bp, Homo sapiens
ggcacgagatgcaaccttttcagacagggcttccctgatgaactcagattcctgtgcctttcctgcaggtctctatacctcactacaatggtggaacatcttcatctgacttaccattatctgaagttaccttgcatatttgcttgcttattactttattggttctctcctttactaaattctaagctccaggacagcagggaccttgtttgtttccttaaccagtggcacacagtatgtgcttaacaattgttggttgaataaatgctggataaataaatgcccccacctctattctcactcctaccatcctgtcctgcagacctgtttgtatttccaggacattccacactccttcagacctctgtgcctttgtacatggttccctctgctaggagggcccgttctctacaattggacttggaaagctcctattcatccttcaaaacccagctcaacgccacctcctccagggagctctgctccttccttggctttctcacaacaccttcctcacacgtctactgtgggattagctgttggtaggcctgaatccccaaggacattcaggctaggggctcccatgggcaggggctgggcctgaatcactggtgggttgggggtggagatagtcccagcacttggcctgagcacccagagtagctttgcagagggtgtttgctgagcactgctggacaataaggccttttgggcgccctgtgaaaaggggcctcacctggctagtgactcacccctgcagggtttccccacctcttctctgcccctgtagctgagtgagcttgtaaaaatgtaaacatgatcagctcactgcttaaaaccgtttcagagaatcctcatcacactgggagtaatttccaaatgctgaccatggcccatgaggcctgacctgtggcctctccactctctctatttcactgcagcctccagccagtcctgcttctgggcttttgcccctgctgtttcctctgcctggtgtgttcttcctcagatagtcacaaggccagctcctcctcatcacccacactcagcacacctttgccctgtttgttttcttcacacacttctctgctcaggaattttcacatcgcctccctgctcctcactccgccacaagctcctcagggctgggccttccctgcctcactcactgctgcagccttagtgccgggcccagtacctggcacacagctggtggccagaatgcttatcacctgactgattctttctcatctctgatgagagtgggcttcggtgttcagctttttagtaaaccaagtcactagaaggccaatgccatgagggcagggatgctttgtctattttattcgccgcagtctccccagggctagggttgctgagtgcacagtaggctcaatgtgtgtttgtgagagaaaaggaagggagttctcacttggggctgagctggctggagataccagagccaaggatcaaagtctctgagtcccttcagcctcatgaaggggacacacaggcatcccctgtgcatggcgacgggaatgggcccaacatcaggctgaagctcacctgacagcctcgtgccgaattcgatatcaagcttatcgataccg

SEQ ID NO: 1776 - DNA, 842 bp, Homo sapiens
  misc_feature (823)..(823): n equals a,t,g, or c
  misc_feature (826)..(826): n equals a,t,g, or c
  misc_feature (831)..(832): n equals a,t,g, or c
  misc_feature (838)..(838): n equals a,t,g, or c
gttgttagttgacatgtggtttgataagtcatttagatactattgaagggaaatataagcagcatatacagatttccttgggaaatctgtggtattaaattctttccatgaagattaaaatcattaaaatgtattttatttacttaaaatatattttattgactccaggagtaggcatgaatgagacaagatagaatgaaaaacaaaaacagctagccctctgtcctgtcttttgctgaggtcctctgactctctctgagatggaaaaggtgaagggtcaagcagcctagttcaggcacacgaggggactactaatattacatcagttaaaagtkgcaacatttccaaggagaattctacacttagatcagaaaataggcaagagcagggaakggycatagttttatttgkcacctcatttkgtccacaaccaaatgaatggataattgtccatgtcggtgttctaagtgctactcttaaagagcagttaattcagaggagtgttgggtggactgagatataccttaagtaactaaagcacacctaggaaccctgacattcttctgctttcctaggagaaggagagtcagagctaacaaattaattttaaaaaggctctgaacaagaattttatcaaattaccactttgattttgcctgctaggatgtcataacctagaatctcatcccttaatatataacagtttagtttaaccgaggcatttttcagcctatgagaccgaagtgacatctaacaaactggtcttattagaatttgcctgtatgggaggcctcgtgccgctcgtgccgaattcgatatcaanttnaagcnnacctantact

SEQ ID NO: 1777 - DNA, 1389 bp, Homo sapiens
ctgcaggattcggcacgaggatctgttgaccacagatgtaagaatttatttctggagcctcaattctaatccattgctctacatgtgcactggtttcctggggctgccacagcagaataccacagacttgggggcttaaacaacaaagtgattcctcacagttctggaggctccaagtctgagatcaaggagtcggcatgtttggttcctcctgaggcttctctccttggcctgcagatgaccacgttctcactgtgttctcagctggcccttctctgtgcatgtacatccctggtgtctcttcctccttttgttgactataaggataccagtcctgttggaccagagccccactgtaaaggcctcattttaacttaatccacttaaataacttatttccacacacagtaagtctgaggttgagtcttttgaattctgggggagacactgcagcccatcacgtatgttgacgtgtgccaccgccacactgcctggttactgcagagtgttagtaagttttgaaattagaaagtataagtgctccagttctgttatttttcaggattattagggctattctgggtcccttccatctccatatgaatttgagaatcagcttgtttattcctgctaaaatttagttgggatttttttttttttgagatggagcctggctgtgtcaccaggctggtgtgcagtggtgcaatctcgcctcactgcaacctccacctcccgggttcaagtgattctcctgcctcagcctcctgagtagctgggactacatgcgcacgccaccacactcagctaatttttgtatttttagtagagacggggtttcaccatgttggccaggatggtcttgatctcttgacctcgtgatccgcccaccttggcctcccaaagtgctgggattacaggcatgagccaccgcgcctggcctcagttgggattttcacagggctcgttttgagtctgcagatcaatttgggtagtactgacatcttaaaattaagtctaccgatccacataagtgggatgctagttaatatggacaagtgaatttattactcctccaaaaaactattttcacaaactttatatcaacatgagaaatcatgttgtatctttctacctggagggagcaagaaagtcaggtggtgtgccttttgtacatgggcaacccaatttcttatctagactttcttttgctcgcctggaaaaaaaaaaaaatgaggtattgcaaaaatgtgataattgctttccttagtatgaaaaactgttaaaatgagtaaagcctgtgctcaactagaattctcacatttccgttttgatgtatccgcatttcacctcgtgccgaattcgatatcaagcttatcgataccgtcgacc

SEQ ID NO: 1778 - DNA, 1728 bp, Homo sapiens
  misc_feature (921)..(921): n equals a,t,g, or c
  misc_feature (929)..(929): n equals a,t,g, or c
  misc_feature (974)..(974): n equals a,t,g, or c
  misc_feature (983)..(983): n equals a,t,g, or c
  misc_feature (1714)..(1715): n equals a,t,g, or c
  misc_feature (1719)..(1719): n equals a,t,g, or c
gattcggcacgagagataattcatcacccaggtaataagcataacacccaatgggtagtttttccatcctcaccctcctcccaccctccactcataagtaggccccagtttctattattcctttttgtgtgtgtccatgtgtacaaaacgttttgctcccacttatgagaacatgtggcatttggttttgtttctgcactagctcgcttaggataatggcctctagcttcacctacgttgctgcaaagaacatgatctcactgcttttatggcttcatagtgaaatgggaaaagttcccttgtccccctcgcagggtgtgcgatggggatgtgactcgcttcttcagtgtcccgctgctcaaacctctatggggggcatgcakacgggcaggctgtggggctccgaccccaaggcagtgtctaggggtgaagccccagtgggcgtgtgttacagggtgctctttcagtttagccgtccatakgcggcttgtgtactcagctcaattagacccctgccttatcgcaaggacagagggctttctgtatccctgggttcttgccttggtgtactggaagaatcggatcacacgtgggcttggagactgagtacaaggttttgttgastggaagtmctctcagcarttgggggagccagaagggagatggttttcccctggaatctggccattcagcagcgcaggctctcctcctccgaccctgtccaaactccatgttctgccggtcgatggcctgctgacctgccggcgtctgtcggtgtgctcttccactggcgtgttccccttgagtcctctggacgtccagccgcttgtgtctctgcccgctagggcgttgggtttttatgggtacaggatgggggcatggcaagccaaggtggtcttgggaaatgcaacgtttgggcangaaaacanaaatgcctgttctcacctaagtctgtgggcacaggcctgggggtnaaaccctanccaagggaacacgaactcctgtacccagcacttctctgccccccttccctatcaatagtactccgtagtttataggtaccgcattttctytatacagtctaccgttgatgggcatttaggtgattccatgtctttgccattgtgaacagtgttgcaatgaacatacgcgtgcatgtgtctttatgataagacaatttagatctctttacgtgtatacccagtaatggcattgcggcttgaatggtarttctgttttaagttatttgctgarttcttttttaatgggttkgtttttcatagtggtatggatgtaccaattctgaatcyattttatatttattgaagaattaagtgtgtaaatatgattatgtttgaagaagccagcgttctcactgtggaagaaaggaggcagaattatggaatggagaaaagaaaggaagatctctgtggtgttgttgaattggcacaggaggtctcagtatgaactcatgatttctaaaacaaacaaacacgtcaatagcgatgagtgtccctaatgcccagatcttagttggtttataatagaaatggcatcatctaactagagggaaagatgatgttgcaaagcgtggcactttttttttttcttctttttttgagacggagtctcactctgtcgtccaggctggagtgcagtggcacaatctcgctcgtgccgaattcgatatcaagcttatcgcataccgtcgacnncgcnggggggtcc

SEQ ID NO: 1779 - DNA, 1645 bp, Homo sapiens
ggcacgagccggtttcttgaagcagctggaagtcctggatagttcccacctgaaagtctgtttgcaaaggcaatgcgcactcaggcaccagagggcagaggggctcaagttccagggttttaaggtgcttggaactcccaggagcctggcaaaccttcatccagaacctcttcctcaagcaagacaaaaagctgctaagcactgctccctccgtctctgtgaagagaccagcttctaacagacggtgccgggctgaccccccatcatgccaggctggctcaccctccccacactctgccgcttccttctttgggccttcaccatcttccacaaagcccaaggagacccagcatcccacccgggcccccactacctcctgccccccatccacgaggtcattcactctcatcgtggggccacggccacgctgccctgcgtcctgggcaccacgcctcccagctacaaggtgcgctggagcaaggtggagcctggggagctccgggaaacgctgatcctcatcaccaacggactgcacgcccgggggtatgggcccctgggagggcgcgccaggatgcggagggggcatcgactagacgcctccctggtcatcgcgggcgtgcgcctggaggacgagggccggtaccgctgcgagctcatcaacggcatcgaggacgagagcgtggcgctgaccttgagcttggagggtgtggtgtttccgtaccaacccagccggggccggtaccagttcaattactacgaggcgaagcaggcgtgcgaggagcaggacggacgcctggccacctactcccagctctaccaggcttggaccgagggtctggactggtgtaacgcgggctggctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtgcgcttcccaatcaccacgccgaggccgcgctgcggggggctcccggatcccggagtgcgcagtttcggcttccccaggccccaacaggcagcctatgggacctactgtacgccgagaattaggcgcccaccgtgtcccctccagcgcgcgcgaagaagcttgggagtcgtggcgggggtctctcgccacccctttccggagagcctcccctccctccagacccggagcggcctctccagacctgccttcccagccgggggctgcgggcctcggaccccggctggccccggcggcggggaggggaggcgggggcctccggcggcgagatgcagaggtgaccctcggacccgctgccgttcgcgaaccctagcagaggactcagccaccgccgaggggagggtgaggcggccgggggcattaactgacctctgagtacagcctcgtgccgaattcgatatcaagcttatcgataccgtcgac

SEQ ID NO: 1780 - DNA, 2365 bp, Homo sapiens
ggcacgaggctggcctggctgcggctatgtgcgtgtgtgtgtgtgtgcactccagcctggctgtgggtgtgtgcgtgtgcactggtctggctgtgggtgtgtgtgtgtgtgtgcatgtatgcatgtgtgtgccgtgtgctccagcctggctgtggacgtgtgcttgtgtgtgcgcgtgttccggcctggctgtgggtgtgtgtgtgcgtgtgcgtgtgtgtgtgcgtgtgtgtcttggcttcaggggctgtgaggcccctgagagttggggctttgttctctgcacactggaaaccctcccccttctcacagatgcctggccgtggtggggctgcggtggggacccacttggtcttgctgagtgatctgtgacggctcgcggggtggctcaggtatcaggggacagccatgtctgtgaggactccggccccgctcagatgaggcagcccagcccgtcgcccagggtccggctgtgggactgcagtagggatggctctgcctaggtgggccgaggccgtgcggggctttaggtgagggctgggatctaactcagcgcaggcttcaggtgggagaaggggcagctgggccctcctggtgactcacatcacgtgagacaacactgtgccctggcctttccagtctttcctgcagctgcgcaactggacggcctccctgctctgctccgcaaccgacctccccgcccgtggcttcagcaaccagatcccgctggtggcgcgggggaactgcaccttctatgagaaagtgaggctggcccagggcagcggagcacgcgggctgctcatcgtcagcagggagaggctggtacggccctgtgcgtcccccgctgggccagctctcaggggcaggaggggggtgcaggaggcagagatggcagcagctggggctggtcttccgacttctcgctaaaggcagatccatctgtggggaggatctgggccgagtgtgaacatggggaggatccgggccgagtgtggccgtggggagggcggagatgagtctgttcttcctgagctgctggctggggctgtggaactttggccgtggtcttgttgggtgcctgtcctagagcagcccccaggggtgacggagaccacaccctctgtggggatgggattggggtggcttctgaggagcaggtggcctggccctgagctggtcctttctgggtaccctggtgcccttgccctctagccggtggggccgtgctcgcctgtgtggtcctagccaggtggcctgaagcctggccccttttccatcttctgtgaaatggggctgtggttgagagctgggggcctggcagggctggtcacagcacagggacatgccgactgctgggctgggcagggtgcgtggccgcccctgaagtgtagttttggagtaagaaggaatggagttcaggaattccctcacagctctgcctgtggctctgggctgcccccgccagtgttgcaccctgagcctggcaatccacggaggcctggtgcaggggctcagggccgagggcagagcaggccgggcagagccgagagtgccatccctgtccgcacacgctgccgtcgtagttgagagaggccctcagtgggtgcggggctcaaggcggcttagtgggcaggcatgggctgtgacaagtatcactcaggacttgtatgtgcggttcgggagtcccacggccgagggagggattagtggcgcttttaggcctggggccctgttgtcaggtgaagaaggcttgatgcccttcggcctccctgttcttgggtcctcctggggggccggaggctgtcagctgcagagggggagccagcaggcgcccccagcctgacccgagcctcgagtgagggtcccaggagaggaggcgaatgggcacagagctgggggcccacccactgctgcgggtgatgcctgccgctccctcctctgggcccccaggtccccccggggggtaataagacgcagtatgatgagattggcattcccgtggccctgctcagctacaaagacatgctggacatcttcacggtaggtctgcgccggctcagacccacgctcccgaggagatggggcagggggcttcgggctggctgccgggggggtttgtgcctcagttggtgggatcagggtggtgggtgaggcgtggcccctgcaggccagggtctccagccccagccccacagcccacagctgcacgtcgacccatggctggcgggtggctctgacgcctgcctccggtgtgttccttgaggcagcgtttcggccgcacggtgagggcggcgctgtatgcgcctaaggagccggtgctggactacaacctcgtgccgaattcgatatcaagcttatcgatacc

SEQ ID NO: 1781 - DNA, 1910 bp, Homo sapiens
ggcacgagtgaaggtctacaaaaagatccaagccatgatttgtttgcattagcatcactgcccaatccaaggtggttaaccagacaatcccagatgctaacaagtcaccaaccaaccagtctgatacatattctacttgtatctctctttctttcaaaccccctgtgttttggactgttaagtgtatgccccctacaaaattcttatgttgaagccctaaccccaaacatgacattatttggagatgaggctttgataattatttagggttagactaggtcatgatggtggggccctcatgatgggattagtggccttatgagaagagggagccctctcttcctctgcatttaccaagggaaggccatgagaggatatacgagaaagtggtcatctgcaggccaggaagagagcctcaccagaaacctaatcagctacacattgatctcaggcttcccagcatcctgagctgtgagaaaataaattcctgttgtttaaaccacccagtctacggtattttgttatgacagcctgagctgcctaagacaagttcatatttcacttgtttttctccttctttcaacccccttcctactcctttgatggggaagattccaaaatcccaaaggtagttccaaggcgaagaaaggggaaataaacagtcaaataaatagtcaaaaagtatgggtttccaacactggaaaaactgacaatcaaacttccttcaataaaaactggctatgcagttacgaaatgtgtttggaaagtcccaaaaagaaataatacagtattagaatcaaagagggttaataaagcatacattatctgaggtaaccacattcagagtaattaaaaaataaaactaaataggtatattgacaaggtatacgacaccctcccagcagcaagaaacatgagtatgaacgcaaataaatactatagatctatttatacagaaaccctcagcaattcttgtcgcagactgcctggcagccctcatgtcttcagtattctgtgccatgaaaaagtaaccgtcaaggataatagaaacataatttgacctacttttccctggattcctgcaaagtctataactccagttcttgtttattccgacaccacatcttggggacacatttcctcacttactttgcaggcaatcctaaatgccacacatgttaaggtcacttgtgggcaattcctaaactctctgggtcaccgactttaagaatgtcccatcacacacagagaatcctcagaacatcttctgagatggacctgggatggaccattttccacctgagatggaaaatgcctaggaaaagagagatgcagcctcgagaagctgaagaccgacatcagttcagacccttccctacccaaaggagggcgcatgaaaacaagtggttatccctcactctcaagtttacacaaacccatctctgaaagagctagaagtctcccagcaaggtcttgttttaagtcagacaagactgcattttaaaaattacagccaaacgggaaagaaaaaccacattgatgcagcttctcattaaagaccacttaataataaatttttaaaagatgagtagaacccaccaaaggtgccgccaaaccctggtgagcagggaaatctgagtaagtcagctctgtgtcctgaggccctggcggggcctcctaggtggcttcttaaagatcccaggagacaatcagcagaccttcctgcttctcttaaaaatacaaaacatgcctgacctgctcaggtcattagatgcacttagaactcaatgagggacactccttcaccaggaaatcgtatctgaacacaccatcaggaagtcaatattgaaggttcttgggggcgtgcacctcgtgccgaattcgatatcaagcttatcgataccgtcgac

SEQ ID NO: 1782 - DNA, 2898 bp, Homo sapiens
ggcacgaggtgggactgtggtctggcacgggcatttctgaagctgtggccacgccattgcagcacgcatcactcctgcacacccagatgcagagctcggtgagaacctcactgtgggcagtgccaggcacagcaggtcccacgtatttgagatgctcaggagccccagggcctggagggagacttttgggcccacatgccccatggttgggaaggtttgggcttaaccagggaataacatcatgcattttgcagctcccttccagctgcagagccagacgttccgatatgaagttggctccgtgcgtaaatcacagcaggtactcaaagcagtggttaccgctctccttattcctgctttctcttccctgagttcaaaagcctgcaaagccagttttgggaaaaaaaaaaaaaaaaaaagaaaagaaaacaaaacaaaggaaaaagaaaacccaccctagtccttgtggcgaggtaaatactgaagaattgactctggcatcctgaaatgtggtgtggcatcgtaacaggggaacaagaatatgggagcaatttaaaccaaacaagactcaaaaatgacagcaatcacggacctgaacacgacgcacaggacgatgactgtggatgtgggttttcccctttgattgctggcaacctcatcaatgctttgcctggagattccagagcacgagtggggtggaacacctgagacccaccattcagacatcctggaaggcctcaggcctcatactgtgtggcttagcgatccccaggccccaggccccaggcccagagctggagcagctcttggagtccagcctgtcctccaccagctgtgaaacactctcccagttatgcctctgggaggtggcttctcagtcctcatacccctgtcttgtagggtaagagaatacatacggggaactgacagaatgtggggaccccggagcatgcccagcgcagaccgatattgcttgaattgtgtcctgattgcagccatcaccacgattcctcattggctttggtggaaacctcatgtcagccacacatcctgtcccctggagtgtcaccacctggtgcttcttctgcacctggaatgccacgtgctctgctgggccttcaccaggtcacagggtcagctcaagcacggcctctttcataagagtttcctattttccttcctatttttcctctcctctgtctgtaacatgtgttcctgtatcgtcctaggttatttattcaacaaatgatgattgaacctcttttatgccccagagactgttctaggcactaagaatataggagtgaacaacacacacacactcacacacactcacccccacacactcccactcccacacactcccacacactcacacacacacagtcactcccactcacacacacacacacactcactcccactcacacactcactcccacacactcactctcactcccactcacacactcacactcacacactcacacacactcacacactcactcccactcacttgccctcatggagacattttattagaggaagacataagataaaaatctataagtaaactacatattagatggcagtaagtattaagggaccattttaaacaaggaaaggggataagaagtgtggccaacagtggctttactggaagctgacatttgaatgaagacctcacaaagatgggagagtttgctgggctcatcactgagggcaggatgtgcagcaggttcaaaggtcctgagtcagaacgtgctggtgtgtgtggggaggcagtgttgctgcagggaggtgagagccagcagtgacaggtgaaggcagaaagtgttgggaggctgggtcatatagggctctcgggcattttaaggactttggcttttaccccaatgagatggacagggtggtgacttgatttgacttttgttttattaggtgtcttattcagagtcattgatactgtctcagtggcttagtaaaaaaagtctcttttttgctcacatgtcacagtctgataaaaggccccctggatgggcctcctcccagccagtgcaggaatccaggctgcctgaggccggaatcagaggcctcagaataactgcagccagagaagagagatgggtcggggagcactctctgccttggactagaagtggcacatcgcttctgtgcgaggtccgttggcgagaacgtcacgtgcccaggctcactgtgagggcggctgggagcaccattgtcgcgtgtccagatgaggagacgatgtgttgcacacagcattgtctgccatatcaggaacgtgctggctgctgtctggggaaggggaggggacaaggcataagcgggaaaacgaattctccatgcgaagcaggtctcctctgcctcccgccgccctaccgtcaggagctgagagaacctcctggcccctaagatttctcttgagacctaacaccaaggccacagcaagtgcccctgcatcgtgccccaacagcgccaaccgcaacccactgtgaaagggccaggtgggtgtctctgaggatcccattttgcaaacgaagaaactggagctccagggtgttactggcgaatgacaggcacaaccaggacccaaactgatgcccgactgactcttcccatcaccatagagtgttgcagacactagtggcgtggcagggccgccgtcgatggctcttcagtgtgcagcagaagacacggccgaggtttgtgtttctcagaaggcaaaggcatgcatttcagggatatcttaagattatatcttcctagtttttttttcagtataacatgcccttgttcaagccccagtgtccagcccagcccaacccattatctcagctcgtgccgaattcgatatcaagcttatcgataccgtcgacc

SEQ ID NO: 1783 - DNA, 541 bp, Homo sapiens
caggagcaaggctttgtgctatatctacataatcttagaccctgttccttccaattccagggatatgctcttaaccactgcagtataagcctccccgcyacactctgagtggagcagaggaaggtgtttttgtctttgagaaaggcaaggatgaagggcaagatttgagccatggtggtagatcagaaagaagatctgataacaggcttagggatcaaaatggtaaggaaatggcttcaggggagtcaggcctggcccctggagagggaggagagggaagggctaggctctttatgtacatgctgtccatggggcctggtaagattcmtggaatcactaacccatttcacaggtgaggcaattgagcctctcagagctgaagtaactgacccaaagcatccgtgctcttgtgtggcagagccagaagtcaaatccaggtctctgtgamctcaaggggcaccaaartgagtatcaaaaaggcagaaagggacttatcccttcactcactcagcaaaagcatagtaagcaggtggcgtgcctt

SEQ ID NO: 1784 - DNA, 2118 bp, Homo sapiens
  misc_feature (13)..(13): n equals a,t,g, or c
  misc_feature (1324)..(1324): n equals a,t,g, or c
  misc_feature (1643)..(1643): n equals a,t,g, or c
aaataataataanaataaataaaaatwaagtgcttaktgtaactcagcggacagggctcccagctgctctggcacgtgggacaccytccaccctgcacacaacaggcatgcaaagaggactggatatggtggggtagagtgcttctggtgtgttcactttaagaaaacatctgccaagagagaagagtgcccaggaaagaccaggaaaatacaagtacatggctgcttcataccatataccccaattctttaaagcagcaaaaggcactttttttttcaggccagagtgaatctaaaacaaacctggctttgcttacagggaagctgtcccagaaggactgagtgatgcctcttgttccctaaggtctggagagtctttgcaagtttccaacgacatttccaaccaggtgggagagaccagcagttgacgagacaagtcagacccaaaaaacgacgccaaggtagtgagtgggtgcctatttgggagtaggatgatttgaggaaaacaggaagaaaaaccggtcagaaagtggcactttggaagtggaaagctgtttgcaaatagcaactctggctaaagcgaaaatgttaatcaagtagaaagtaaaattcaggatcttagaagctcatccttctgatgagaactatttttttttccgtgaaggaactattattactttaaaagtgagggtaatttacatatggggtgtatatattctaaaaatagtaataaaagtaccttttataagcaatgttgtgtggcttgtagaagaaagcagggaggaaaaaaaggcaggcaaaactagtctaggtctaggccctaaaaatgagcttccttcccacttgactggaaacgcccatgtgatttctaggctgaaaataggtaggatttaacgagtaacctagttcccttctgtctctgatttctgatcagctgatggagctgctagtaagaggggccgatcatgctcccagacgagtcctttggcctcttgctctccatcccaagcctgactccttcagcagcagccccctccttctgtgtccatctgatgcaggcaagcaggagcagtaagagggcatcccatgttccagttcaccttctatggggtgactargaggttcccggtaactagggcagcccargcccagcaggttgcaaaagcagctgcaagcttcagaaacccacttcctccaacaccagggaggtggcagagagcccatccaaaagcccactgggagaggcataagattctgtgccaggcccccaggtcccctctgtgtcaggtaggctctgctactggcctctgaagtaaaggcaaanacaaacgggcagggcagggtggcaggaataaaaaactctggacagaaacccttttaataaaggaaattccacccctcccaatccttccatggaagggtgagaccttaatgtgatgtaagaggaaggtcttctctggctttcagggaaacagctgcagctgaaacttaggggcccattccagggcacttttcaccacagccagtgcagccgctccaagtgccactgtcagccccatcactgccaatttcacaaagcggttggtccttggcttggtcaggacatcttttgttcgatcttcaggccgcagaagtccccgaanaccgctgccgcagcaccatatcaggcctctgctgggctgatgccagctcaaagtctttgaaagtagaggctgccgtcctctcagcttgctgttgggcagcggcctcccgagcaagttcggatgggggaaactgaacaaaaaggtctcctstctgctgatcagtgtctcatagggcaagtcctgagggatctgggacaacaggtggtggaccgaggccatgtcacagtcacagtccaggacttcctgctcgcgatacaacacaatcacggctgcaaagtaaatcggcatcagtgggtggcaggccaggaagaagtcatataaccgcacgacgtgcctgaagtcagacaggacatgcccaaaccaggtgatgagccagctgagggcaaagatggtccctacctcagcactctgcatgaagtcatggagctctggattcacctggtcaatgatgggcatcagatagtttaatatatgc

SEQ ID NO: 1785 - DNA, 1571 bp, Homo sapiens
ggcacgagaggagtctcgcctgctttgttgggcctataaagtaatcgcccatctttgggatttcttaaaagcagttctgccagtttccggctccttccacgaatagcaatatgcaagggagtatctcctttcttatctacagcagacactttagcacctttgtctagcagcagctccaccacttcaatgtttctcatcttggtagcctttataagtggcgtttcaccatcctttgtgcatatttcagtgtcaggattgcactgtaagatatctctcaccattgttgcatttcctttctcaacagcccaatacaaagcagttttattatcctagataattaaaaaaagacacaaacaaaccaaccagagggagaagagcccctgcccactgcactctttggttctctgctgtgcctgcctgtgtcctgaggaagaagccaggctgttcgcggtggcctctggggacctgagccccgggggccccatcggcctccagaagggacgctggggtcccgagcaactctgcctccatccacgtgggaagcggaccctcctgccctcagcttgggtttgggggcctcagtgcaggacatctggcctgaacatcgactgtggggacagccctcgccctgccaagcactgcggccactcagcagctatgttcccgccgcagtggggccctgacgcccacctcccaggtgcccctcgagcaaaaacctctggcgcctccaatccagacccaccacagctggagggccaggcctcctcttccccaggctgccacccacgctggcggagctcagggctggggacttgtccttctcttccaacgtaggccactcagcaactggcatggagggcccaggcaacggagacgttttctccatggcaggacagagcgggaggccgggccttgggccacaggagaccagctcagggcggaaggtcaggctccccgccccctccacgtggagacatggccttagggggccaggcccggctccacaggagtctccttcaggactggtgtggatgtccgccgcttctttcttgtttaagtgatgtgatgtctccgaggaggggagagaagactttgtttccgactcatcaccctccaagagggcagcgctcccagtggtgggactcagcccagactgccctggggcagcttcctgggcccgctgcgctcagagggtgctggttggaggccagagctcggcagagtcacccacctgcccttccccaggacccctgagaggggcttattggtgatggctgtgggaatcccccacttccaagatgtgcccaggatgtgaggagctggagtggaagctgcacctttgggaagaattcctctccagacctggcagagcctggtgtggggtctgagacggccggagaacctcccaggcagggctctgtgttttgtctgttacaacctccgtatgacgccacgccacccgctgttcacgtcccgtcggcctcctgcacagcccacacgtgcgcctggaaggcccctgctgtggagaagctcgtgccgaattcgatatcaagcttatcgataccgtcgac

SEQ ID NO: 1786 - DNA, 953 bp, Homo sapiens
  misc_feature (952)..(952): n equals a,t,g, or c
gaattcggcacgagaacaacctctgccttgccccttctccaccttcaggtccccttcccagatacaataatttttagctttttatttttaattattctggttgttacctacataactctgggcaatatggaaaagttattgattttgtatattaatttcataatcagttaccttgatgaattctcttgtttctagtagtttttctttagggttttaaagggatacaatcataccatttgcagttagtaaccatttatctcctcttatttccaacttcgtactgttttctcttgtctaatttgtttttaattggtgggtacttctagaacaaggttaaataaaagtggtgttggtgggcgtccttatttctgatattaatgggaatgagtataatgtataaatatataaccatgattttggtttttttccaagtttttatcagtaatgattgctgagttttatcaaaatttttttggcatccattgagaggattatatattactctttgacacattaatgtggttaattaaagtaaccaacttattaaccttgaaatagtcttagttaaataamccctacttgtcaatgctatatcattattttaatattgtactgaacattttacaaaggtgtttcaccataaggcatattgatctgtaatttttttttttctgttgaacttgctattgtcaggttttggtgtattatgttggttttggagaataaatttaaaagtttcctttatgttatctatacattgcctgaaaagagtttaaatagcattgaaaatgatctcttctttgaagatttaaccaatttcacctgtaaatctgtctgtgctttgtaattttggtgatactgttgactcaaattccaaaagcagtaaatgcagtgttttatatttttctattaaaaatgtaaaatcaaattataaaaaaaaaaaaaaaaaacnc

SEQ ID NO: 1787 - DNA, 750 bp, Homo sapiens
  misc_feature (749)..(749): n equals a,t,g, or c
gagctgcctgatggaaagaagagaagaaaggtcctggcgctcccctcacaccgaggccccaaaatcaggttgcgggacaaaggcaaagtgaagcccgtccatcccaaaaagccaaagccacagataaaccagtggaagcaggagaagcagcaattatcgtccgagcaggtatctaggaaaaaagctaagggaaataagacggaaacccgcttcaaccagctggtcgaacaatataagcagaaattattgggaccttctaaaggagcacctcttgcaaagaggagcaaatggtttgatagttgatgatggcagcaggctgggtaagaagctgggttgtgtactttctggtgacactcctgggctcctccccatcccccgtgtctctcactgagggaaagaaaatccccaagggcactgccactgtgctcggaggtgccctggactgtgtacatctgaactttggtccatcctttgatgtgtggttcgttagccacaaagagaaatatctgaaagtcaacatgatgcttcttgcatattatccagattattgtatgaagttgtgtctataattattaccaatttttattctttatttctcaaatggaaacacctgaaaaagcattctggagtgctgaatttttaagatgtatattttgttaagcatattctctaaatgagatattgtgtggctttttagtaacaacgtcatttctaataaaaaaaaaaaaaaaaaaagaaaagaaaaaaana

SEQ ID NO: 1788 - DNA, 2211 bp, Homo sapiens
  misc_feature (2181)..(2181): n equals a,t,g, or c
ggcacaggaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttgaaaaaatggaagaagggaactcgagatgttggtatgcagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatgtctatactgccaaaaatccaagaatcacaaccaagatctggtttgttacagtcttcagtaattacagtctacacaatgtatttgacatggtcagctatgaccaatgaaccagaaacaaattgcaacccaagtctactaagcataattggctacaatacaacaagcactgtcccaaaggaagggcagtcagtccagtggtggcatgctcaaggaattataggactaattctctttttgttgtgtgtattttattccagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacaggtatgaaccctctcgtgagatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccaytattgggcttattctctgctctatagttgtgaaatgaagagtraaaacaaatttgtttgactattttaaaattatattagaccttaagctgttttagcaagcattaaagcaaatgtatggctgccttttgaaatatttgatgtgttgcctggcaggatactgcaaagaacatggtttattttaaaatttataaacaagtcacttaaatgccagttgtctgaaaaatcttataaggttttacccttgatacggaatttacacaggtagggagtgtttagtggacaatagtgtaggttatggatggaggtgtcggtactaaattgaataacgagtaaataatcttacttgggtagagatggcctttgccaacaaagtgaactgttttggttgttttaaactcatgaagtatgggttcagtggaaatgtttggaactctgaaggatttagacaaggttttgaaaaggataatcatgggttagaaggaagtgtttgaaagtcactttgaaagttagttttngggcccacacggttggctcacccctgtaat

SEQ ID NO: 1789 - DNA, 724 bp, Homo sapiens
  misc_feature (641)..(641): n equals a,t,g, or c
  misc_feature (693)..(693): n equals a,t,g, or c
gttctaaaatatgacccccgggctgcaagaattcgcacaggaragtggcagcgggggctgatggaagtgcagtgggggctggagagggcaccctagtgagttggcttttctctccttcggtgcctttggttgggctcgaggcccggggtcggaggccatcaggacaagagtgtgggacttggaagggcagccacctggagcttggaaggggctgtatccagcatgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgtctacttggctgacctcctgatgcctcacttgggtgcagcagaagacccccagacggccctggcactgaacttcggctctacgttgatgaagaagaagtctgatcctgagggtcacgcgctgctcttccctgagaggattcatcngatagacaagagtgagaatggtgaggcatatcagagaaagaaggcggcagcnactggccttccagagggtcctgctgtcccct

SEQ ID NO: 1790 - DNA, 1378 bp, Homo sapiens
gatctctgtgtttacctgtataaatattttccctgttctttttatgacttgtatatttctggtataggtttgttgcaaatggttatttaatcttgactaggtgagaagtcatagaaattctcctaatttcaacatctatttattcatggatctatattatttttgtgtgggagaaaaacttttctatttaaagataatttacaaacgatcataatctcttttaggtatgtctatttttacttgtcaaaaacacataacatttacaataggatattttgaaatgtttattttagtcctattatattgacattgttatgcaacatattcckaaaakgttttkgtcttgcaargctaaatatcaatacccattaaaaaactatggaattttacccatttcctgggcacttttcaaacaccactctgttttctctaagagtgtactggcttcatatatctcatacaatctctgtctttttgtgactggctcattttattttgcacaatatcatcaagctttatagttgttagaatattttctgctttttaaatactgggtgatatttaagtattttgtattttagattatatctactgagtaatttggkgacaaatttgcackgcttttacctattggctttcagtaacaatgctgcaataatkacmggtatgcaaatgacctatatgatcatatatgtgtaagtttatatatgtgccgcattctgttctactagtgtacgtttttacctttgtactcataccaaattgttacaattctgtagctctgtaatgtgtttcaaaatcagaaactgtaatgccttcaaaattgtttattttattgcagatttttgggtactttattatctcttaagactttatatactttgggggttgctgtttctatttcttcaaaaatgcatgagaaattkgamcaacattgcattaaatctgtaaattacattgagcaggatggacatcttcacaagattaattattttaacatttcaacaagcatgctcaagagtgtattgttttaatttctatgtatttgtgaatttttcagttttttcttcttactgttctatactcatttcattttggtcatataaagtaatccataaaaatttagttttaaataatttgttaagacttcttttttggtttaccaggttttctatcaaggagaatttcgtatgaggtatttagaaggctgtttatcattatgttgttgagtgttctttatgcctctgttattaataattgttttatactcccttcaagtccggtttctttaccaatattttgtctttttaaaatctttattacagaaagtgaagcattaaaatattctactataaaaaaaaaaaaaaaaaaaactcga

SEQ ID NO: 1791 - DNA, 2012 bp, Homo sapiens
  misc_feature (1468)..(1468): n equals a,t,g, or c
aattttttaaaagcaattttaggttcatagcaaaatttagcagaaagaacagagttcttatataccctttctgcttttccccaagcctcttgcactaataacgttctgtaccagagtggtatgtttgttacaatcagtgaacctagactggacacctcattatcacccaagaccaaggtttacgttaaggttcgctcttagtgttgtatattctatgagtttgacaaatgtttaatgacatgtatccaccatgatagtatcatacagaatagtttcactgccttcctctgtgctctgcctgttcatccctcccttcctgctgatcttctattgtctccatagttttgtcttttcccaaatgctgtatagttggaattatcatgtaacctttcaaatggccttttcacttataatatgcgtttaaggttttctacagtcttkgcaggcttgatagctcatttttctttagtgctgaatactattccattgtttggatgcattacagtttattcattcacctactgaaggaaatcttgcctgcttccaagttttgtcaataaagctgctttgtaaacatccatgtgcaggtttttgtgtggacataagttttcaactcatttgggtaaataccaagcagcacaattgccgtgttgtatagtaagagaatgtttagtttcataagacatcaccaagctgtcttacaaagtggctgtactattttgcacttccaccagcaatgaatgagagttcttgttggttccacatactcgtcagcatttgatgatatcagtgttttagattttgaccatttaataggtgtgtagtggcatctccttgttgctttaacttgtaattctctaatgacttataatgttgagcatcttttcatatacttatttgccatttgtgtttcttcttcctttttctttttctttttctttttttttttttttttttgagacagggtatcactctgtctctcggactggagtgcagtggtacggtcacagctcgctgcagcctcgatgtcccaggctcaggtgatcctcccatctcggcctcctgagtagctggaactacaggcacatgccaccatgcctagctaattttttatatttttagaagagacaggtttcgtcatgttagtcaggctggtctcaaactcgtgggctcaagtgatccacccaccttggcctccgaaagtgccgggattgcaggcatgagccackgtgcccagccaatcaaatgagaaaagggcagtctcttcaacaaatggtgttgggaaaattgaatatccacattcaaaagaatgaaattagatgcttaccttaaactgtatacaaaaattacctcaaaaaagatcgaagtcctaaatgtaagacctaaaactataaaactcttagataaaaacataggaggacattggatttggcaatggatttcttgggcgtgacaccaaaaacaggcnacmgaagtaaaaatagatggatgacatcaaaatttaaaacttctgtgtatcaaagaacacattcaacagagtgaaaaggcccataaaatgggtgaaaatatttgcaaatgatatatcctgtaagaggctaatatccagaatacataaggaaatcctaccattcaataacaaaaaacaacctgattttaaagtgaagaagtcaagaaaataagatagactacatactgggagaaaatatttgcaaaagatatatctaataaaggactgttatccaaaatatacaaaagaactctaaacgataagaagacaaatagcctgaataaaatacagcaaaagacttgaacacataccccactaaagaagattcacaarrttgggtgcagtggttcgcgcctgtaatcctaacacttttggaggccaaggtgggagaatcgcttgagcctgggaggtcggggctgcagcgggctgtgattgtgmcgctgcactccggcctgggcaacagagggagaccgtgtctgaaaaaaaaaaaaaaaaaaacctcgag

SEQ ID NO: 1792 - DNA, 2749 bp, Homo sapiens
gccgctcagtgccctggacaggagatgctgtgttaaactgttaatggatatctatatgagaagctcatttttgtatgctatccctgcagtttttttttttctaacaggcccatgtttgagaataaacaagtctgtgatgtcagagacaaaggtgtattcttcagtctgcaggtgtgtggcacctcccttctcccctgcagccccccacatccagagccgttcctgagagtgacatcatgcatcaagaaaacataaccttggtcctcaggtgaacccttggaacattctgtgaccgcctgatgtccattctgagccaccttggcacacatgcttacaggsagcactgctaagggttcaggtgccccatggctgacagcccgagttgcttctgtggaccatcatgccgctcggcacgtcctgagacagaagttgctgcaggaaggagcttctggagaggtcctgtggcatgtgtgggggtgtgtgtgtgtatgtttccttcttgaacagacattccaactttagatgtgtttatagaactgacctttttactaacaaaatacaatgatatatgttggaaactacttaatatgcttttcctgcacaccttagcaataactgtaggggtctctgctagagttgtttgtatgtacagcaattttgaacaaattgttttaaatgtaatataagagaattagtttaaggaagtaaagagaatcatttgcttgtgttacattttcagtgaggattcagtttaagagtcattcttaggacttccatttcctaatatttattcatgggtaatgmagaaatggtttgcattttgtggccagtcctaatttattttccagctgagccctaacttccggctcccacctacctccacggacttcctaacagagacttatgaataccaggatgtgtttttgttaagtcaggttcaattcgttgcccctgtcagttttatagagtgtgagggtcactccattaaagatctctcctgggtggatcctacttggatgttcaggtgattttgaaaactgctaacatttttaaaaggctagaacatcctttgacttcttgaaaatctgcatgtctggcttgggttttattaccacatgcctgagttcttcaagaatggaaggctcaagtattctcatcttccatttgccaaacttccttcctgatttgagtcacgtgttccacttggaaagaaagggaacagagagcctcctccatggacagtgtatgaatttcattgggaatcttgctctctcccgcctctatgcctttctctctttttaaccttactttacataatattatagatgggccaagaaaagaaaagatgacataacattttgatgaatttcacctattccattcttcacgtttcagaattggtcgactttgttagaagataattgaagtagccttgggtcaaaagcaaccttttcaattgtgatcatacctaaaacatataaaaaccctgccgtagattaaaagcaattataaaatcataaaattgaatgtttgcagaatcctggagcagtagatttctttgtctttggcctgcggactagaaagagggcagcagtagtatgctggagcttccctgggataccagccacatggtttcttttcattagatctgatttttgtttcccactgtagatctgattttgtagttgaaaacatttcaccaccatcaaacactatttctgaatattgtgcctttttatacctagcctagatgaaaaccgatgccattcttattcagaaaatccccccatcctacatgactgttatctagacataaagcaaagtgcatttaattcaaaatttggttcacaatataagtattttgtaaaagccagctgaaccagcattttatcaggtggaaatctctgcaagccaaattgctgatactccttcatgcagatcaacttggtgtcccagtcagaatagaacagcataattacctggagttagggggagtatttctgcactattacttgtcagggagagaagaaacttagaattgtccctcaaaggagtgtcaagaagtatgaataaatgtcctttcaccagctcacaggccagaaatggaggacccaagtcaactaggtgaaactactagcagacccagctttcccataataacctaatctgcaaattgttctattaaagtctcattgttttcaggatgcaatgaaagtggatttcaaaaggctttggaaaaataagtggaacatgactgatcttgaaaaaaaaagcaaaagcttaaatatttgatacaagtttacttagctacaacatactttacattgttgcctttagttatctcacaggcactgacattttatatttagaaaatacttttaatctttctaatctttttttgtaaatattagtgtccattctgtatgactcgctaacctactttgcaaggctttgggcaacattttagctcattaacttcaagatgatgtgtcatctgtataggtcaaagaatgggacttctgaactgaggaatttgctgttgacagccaaagtatagtgtacaagattgatgtaacttgatatgtatttttgttgaagttttttgtaaaaaaaaattatttacaatgttatttgaatgatttttttaaatgctgtgaatctatatttgttgttttrtatattaaaattcatttgccaaaaaaaaaaaaaaaaaaaaaaaaaaaaaaaaaaaactcgagactagttctct

SEQ ID NO: 1793 - DNA, 563 bp, Homo sapiens
ggcacgagataagatcgccttaataccagaaatgattagaagtgctgatttagattcaacaaataccatatgtccttatcattttttgtaagaagaaattggttaagtcctaactttcaatgtgtacccaaatacttgtatttatgcttttgataaaatgtattttcagcattaatacacatccgattatgccttatttatatatgaagaataaagttaccatgttatactgttatgtcctaaaattcaaatcactatttgagaaaccctcaaattggtgctttcattatataatgatacatttagacaaaaccccaaactaagccatttgaaacaagattctctccattgcagtttgtagcaatgttatttctgtgtatgtcatgagaaggctaaatatcagtgttaatttcttgtttgaatccgtgaaatcatgcctgtaaagcccaaacatttgtaacaaactccctaataaatttagagaaagtcaaaaaaaaaaaaaaaaaaaaaaaaaaaaaaaaaaaaaaaaaaaaaaaaaaaaaaaaaaaaaaaaaaaaaaaaaa

SEQ ID NO: 1794 - DNA, 1244 bp, Homo sapiens
ttttgaaaatttgttgatttcttacttatataggggctaatatatactgtgaccaaaaaaatctttataaacaagattgggaggtttaacataaacattacctttatttatctcatttttaggcgactgagtcaaagaccaacaccagaagaactagaacaacgcaatatattgcaacgtgagtccagttatggaaataaagttgtatagattttctttgtatgtttctgactttaatatacataaaagaaaaaagaagcgtttgctacaagggctaagggagagtgttccagccaggcaaggactatttatttccccatgaaggaacagagcttaccaagcttcctttggaagatgctattatggtattgtttagtgtgctgtgatactctagaaagctttgtttcagtgttctcactgtatcctggaactgccttgggcatttgggaggctttgacagtatatgggagatgtgcccaatttttctgttttcagggagctaaggaggtagctgtgcatatggagaccttcctattcctagaatgtgagggctggggcccaaagcaagtcccaaatgcagcagcttttctcttggtttaatcccttaagactttcttacctctgtagttaccaaatgggaycayatatttaatttgctgtctgtgtacataattaatttcctgaaatagcattctaatctagtacatatttcatttgtttttccagaatatagagtgaaatttggccttaaaagtctcctcactgagaaggtttgggcttccttggggctatttgtgagcatgttcagtctgaccaatccatcccctgttctctcagcactacttgggtatacacaacttaataacttagtacattttctagtgtgggagcccttataacgtatcacacaaaactcagtgtgatcaccattgtccattcttagcagttactcttgagcaagaatctgcaggcttttccttaaagcatacatagtaaacattttgggttttgcaggccaaaaagcaaatgaacaactatacgtaataggtccttacaaaaccatttaaaaatgtgaagactattcttagttcatgggcaggaaaaatacaggcaactggcgagatgtggtgccatagtttgctgactcttgcttttaagtatttgtatcgttgacaagaaaattgttttgtttagccatccccaaagttagtattttattctgatttgggcctataagaaatatc

SEQ ID NO: 1795 - DNA, 1274 bp, Homo sapiens
  misc_feature (5)..(5): n equals a,t,g, or c
  misc_feature (1258)..(1258): n equals a,t,g, or c
ctacncggaacaaaatctggagctccacccgcggtggcggccgctctagaactagtggatcccccgggctgcaggaattcggcacgaggagccatcttgcagccgtccatatggcagcctgggtcttcccgttgctttcagtcatccacacargtctgccacaggccagtcctgaaatctgggtaactcagtcagaaggtggtgatcagggcgtagcttgtgaargggttgggggtgtgttragcacactggatcgtattgaattgtgtttcctaagtgaccgtgctagctcaggctgcartgacaaascaccacagactggggtcttattcctgggggctggcatttgccatgaaggtgtgggcagggctggttcctcccgagccctctctcctgggcctgcargtgccgtctttccgtcttttccctgtgccttcccggggccatcctgcgtgtgtctgtgtcctcggctctcctggaramcctaccgttctcaaggaccctggtcatattggatcagggccaccctaatggcctcatgtcactgcagttacctytaaaggccgttaaagtcccmagctccaagtatawtcmcattccaaggcactggggtcgggatttcaacttwcgaactctgagcggragatcaattcaggccatggcaggctaaagtataatactaaaatcacaaatgtagcagcctgcttttccgtagaatgttgctgtgtgtattttttgttttctgtggcaaaataaaagtgggtcactcttgtaaaatttggcagtttttaatggagaaagcaacttaattttgctagcctttaagaaatggcatcttgacatatcaggtcttcattttattccaacaagaatgcagaatatgttttaaaaataaccaagaatccccttagtgcttcataaaataagtgaaaacctgaccctgatttttgtagcaaaaaatgaagtaaacgtggaaaatgaagaggaaattctagtaggagacgatggggtcataagtcagaaattaaagagttgtttgctccccaccctcccgccagccctcacctcacccctgctgtggggcctctgcccagcctgggccaaggccgtggctcccctggtgccatcctgtccgcagtcggctccctgtccacggcgtgtggctccttcaggacatcagtcacctgttgtccatgtggcacatcctcgtgccgaattcgatatcaagcttatcgataccgtcgacctcgaggggggnccggaacccgggtcga

SEQ ID NO: 1796 - DNA, 2877 bp, Homo sapiens
gaattcggcacgagacaagatggcagtcaacagcttcccaaaagatagggattacagaagagaggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcmgcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaagggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaaaaaaaaaaaaaaagggcggcggctcgcgatcctagaactagcggacgcgtggg

SEQ ID NO: 1797 - DNA, 1500 bp, Homo sapiens
aattcggcacgagcatttgctaataaggccctgccaggctgggagggaattgtccctgcctgcttctggagaaagaagatattgacaccatctacgggcaccatggaactgcttcaagtgaccattctttttcttctgcccagtatttgcagcagtaacagcacaggtgttttagaggcagctaataattcacttgttactacaacaaaaccatctataacaacaccaaacacagaatcattacagaaaaatgttgtcacaccaacaactggaacaactcctaaaggaacaatcaccaatgaattacttaaaatgtctctgatgtcaacagctacttttttaacaagtaaagatgaaggattgaaagccacaaccactgatgtcaggaagaatgactccatcatttcaaacgtaacagtaacaagtgttacacttccaaatgctgtttcaacattacaaagttccaaacccaagactgaaactcagagttcaattaaaacaacagaaataccaggtagtgttctacaaccagatgcatcaccttctaaaactggtacattaacctcaataccagttacaattccagaaaacacctcacagtctcaagtaataggcactgagggtggaaaaaatgcaagcacttcagcaaccagccggtcttattccagtattattttgccggtggttattgctttgattgtaataacactttcagtatttgttctggtgggtttgtaccgaatgtgctggaaggcagatccgggcacaccagaaaatggaaatgatcaacctcagtctgataaagagagcgtgaagcttcttaccgttaagacaatttctcatgagtctggtgagcactctgcacaaggaaaaaccaagaactgacagcttgaggaattctctccacacctaggcaataattacgcttaatcttcagcttctatgcaccaagcgtggaaaaggagaaagtcctgcagaatcaatcccgacttccatacctgctgctggactgtaccagacgtctgtcccagtaaagtgatgtccagctgacatgcaataatttgatggaatcaaaaagaaccccggggctctcctgttctctcacatttaaaaattccattactccatttacaggagcgttcctaggaaaaggaattttaggaggagaatttgtgagcagtgaatctgacagcccaggaggtgggctcgctgataggcatgactttccttaatgtttaaagttttccgggccaagaatttttatccatgaagactttcctacttttctcggtgttcttatattacctactgttagtatttattgtttaccactatgttaatgcagggaaaagttgcacgtgtattattaaatattaggtagaaatcataccatgctactttgtacatataagtattttattcctgctttcgtgttacttttaataaataactactgtactcaatactctaaaaatactataaaaaaaaaaaaaaaaaaaa

SEQ ID NO: 1798 - DNA, 590 bp, Homo sapiens
  misc_feature (12)..(12): n equals a,t,g, or c
  misc_feature (27)..(27): n equals a,t,g, or c
  misc_feature (30)..(30): n equals a,t,g, or c
  misc_feature (35)..(35): n equals a,t,g, or c
  misc_feature (76)..(76): n equals a,t,g, or c
tatatatagacngttaatagtcgtgantgntgtgnacgaacattaacggaagtagcatgtagccagtcgaataacntataaggacaaagtggagtccacgcgtgcggccgtctagactagtggatcccccggctgcaggattcggcacgagctgccaggtgaggagcagagagactgttcccttgggtggagaggtgtgggcatgagagccacccattgccaagcagcaagaatgttcgtgcttttttcccttccaaaatatgcagggctcaggctcccaattccgggcctgtctgctttgcttgtgtttctcctgtccctgttctcccggagggcccaggtggaactcacgacagggagggagacgcttcccaaaaacctgcagggctatttcccagaatttggttttcaagtacaaaactttttgtcctgtaagatatatgcagcctcacagaagcagcctctgcctccactttaccagctacgtttttatcttaagcacatggggctcccttagaacttactccactgatttaaaaaaaaaaaaaaaaaactcgagggggggcccggtacccattcgccctaaaagt

SEQ ID NO: 1799 - DNA, 3283 bp, Homo sapiens
cccacgcgtccggagggccaggcagtgctggagtgcgtttgctggcagggtttattgtgggagaggaatttgagtttaggatctgaatcttgtacataagaaatgaaaaggcttccctccaccccgcccccaaaatatgcccgtcctgtatccatgagagtgcatgtcggttctcagtgagggtcagagtgggggtgggggatgtaaggcctgggtccctttcagcggcctctagggcaggagcgtgcgtcttcttcccagtgcagtggtggtttgagtgctgtgggctctggtggggagggggctctgctcctcttcatttgctggtagctgggtcagggcactggcgcccagtgaggatgcccactagcattctgccccagttggttggtggggggacacctgaccactgagcctttggtaaccttattttttatagtaagtacttcttataattttctttttcacatcttattttataagaagtttaggaatatttttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggttcagctgaccaagtagcagagaagtcttttttcccaattgagtgctaatagattaggataaaatactcacaatgttagtgtatgcttttaaaaagccccacacaacaaaatggaaacatacatgtacaactcctgtgagggctggagtcttggggttcaggaggaggttagaagttacaggcatctcttcaggcttgcttggtacttggcacacacaggatggtgttttaaagagtgggctgcaccccccacacgccatttacatcagcttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaactgtcataggttgtaattttatcaacattcgcttctagtaaaattaaagtcaattaagaaatagaacttgggtcaaaattctgttacaaagcttcataatttgtcccgaagcatatggtggagcattctgagaaatttgctttttgtgtgtttgacattcctaatttgggagtccttcagctgaattactattcttttagaagttgagacagcaggtaagcaaaggacctagttcatgtaaacatggacatcatgatggctatttaaaaaatatttgttctacaccttctcccctgaggcttggggagtgtgttcagccgctgcagtttctctgctcatggaggtcttgtttggatctgtgctggcggctgagcatttagtgtgagccagtgacccatgaacttgccgctctgtgagggccagagtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtaacaagaattgttatgtattaatactgcagttttcaataaagattgacttgtgttgcaaaaaaaaaaaaaaagggcggccgctctagaggatccaagc

SEQ ID NO: 1800 - DNA, 1274 bp, Homo sapiens
gagccaccacacctggcctggaaggaacctcttaaaatcagtttacgtcttgtattttgttctgtgatggaggacactggagagagttgctattccagtcaatcatgtcgagtcactggactctgaaaatcctattggttcctttattttatttgagtttagagttcccttctgggtttgtattatgtctggcaaatgacctgggttatcacttttcctccagggttagatcatagatcttggaaactccttagagagcattttgctcctaccaaggatcagatactggagccccacataatagatttcatttcactctagcctacatagagctttctgttgctgtctcttgccatgcacttgtgcggtgattacacacttgacagtaccaggagacaaatgacttacagatcccccgacatgcctcttccccttggcaagctcagttgccctgatagtagcatgtttctgtttctgatgtaccttttttctcttcttctttgcatcagccaattcccagaatttccccaggcaatttgtagaggacctttttggggtcctatatgagccatgtcctcaaagcttttaaacctccttgctctcctacaatattcagtacatgaccactgtcatcctagaaggcttctgaaaagaggggcaagagccactctgcgccacaaaggttggggtccatcttctctccgaggttgtgaaagttttcaaattgtactaataggstggggccctgacttggctgtgggctttgggaggggtaagctgctttctagatctctcccagtgaggcatggaggtgtttctgaattttgtctacctcacagggatgttgtgaggcttgaaaaggtcaaaaaatgatggccccttgagctctttgtaagaaaggtagatgaaatatcggatgtaatctgaaaaaaagataaaatgtgacttcccctgctctgtgcagcagtcgggctggatgctctgtggcctttcttgggtcctcatgccaccccacagctcccaggaaccttgaagccaatctgggggactttcagatgtttgacaaagaggtaccaggcaaacttcctgctacacatgccctgaatgaattgctaaatttcaaaggaaatggaccctgcttttaaggatgtacaaaagtatgtctgcatcgatgtctgtactgtaaatttctaatttatcactgtacaaagaaaaccccttgctatttaattttgtattaaaggaaaataaagttttgtttgttaaaaaaaaaa

SEQ ID NO: 1801 - DNA, 622 bp, Homo sapiens
  misc_feature (96)..(96): n equals a,t,g, or c
  misc_feature (115)..(115): n equals a,t,g, or c
  misc_feature (550)..(550): n equals a,t,g, or c
  misc_feature (605)..(605): n equals a,t,g, or c
tcttctgtaacagattccttcagcagcctggtgaaccgccccacgctgggccaattcactgaagaggaaatccacgctgaggtctgctatgcgagntgcctgctgcagcgagcancctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtagggccttcaacctgacactgtccatgcttcctactaggatcctgaggctgttgagtttgtggggttttcaggaaacaagactatgggctgctgcagctggaggagggagcgtcaggcacagcttccgctctgtgctctgtgtcatgctcctgctgtgctaccacamcttcctcamcttcgtgctcggtactgggracgtcaacatcgaggaggccgagaagctcttgaagccctacctgaaccggtaccctaagggtgccatcttcctnttctttgcagggaggattgaagtcattaaaggcaacattgatgcagccatccggngtttcgaggagtgctgt

SEQ ID NO: 1802 - DNA, 1519 bp, Homo sapiens
  misc_feature (40)..(40): n equals a,t,g, or c
  misc_feature (1470)..(1470): n equals a,t,g, or c
  misc_feature (1473)..(1473): n equals a,t,g, or c
  misc_feature (1519)..(1519): n equals a,t,g, or c
ccctgcaggtcgacactagtggatccaaagaattcggcanagcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaaagaaacatcagagaaacctgggcatgtctatgcgtgtggaacgttccaccctggatcaggtgaagaaacgttttgaggtcaacaagaagaagatggaagagaagcagaaggattatgattttgaggaaaggatgaaggagctcagagaagaggaggaaaaggccaaagcgtacaagaaagagaaacagaaggagaagaaaaggagggctgaggaggacttgacatttgaggaggacgatgagatggcagctgtgatgggcttctctggctttggttccaccaagaagagttactgaggctttctgtgcttggcctgactttggcctatgctggacctaactttgcgtgtgtgtgtgtgtagtagggggtcatttctttttgggtaatgggaaagttcttaagagtgtcaatggggagggatagagggtgggggctcatggtttccctctactttgggagagggcacagattgcagaggtaatgctgtggcatattgcttctgcctcagtgtatcactggagtcacaggaccctgcccacctgagttcccaataaagaaaaacctccccttctgaggctgctttcccaaaactccccctgcatctttatctcttcatctatcccacctcttgtctgaacatcccacctttatcctgtgttctgcctttgttttaattttaactcatgttcatcctgcaacagaagcattctctaggtcccagtttccwgttgcattgcatrtgtatttctgcctggttctatggtgtgtggatgtgtgtgcatgaatctgtcatatagagggggtccgagctggaatcctagagcattgctgccctggggcctgatgttcttggcttcctcagagcatgtaacaggaaattaaatgggatgagtgtttggtgtggtttgtgtctgatgagttttttaacattcaggtgtagattgtttcagcttctcttgtttcattttcctgaagatttatgtttttgtctaccttgtgagcaggcttttggaagaacctgtttgatgcaaaaaagaaaatgaaaaacaaaacaaaaaatccccaaaaccttattatgggagcccttcggtcttagaagctgtttgacatgtataataaatggcattgactgggnwanaaaaaaaaaaaaaaaaaaaaaaaaaaaaaaaaamaaaaaaaagaan

SEQ ID NO: 1803 - DNA, 889 bp, Homo sapiens
gtacaggtgcatgccactgcacccagctcattgccttttgttttgtatgttaaagcagatttagcccatgaacttggagacagttttgctgagcagaacttcatctcttggctttgctgtttgtttgccttgttttttttgttggttttacttagttttgtttttggagctaacatccataacttttgctatgtatgatataatcccctgtatgaccctgggcaagtaacttaacccattcagggtccaggttcctcttatgggaaagggatgcttgataagacactgttcatggttccttgcagtttactattatgatagatattcgatgacctaaaaattaaaccagtttcctttttcaaatttaatttttycgggaggtggaggaagattttcattccttatggtttgagaaacatcgctttcatacatgtctagggtaaccaagttctctaatgaatggcaatagtgatgtattttyctwaaatccttttctaamcagcattatgggtttgtgctgtaccggacaacacttcctcaagattgcagcaacccagcacctctctcttcacccctcaatggagtccacgatcgagcatatgttgctgtggatggggtaagaatcgtctctgaactgtgcctggcttttctccactatcttgaaatcagatgggaggaggcttttttctgggtgggactgaggaggcacactgaagtcccccaggtcatcggggctgggccattgcctttttccccaccctgggtagtcgtggacagaagcttgggatgggatggagaggagagatcgtgctgtgtgtcatgtctgttgttcaagtaaataaaagttgccctgacttcaaaaaaaaaaaaaaaaaaaaaaaaaactcga

SEQ ID NO: 1804 - DNA, 1701 bp, Homo sapiens
aaatgtataaactatacatttggagtgtttgcatataattctttataacctccacttaaagctgtcagacattggtattttatcagtccacattgttgaataaaactaatgttcttaggaatccagcttgtacacactgtttaaaaaccctcagggacagtttacacactcttctcactcaattcaggtactttgatgctattcttaaacctaacagtgacttgtatttttctgttttgcttttatttcaacgtgctggtagcacatctgatgaatgtcaacttaaaaaactcagttcagttatccaggtataactcagccaaacagattttaaagctgcatataactctccagcacatggtgcctcacactcttatagtggcattctatatattcagttattactactgagcagataatatgggggttcctgttaacagtgtattttttaaaaaaagcgcataaatgtatagccagcacactacacacacacacacaaacatgcacagttaaactatatatttttaaatgccactaatagccagcacaactaaaacaaaagacattcctaactgctctgtaagctgtkaacagatgcagttccttcttgatgtggctcttgcttcttcacgataactactactaaattcaagcactggtccttgggtgtctgacctctacattctagtttatgcaatgtctttagagaattttgtgcactggccactgtgatggaaccattgggccaggagtgctttgagtttatcagtagtgattctgccaaagttggtgttgtaacatgagtatgtaaaatgtcaaaaaaattagcagaggtctaggtctgcatatcagcagacagttttgtccgtgtattttgtagccttgaagttctcagtgacaagttttttctgatgcgaagttctaattccagtgttttagtcctttgcatctttaatgttaagacttgcctctttaaaattgcttttgttttctgcagtactatctgtggttaacaaaatagattatttctctgctttaatatttgatatcttacatctaaaataaattctctccacatataaaacccatagcctttggagatatggaaaatggtatctttcagatttctagaagttcaagtgtcatacaacaaaacaggaaccccctttactcttatggacctcatttcaatatactgtttacagtttgatggaattgtataatttaatatttctcttgtactgtagtttatatttatttacagatttttttgtactgtgtgatttgaactttttgttccttgctatgatcaatgtttatgtagtagagcacttatgatcacaaattaagttttttggtttgattgcactacattaaattttttaatgcagttctgatttttgactggactaaaactgtgtcttaatgtatgtgatgagtacttaaaattttaatccatgtggtcccccccctttttttttttttgcattgtatgtcaaaagcgcttgttctttcgtgcatgtgtaagatttaatggttccattgtattatttgaccatgacattttggagaaacattcccagctgtaatgttgtgtatggtagttctcactggatgctagagttttcaaaaccactattcttctaataaattttgttgtgaaaaactgaaaaaaaaaaaaaaaaaaaaaaaactcgtagg

SEQ ID NO: 1805 - DNA, 682 bp, Homo sapiens
gaattcggcacgaggtgattcgaaagtcttagaactgggagtgaaggcccacatgggatgcactggctcggaagggggtggaggttgctggagggtggagagaaggagctgccaacctggtcactgttgttgctgtatccaggttgcctccagtcctgctccaccacaccatggaccactccatcccagatgcctgaagccactggagggcagggcaggcagggggggcttcccgccctcctgcagcaaagggcaaccaccctcggatgatgggttgcagccggcctgctgcttaaggtgggggctgccatgaggggggcgtgtccaggagggtgaccatgggatggcttatacacacaggcctccttggagcctcagactccaagctaggctgaggctcaggcagggcccacaggcagccgattctcttgtgctgatttaaatgctggacacggaggcaggctgtttaaacgctgcttaaagtcgcaactgggcccctttcaagaaattttgctctaccaggaaaacagttacacattttaagagaacagagctacgttctttgtgagagctttttccttgscttgacttgctctttgtcacagactgcataagttgtcagccttgactatcttttgaataaagatttgattttaaacaaaaaaaaaaaaaaaaaactcga

SEQ ID NO: 1806 - DNA, 968 bp, Homo sapiens
  misc_feature (904)..(904): n equals a,t,g, or c
  misc_feature (907)..(907): n equals a,t,g, or c
gaattcggcacgagcttactttcactcaccgcctgtccttcctgacacctcaccatgtgtacgggaaaatgtgcccgctgtgtggggctctccctcattaccctctgcctcgtctgcattgtggccaacgccctcctgctggtacctaatggggagacctcctggaccaacaccaaccatctcagcttgcaagtctggctcatgggcggcttcattggcgggggcctaatggtactgtgtccagggattgcagccgttcgggcagggggcaagggctgctgtggtgctgggtgctgtggaaaccgctgcaggatgctgcgctcggtcttctcctcggcgttcggggtgcttggtgccatctactgcctctcggtgtctggagctgggctccgaaatggacccagatgcttaatgaacggcgagtggggctaccacttcgaagacaccgcgggagcttacttgctcaaccgcactctatgggatcggtgcgaggcgccccctcgcgtggtcccctggaatgtgacgctcttctcgctgctggtggccgcctcctgcctggagatagtactgtgtgggatccagctggtgaacgcgaccattggtgtcttctgcggcgattgcaggaaaaaacaggacacacctcactgaggctccactgaccgccgggttacacctgctccttcctggacgctcactcccttgctcgctagaataaactgctttgcgctctcaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaataacnaanaagcccgcaccgatcgcccttcccaacagttgcgcagcctgaatggcgaatggcaaattgt

SEQ ID NO: 1807 - DNA, 340 bp, Homo sapiens
tcggcacgagaaaattttttttcttggattcaagattcaaagataaatatttaagtgttgattgtattactattggattggatttgatcttagaacaagcagcatacacttaaatcaaggctagaaaggtatttttaagtgttacaggatactgtaaaaacatattcagatgtttggtttaaaatatagcctgggatgctgccaagcaatgctcctcagcaacttggtggtaagtgctttgtataatcctgtcttaggtttgtcttgtttttaatgtactttagatactccatcctccataagatgaaaaagaaatcagtctacatttttaaatgtttat

SEQ ID NO: 1808 - DNA, 685 bp, Homo sapiens
tcgacccacgcgtccgagcagacacaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatygtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggatgcctgtcttgagtagacttggacccaaaaaatcatctcaccttgagcccacccccaccccattgtctaatctgtagaagctaataaataatcatccctccttgcctagcaaaaaaaaaaaaaaaaaaaaaaaaaaaaaaaaaaaaaaaaaaa

SEQ ID NO: 1809 - DNA, 993 bp, Homo sapiens
  misc_feature (370)..(370): n equals a,t,g, or c
ggcacgagcccaaagtgctgggattacagggagttgatgaaagtggagatgtttttagagctacctatgcagcattcagatgttctcctatttctggtctgctggaaagccatgggatccaaaaagtctccatcacatttttscccagaggtaggggggattatscccagttttgggatgttgaatgtcaccctcttaaggagcctcacatgaaacacacgttgagattccaactctctggacaaagcatcgaagcagaaaatgagcctgaaaacgcatgcctttccacggattccctcattaaaatagatcatttagttaagccccgaagacaagctgtgtcagargcttctgctcgcatacctgacangcagcttgatgtgactgctcgtggagtttatgccccagaggatgtgtacaggttcctgccgactagtgtgggggaatcacggacacttaaagtcaatctgcgaaataattcttttattacacactcactgaagtttttgagtcccagagagccattctatgtcaaacattccaagtactctttgagagcccagcattaacatcaacatgcccgtgcagttcaaaccgaagtcccgcaggcaaatttgaagctttgcttgtcattcaaacagatgaaggcaagagtattgctattcgactaattggtgaagctcttggaaaaaattaactagaatacatttttgtgtaaagtaaattacataagttgtattttgttaactttatctttctacactacaattatgcytttgtatatatattttgtatgatggatatctataattgtagattttgtttttacaagctaatactgaagactcgactgaaatattatgtatctagcccatagtattgtacttaacttttacaggtgagaagagagttctgtgtttgcattgattatgatattctgaataaatatggaatatattttaaaaaaaaaaaaaaaaaaaaaaaaaaaaaatt

SEQ ID NO: 1810 - DNA, 917 bp, Homo sapiens
ggcacgagttagtgtcctgaaacgcctatgacagtgcctggcccagggttgggcacttactcatgttattcacttattcatatgtgggaatgaacagttcagccagtataaaggacaggtgagtacacaccaaggagatcttcagggagagatcagctggttttcctgtgaagatgtcagcttcatccctccaccgtctccctgtgctcatggctctgttccctttccaggctgctgctgctggttctttgggtctgcagccacctcccacccccatgaagggcaaacccagcattatgttacctcctcagtataaaaggagagagggtctcaaaaaaaaaaaaaaaaaaaaaaaaaaaagttgctcttgtcagctttgggagggcagactccatagttggagatgggcttccaaccaaccaaggagataaatgccagagggagcgaaccatgccaggctcaaagcacatctctccccaaactccccaggtggggacagcaggccaaaggcctccacataacccctcagggaggcctggagtccagatgctgtactccagtatctaaacaatcactgaatcttaaagctgacaggttcaaagctcttactttgggccgagcgcagtggcttacgcctgtaatccaggcactttcggaggctgaggtgggtggatcacctgaggtcaggagtttgagaccaacctagccaacatggtgaaaacccatctctactaaaaatacaaaaattagctgggcgtgttgacacgtgcctgtaatcccagctactcggtaggctgaggcagaagaatcgcttgaacccaggaggcagaggttgcagtgagctgagatcatgccactgcactccagcgtgggtgacagagtgagactcccgtcttgggaaaaaaaaaaaaaaaaaa

SEQ ID NO: 1811 - DNA, 2056 bp, Homo sapiens
  misc_feature (1730)..(1730): n equals a,t,g, or c
cgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctcttntatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagc

SEQ ID NO: 1812 - DNA, 1907 bp, Homo sapiens
tcgacccacgcgtccgctaaaggaaatactattttgtatcttgcctttttcaattaataaattgatttttaaaatttcttctcattttcagtatgccactgtctagattctggttacttctgctattcttgccttctcatatctctgtcctctctctcatcagatacccttctgtcaaggaatattgatgcttcagtgtagtcatctatgatcttctcattctgtcttttctttcttggtctttgacactagatactcaacatcccacccctaatttgcctgcctcacccttgatgaaactctgttctatagagctagaagcacagcaagagagatgcttttttcctcgatacttttcagaaatgcattgcacctaatacctgggagaagctattctttagccaagtttgttgaatgaaaccattcattcaaagtactgtcagctgtagcagtactttgtaagcttgactgattttcctggaactccatagtctctcaagtcgaaatttgaaattgcattaagatgtattaagcatgtatcttctatgtattgttaaattcctaaacagaatactgattaacaaaatgttaattttcagtcgcatacaactaaggagttatactagataagttttcctttttttaatgctcctagttgaatactactggttttctgatagaagtatgaccttctggaagtgtttatactttttaaaaaatttgtgaaaactgataacctatgtttgtttcatgtctaactgattatatcttaaaagcaactactaaggtgtttattagtttgtttgttttttaatcttatttaagcaacagccaactcagtttataaatccagaaacacctggctatgttggatttgcaaacctccccaatcaagttcaccgaaaatcagtgaaaaaaggttttgagttcacactgatggtggtcggtaagaaattaatctatagtctccaacttactaaataaatatctcccctttccaatctctggagtatgataacgtgacctataaagaaagaggaaaatttggcagagtcaaataacttgagaatttgaacaaatatatgtgtattcattagaaaatttttctcaggagcaaaattatttttctgtcactttcttatttatatgtagtgaaagtttactcattgtgtcagctaggctccaaaatggcccccagtgattcttatctcctggtattcacaactttcttgtcccttcctgcattgaatagggttttacctgtgtagccagtaggacattgtggagatgaaagtgttgtcattttctaagactaggtcataaaaggcattatggccccccaccttgcctcttctcaaattactcactctggaggaagccagcccttcctgcattgaatagggttttacctgtgtagccagtaggacattgtggagatgaaatgttgtcattttctaagactaggtcataaaaggcattatggccccccaccttgcctcttctcaaattactcactctggaggaagccagccgttacggcattggaaaatttcaagacctgtgacagcagaaggggacaggtaaggaaccaaggcctgccaatggctgtgtaagtgacccgtttcagaaatatcctccaggccaggcatggcggctcacacctgtaatcttagcactttgggaggccgaggcaggcaggagttgaagatcaggctgggcaacatggtgaaaccctgtctctacagaaaatatgaaaactagccaggcatggtggcatgtacctgtagttcctctcacctgagtccaggaggttgaggctgcagtaagctgagatcatgccactgcactcaagcctcaagcctgggtgaatgaaaccttgtctcaaaaaaaaaaaaaaaaaaaaaaaa

SEQ ID NO: 1813 - DNA, 1390 bp, Homo sapiens
ccacgcgtccggctaacagcacctgctgtttgttgagcatttactaactgccaggcactgtgctcagccctttgtgtatatcatcattttaatcttcatggctcatggcatcacattcatttcttttggacatttaccttgttttgtcattatggaaatgcatacctggtttagtgcaggatgtgttcctggaaatgaaagtgctcactgagtcagcactatgcaaggtcatgacacttgagcccctgcagcacagcgttctagtcttcagatgttggcagtcacccttccaggcaaagtcctcaaggccatgtcaggcatccatctttgcctattatactctcaatttctgacaactgcagggcagtccatccaggctgcagcagtttttatgatgtgctctctaagtcaccgaagtggtcaccaatgactaaaagcctgctggcctttgctctgtgttctgtaggtttttatctgggaaattggcattttagcatcatgtgccagattcttcctttgctagacaacttttgcaaaccattatgagtgttacccacaatgggtaaaaaccatggaccagaacacaaaaaaaatggtgagaagagaagcttcagcatagtgcagcagaattgaattggctcatgatggtgtggcagaacatgttggctgagagctttagctgtatggtggggccgtgttttttctccctggctgagagcataaacagttcttggagaaaagtaggtaaatcaaaactgtgccattgtggcttatggtatgtatgtcttggtagttagaaatgatttggagacggcagttaagtggctggcccttccatcagcgaaaggcctgcctccagctttgtcctgtgagattaaggatcatgtcttgcttttgtacataatgtatctttatctcctagtgtgtggaaacttacaaatatttactgggcgttggatatgtacactaccatataaacaatcctcattttacaggcaagagcattgaggctcaaataggttagataaacaactgcaactagaaggactagagttgggtaagggtggagtctgacatcaggatgggcctaccggagggttctgtgtgtgcttagtgcattctgagaccactggattttccagagagagcagtaaactcagagattgcagttgttcaaacatgggtgcacccagattttgtggggcctaaagcttgtatgacatagtggccttctttataaaaaatccccacagaattatatatacacgcttaggagtaaaattatgtgttgtttaggctgagaaaataaataatcacaaaattataaactttaaaaagctatgcacattacaaacatggtcgggtctgaaaaaaaaaaaaaaaaaaaaaa

SEQ ID NO: 1814 - DNA, 889 bp, Homo sapiens
ggcacgaggttacttattgctcctacttcatatcatatgtggttctacaacctacattatcttgtctatgtcttttaactagctgtgtgttcttacataagatctgcagaccttggttctcaactgcaaaagcatattgattaaatgattactgtttttacctgcaatactttaatttttggatttgggattaataatgtaaaaaagactaacatatatgtgggattacaaaactgttttgttagccttcaaacaactgatgaactgcatcaggagctgtcttatacttattgttctgctattaatacttaatgcactgccttgtaaagagctgattgctacttaaaaactctgcttaaatgaaaaaccaaaacataaaagaattaaaccaaacatacttactctcccatagcccatggtggacagcaacataaaggagggaaatgtttctgttgatctttggcttcaaggattaataccagatttggataccggttagttagataattggtaaggaatcccataaagttgtaaattacataagcttcatagcattctctgcaggtatccacatatattgcaattccgggatatttcaaagctatccactatgaaaaagcacagatgttaaagatagttgcagctaagataaaatgaatcaccactccattcatggtactcacaataagctaatttttatgcttgagatgtcttgtcatatacttacatgggactctctaaaatttatcattatgagggctatcaatctgtgaaatgaatgcttaaaagcaataaacatcttagatattggtaaacaaaaacaagtgtttgaggggtaaataatgaataaagagagaagctaaagtaaaaaaaaaaaaaaaaaaaaaaa

SEQ ID NO: 1815 - DNA, 2388 bp, Homo sapiens
gcccacgcgtccgaaagcggagaacgctggtgggcctgttgtggagtacgctttggactgagaagcatcgaggctataggacgcagctgttgccatgacggcccaggggggctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcataaaaaaagttgcacaagttccttattttccttaatatttcacttctatttaatacaagctgggacataaaaattctgttggggatacctgggggaagatgtgagaaactaatgctgaattcagcttatacatgatgaaaagaaaaaccagacaaaaggagcacataaatatgcatacagtgtaactgttattattttaatacccacgataagggatttttgttagcatgtttagggggaacgaggattggtgggatccttggggccacaggaatctgaggcaacggaagatatatagagtgatcgtccccctgccgaaggaacctggcayctgtcaagcagatgctgcagttcaaacttcagcttttaagatagatagctattgaaggcagagggtcagcaggaggatgtgtatttctaatctaccctggtaaagtcataggtaagactcaaaagcgggatcttattcaaaaggcaggtatttcctttgttttctgtcttgaaatagccccttcccctaaggtgcattctctcaagttttcagtattgctttatttgcagtgattaaaagagatgagagactttggagacagacaacgtaagcaacacatacacacatgaaatactctagacagagatgaatataaatctggcctaataaccagttttccatgtaacagtgattttgtgtttcgggctgaagcagtggttatattaaaagccactaattcccttatccctttaaaagatttttacaattctccaaccacaaacagcacttctaaaactaactttactttctgcccataatttgttctacatggaaaaaaaaaatattactttggccaggggtgtgtgtaaatgtggcagaattcctaggcaggctgacctttacagtatgggcctttaagatactggatcctggttgggcaacaagtgtcacgcctgaagtttctgaaaacaaattagaagactgttggcttggctaatctcgtagttcagggccaagtttctgtagtcagaatgaagaataaaattgaaagaaaaagggggaaatgcttatacttggcattaagttgaatgcctcaagtcttaactatggctttgtagatgaggcaaaagatttcttagtggtaaaatttcttcaacaggtcaatgccaatctgtatgccattttagtaaagtaggtaaggagagtagccgctcagtaactttggcactaaagaaagagtgtggctctagaacttccaatcccattgctagatgtgccctttaaaagatggtccagtgctttcagggaaggatgtttagccagttttcctagtatttgttccttaagattttttgacctgtgcttaataagacggacgcgtgggtcgaccc

SEQ ID NO: 1816 - DNA, 833 bp, Homo sapiens
gatcttgtccaagcagtcggggctacttccaagaatgtcagctcctgttagcaaccagtggagtctggccttgggctctaagttgacctctctatagctccaaatcctaccaatctcagaaaactgtaagaggcacagatgactccaccagctgcagagtgactctgaagagagtcttcacttactgcacaggcaaagaaaggcacaggaatatttcctacctctccctcctgtgagtcccacctccccccacccccatctccaggaggcaggtagagcagttctraccgagaggatagactgctgttgctgtctttccccagctctgaactagttttaaggtagcttaggatgaaaaatggagaatgattgggggttccaaaccactttyttctcccttggcttatatctcttcaccatttggtggtcaactgtgggsctaccctggacctcatctactcagcgagaattggacatgaagctagaggcagctgccttggaagggaagtmaggctcacttggacagcccaggccatggcaggaagaatcccttcctcttggggtccttgatgggcatgtgtgatggggaaggagcagtctcccagccctgggtctgctccccacatctctcctaattccacttcaccttttgccaccccctccccaccagaggcctagcccttttgtcaccgaaggcccccagagtgtttctgtgtgaaaccctctcatttacactgtggcatcaaaatccacaaaagatggattaattgcactctggttaatagcagcagcacaatgattaaaatctatattcctaaaaaaaaaaaaaaaaa

SEQ ID NO: 1817 - DNA, 1098 bp, Homo sapiens
  misc_feature (283)..(283): n equals a,t,g, or c
  misc_feature (301)..(301): n equals a,t,g, or c
  misc_feature (349)..(349): n equals a,t,g, or c
  misc_feature (438)..(438): n equals a,t,g, or c
agaccctgtctcaaataataataataataataatcttattttggagaataaagagacctstggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttnctaccacaccctttcttngccccccgcctcccatgtctgctgtgcctttgtactcagcaattcttngtttgctcccattatcttccagccggatacagagtgaatagttaaccacacttaggtcaaataggatctaaatttttgttcctgctccngtgtaaagaggccagtgtttgtgtgttgcaagcagccttggaatagtaactcttctcatttgtttgggatctggccamcaagttccagaatgatacacggatcagtgcagaagttcatcaggctctcggaccttagggctgttggagaaggcttcagcagcagaactgatggtkawkgytcgtgttctccatcctcaactttctttgcttcgatcatacacaagaatacatttggaagggcaaaaaatgaacactgttgttcattgcagccgtgttttgtgacacagatgcacagtctgctgtgaagaccttctctcaagtggsatytgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcaaaaaaaaaaaaaaaaaactacgtag

SEQ ID NO: 1818 - DNA, 899 bp, Homo sapiens
  misc_feature (20)..(20): n equals a,t,g, or c
  misc_feature (85)..(85): n equals a,t,g, or c
ggcagagtggggagggcgtnggtggatgagtcaccatcctccctcaaggacgtcttgggcaagttgtctggccccattagccagnaaccagggaaatgtagctgcaggaaaatcacctcgtttcctcgggatgttttttcttaggctggtttcctttacaagctgcaattatgttccatcccacgcaattcagttaagtggcacttttcagagaaactgtcttggtgatcatttgggctgctgtgggcacgaggttgaggagagaagggagtgagagcttctactgagtttagttggttttgtgtccatgagccatttacaaactttgcacctgattgggctcagttgcagtttcttgtatttccctaccagccaagctgttgaagctgctgagcccggaatgatgttatcactgaggcagatgacaaaccctctagttgctagaaaccaaactgctccccgagctggtgtttccgttttttgtactgactgcttatttgggcttgatatataatggtgaaaacaggaactgtttattttaggtgataagaaaccaacattatgacaagaagatgtcatcttagttactctgttaccagtaccataggccagatactatctagatgcttataaacatcttatctaatccttgtaataataagccccaagctaggttttatatccccattttatggatgggggaactgaggccaataacttcatataacttatccaaggccacaaaactagtaataaacagagtgaaattcaacccaaaaacaaactacaaatccaaatttctttacctctatgctgtctgtacttgctgttactagcaaagttctcttggtgggagttaccccatcccctctccaaaaaaaaaaaaaaaaaactcgtag

SEQ ID NO: 1819 - DNA, 855 bp, Homo sapiens
  misc_feature (850)..(851): n equals a,t,g, or c
ctgtaatagcacacaactcagaactcttcagcatttgtgtgattccttacctctggctgataaaactctaatgggttgtggcttactttgtttccattttctttggctttgtgcaatttttgtgtaactttacttgtacctatattttctgtttacagttctttttaaggggaggggtagggttctaagatcttgttgtttattgtagataaaaattttttcgtgttgtagaaaagcatgggttatgcgtttgactgaaaaagacactgtattatttaccaaaggggtattgtttttgcatttgtttataaatgcattattttggtactgtaaatttggacataatttctgagtttattactactggcattttctttttcccttttttttttttttaaccgtaagtgcacgatgcaggtgcataggccccagaccaaactagaccaccagcatgttcatgtccagacctcggcagtggcgtgcactgcttgtgcacctcagttcctccagtgttggtttgtttgttttttaattcagcatcctgctggttttactttccaagcaagatctgttgcgactcccaaatgcgttttaatgagctcatccttatttgcctttcttcttacgtattttgtgtattagattgtgcaggagatattctagaaggcattaatggtttgcattcaaaacgatgtggtttgtccaagttattttctgtctttattactgagacggattaatctccttatttttttcttgatgatttgaagttgtaacagttgtccagctattgcttaataaaattttgcagatcaaaaaaaaaaaaaaaaamctcggggggggccccggnnccca

SEQ ID NO: 1820 - DNA, 553 bp, Homo sapiens
gaattcggcacgagtccctaaacagttaaaatgtcacagctgtttcttataatgcttacattcatatttctaaataacatgtttataatgcatctaacttccttccatggaaaaagagtatttggctttttaaaccaatcgagtcacatgcatgctttcccccttccacgttggactacatcaatatttagtgttagtatttttataaatagataaatattgttcgcaaattttatttgctgtctattgctgtgtaacaaattcctccaaaattattggctttaaacaacatttattatcccatagtttctatgagttgagaatctaagcaggcttagctgggtccactagctcggggtctctcacaaggccacagatcaaggtgttggtcagtggtttgtgcccttagtcccagctacttgggaggctgaggcaggaggatcacttgaacccagtagttcaaggctgcagtgagcwakggttacaccactgcactccarcctgggtgacagagcaagatgccatctcttaaaaaaaaaaaaaaaaaactcga

SEQ ID NO: 1821 - DNA, 596 bp, Homo sapiens
  misc_feature (297)..(297): n equals a,t,g, or c
tggaggtggagtcctggacactttcggctctggcagctgtgtcttgatctgagccccaagcatgaactggaggctctgcagcccttgggagatgggggctcagggaggaccccctgaagaacccctcttctatgtggctttggtggtattccacggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctngctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaaggctctgcaccagcaccttggaagcaccaataaagaggatgcccacgtggccccagca

SEQ ID NO: 1822 - DNA, 1263 bp, Homo sapiens
ggcacgagccccttccggcaaaacggcagcagtagcagaggcagcttctgagagcctgggcaggcagcagctggctgaccaagtccactggaagagaaggcttgtgccagccgggagaaggaagccggggacaggatgaaagcaacaacacctttgcagacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagttaccaagcctcaagcttcctgattgattgtcattctaatggatcaagattatatttcactttgaggattttttccaattatttaattatatgcaaacaaaaatatctatacacttaagaagaaccacttgcctcctcgaagcgcaggttcacacataggtcttcccttggccttctttgggttttggattccccaatactcccttgcatgtcctttgcttcccctcagaaatcagtgtcctcaggattttctttgaaactccacagttcctctgcatctccttccaagcctacttctaggaaaacatttggaatcaattgcaatttactctcaatttttggtttaaaagaattttaggtgtcagtgaacaggaaaaagagagttttctttgtggagctccttcaagagtctccaagaaatcacactcatattaatccaaggccagccctgtggtttaattggaaactctagccttgccacacccaacatgagtgtccttgattgagtctttgaaaccctgtgtttgcggttgtgttctggagaagcatgttcaaaaccttatcatcagataattcatacatgatatttgtctaagccttcttaccctttctttaaataactcatatcttttagagtaacaggactacaaaaaaaaaaaaaaaaaaaaaaaaaaaaaaaaaaaaaa

SEQ ID NO: 1823 - DNA, 2005 bp, Homo sapiens
ccacgcgtccgcgcccagccatgactgcgccggtccccgcgccgcggatcctgttgccgttgctgttgctgctgctgctaacgccgcctccgggtgcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttggaaaaaaaaaaaaaaaaaaaaaaaaaaaaaaaa

SEQ ID NO: 1824 - DNA, 805 bp, Homo sapiens
  misc_feature (671)..(671): n equals a,t,g, or c
  misc_feature (688)..(688): n equals a,t,g, or c
  misc_feature (706)..(706): n equals a,t,g, or c
  misc_feature (708)..(708): n equals a,t,g, or c
  misc_feature (738)..(738): n equals a,t,g, or c
tgatactatttaaggtacgcctgcaggtaccggtccggaattcccgggtcgacccacgcgtccgaacatgacttggaagatcaaattgaggagtgcagtgtacctttcagatgcgactgtaaccacgctaggaaacttagtgcccttcactctgaccctgctatgttttttgctgttaatctgttctctgtgtaaacatctcaagaagatgcagctccatggtaaaggatctcaagatcccagcaccaaggtccacataaaagttttgcaaactgtgatctttttcctcttgttatgtgccatttactttctgtccataatgatatcagtttggagttttgggagtctggaaaacaaacctgtcttcatgttctgcaaagctattagattcagctatccttcaatccacccattcatcctgatttggggaaacaagaagctaaagcagacttttctttcagttttgcggcaagtgaggtactgggtgaaaggagagaagccttcatctccatagattcatgaraggggcattgtgtgtcttctagcagaaaaacaaactggtggtgtatgaaacattttatatttcttactggtttttctatactgtatgtgtatgaataatttcccaacgtatacctagaaaagtctttgacctaatattagtctagaanaaaatatatatatatgngtgtgtgtggttatgtgngnatgaaaacttaagaacattgacaataacangctcttttctggttttttcatacaaactggcaaattatacaaaatatgacaaaaatttcttagaaat

SEQ ID NO: 1825 - DNA, 1042 bp, Homo sapiens
acggcccgtaattcccgggtcgayccacgcgkccgtgcttcctagaaggtcgtgtcacgtggaacctcttaatctcagcatccggagctccaggaagggaaaatttcaagtcagatagaattctatatataccatttctttggaaccttcagccctcaagattccaacatcatgacctcagtttcaacacagttgtccttagtcctcatgtcactgcttttggtgctgcctgttgtggaagcagtagaagccggtgatgcaatcgcccttttgttaggtgtggttctcagcattacaggcatttgtgcctgcttgggggtatatgcacgaaaaagaaatggacagatgtgactttgaaaggcctactgagtcaaacctcaccctgaaaacctttgcgctttagaggctaaacctgagmtttggtgtgtgaaaggttccaagaatcagtaaataagggagtttcacatttttcattgtttccatgaaatggcaacaaacatacatttataaattgaaaaaaaaatgttttctttacaacaaataatgcacagaaaaatgcagcctataatttgctagttaggtagtcaaagaagtaagatggctgaaatttacataagtaatatttcataatcttagaattctctcaaagcatgtgaaataggaagaaggaagttcttgcccagaatcttaggaaatcaccactgttcggttataatcactgcctcctgaatcgttgaggagtcttttaaattagatttttgttttgttgtctcccaagttaatattatatttagatatcagagagtcaggyaaaaaggaaaacttttatctctagggaaaaaacatttagaaaaatgtattcagtgtatctaatactgaaatgcggaaaaaaatttaatgttaaaaaaaaactatagacattgacatggaaaagagatttaatgttttgaaaaaaaactttatattaactgagtaacatcctcctgatgagaagtactatattaaatataaacccattatgttataagttaaaaaaaaaatt

SEQ ID NO: 1826 - DNA, 675 bp, Homo sapiens
taccggtccggaattcccgggtcgacccacgcgtccgcttaacgccgggattatacacattctagaaatgattctgagaggagtgtatagtatggtgcctatctacactcacatgatattcttattcacgttttttttaaccataagtggcaaatattttaaaatatttgaaaaacactccagaatctagtacgctttatttttagactgaacctaaagtaggttgttcttttaacaaagggtttaattcgggtggggaatataacatatcaaaatacatgaacaaatggaaagttacttctagaaaagcaaagaaattgggtatcatttttgtttcttgggaagctaattttgttgaatgtttagaattgagcaaagatgtaaatttttgaagggcagtttagaaaaattaactttgtgaatgaacttaagatgtctgtactctatatgtgatgctgtgcagtttgtttttatatggaaagatgtcaactatagccataaccaataaaataaaaactgatgaggcatgcagctttcagcacatcttttatacatgaagaaattaattttgtgttgctatggtgttgaaatatccaagatgttctgtatctatgtaaacatgattcctttaataaattgtattttattattaaaaaaaaaaaaaaaaaaaaaaaa

SEQ ID NO: 1827 - DNA, 1172 bp, Homo sapiens
ccacgcgtccgaacaccttgcagctttacctgtgaatgtcaagattggcaagatgcttatttttggtgccatatttggctgccttgacccagtggcaacactagctgcagttatgacagagaagtctccttttaccacaccaattggtcgaaaagatgaagcagatcttgcaaaatcagctttggccatggcggattcagaccacctgacgatctacaatgcatatctaggatggaagaaagcacgacaagaaggaggttatcgttctgaaatcacatactgccggaggaactttcttaatagaacatcactgttaaccctagaggatgtaaagcaggagttaataaagttggttaaggcagcaggattttcatcttccacaacttctaccagctgggaaggaaacagagcctcacagaccctctcattccaagaaattgcccttcttaaagctgtactggtggctggactgtatgacaatgtggggaagataatctatacaaagtcagtggatgttacagaaaaattggcttgcattgtggagacggcccaaggcaaagcacaagtacacccatcctcagtaaatcgagatttgcaaactcatggatggctcttataccaggagaagataaggtatgccagagtgtatttgagagaaactaccctaataaccccttttccagttttactttttggtggtgatatagaagttcagcaccgagaacgtcttctttctattgatggctggatctattttcaggcccctgtaaagatagctgtcattttcaagcagctgagagttctcattgattcagttttaagaaaaaagcttgaaaatccaaagatgtcccttgaaatgacaagattctgcagatcattacggaattgataaaaacagagaataactgaaactgaaattcatggtcaactgctttaaaaattaagatgaagatacagtcatgaaattatctgaaaatgggtcatcacattaagtatttcattacttaaaatgttggtactagccattaacttaaaggtggtgggaaaaaagcacatactttaaacatgtataattttctagttcctttttaatgatgattattctgaatgtatttgccactacatttacaataaattctttggtattatgaaaaaaaaaaaaaaaaaaaaaa

SEQ ID NO: 1828 - DNA, 1376 bp, Homo sapiens
  misc_feature (18)..(18): n equals a,t,g, or c
ggcgggcggcgcggaagnggcggckgcgcggccggggcagccatgtcgccattgtctgcggcgcgggcggccctgcgggtctacgcggtaggcgccgcggtgatcctggcgcagctgctgcggcgctgccgcgggggcttcctggagccagttytccccccacgacctgaccgtgtcgctatagtgacgggagggacagatggcattggctattctacagcgaagcatctggcgagacttggcatgcatgttatcatagctggaaataatgacagcaaagccaaacaagttgtaagcaaaataaaagaagaaaccttgaacgacaaagtggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacstctacaagcacgtgttctgggccacccgtctggcgaagaagcttctcggctggttgcttttcaagacccccgatgaaggagcgtggacttccatctacgcagcagtcaccccagagctggaaggagttggtggccgttacctatacaacgagaaagagaccaagtccctccacgtcacctacaaccagaaactgcagcagcagctgtggtctaagagttgtgagatgactggggtccttgatgtgaccctgtgatatcctgtctcaggatagctgctgccccaagaaacacattgcacctgccaatagcttgtgggtctgtgaagactgcggtgtttgagtttctcacacccacctscccacagggctctgtcctctagttttgagacagctgcctcaacctctgcagaacttcaagaagccaaataaacattttggaggataatcaccccaagtggtcttcaaccataaactttgtgattccaaagtgcccagttgtcacaggtgccataaataattacattttccaacataaaaaaaaaaaaaaaaaaaaaaaaaaaaaaaaaaaaaaaaaaaaaaaaaaaaagggcggccgc

SEQ ID NO: 1829 - DNA, 1098 bp, Homo sapiens
tcgacccacgcgtccgcagaactctagatctgggaataaccctgtatctatttctttacatttttctttcattaatgtatttatcactattttttttttgtttttctttgcaggcctcagctgttgaagaacgctctgcagagagcagtagagaggggccagttagaacagataactggcaaaggtgcttcggggacattccaggaactccgacccacctggtgcagaggagtcttgtcttgacctgctttgggagagtgttgtcttgatgcttttctcttcctccttggaaaacagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaagcacttttgatatcaagcaagtggcttcctttttgagatattaaaaaaaaaaaaaaaagggcggccgc

SEQ ID NO: 1830 - DNA, 630 bp, Homo sapiens
tcgacccacgcgtccgcctggttctcacccctgttggagtcagctttcaagattgcctgtgcccctgctctgccccatcctggctggcagggctgcatgtttccatcctgtttgcctcttttatttaatgccaaagttttagccaaagacatcttcctacttttgttgtgtttcagcattctgttctgcactgtgggctggctctctgccccaaccctgggcactggcccctggctgggccatttcatggctcaaagcctctgggggctcaaggaaggctgggctgctcagtcccttcatgggtcttgctaatggaaagtagcatatatgtgctttaaaaatattaatccttttgaaaagaactgagaagaraaatgtataattttatcccatttttaatattttggtctagcaacttgtgatacatagatgacaattttgtgagtttttcaaatgtgtgtacagatttttgtaaatatgactcttttgtaattaactcatgtacagcctcatcctgtatagtttaatgatgaatgtgcaggggacctgtctcaggctcctatatggttaaaaaaaaaaaaaaaaaaaaaaaaaaaaaaaaaaaaaagggcggccgctctagaggatccc

SEQ ID NO: 1831 - DNA, 1327 bp, Homo sapiens
ggcacgaggaaagtccttgctctggtgacctgtaagttgcagaggagggtggagtgagagtgtcatgtattgggatagtcagggatccctgcctttggcctttcttcttcttcttcttcctcttccatagttggatcatgtatatttwacttctaaaggagagaatgtcaaaaagttctgtatttttttatattctatatattaggtaggtcaatcttaattggtctcaagaggaagaactgtctgtcatttcggtaagtaggatactgtgaggaagaccaaaaagagatatggatgcttcctcgctcaggaggcctgagcttggtccttttcctctctgcttggattctggaccaccacctgggaccaaccttcagctctggaaccttcataaagcaggtcagcgtggcctgattgtcccaggacctgaagggagcaaggatggcctcagggcctggtgaagtctgctactctgtccttactgctgaacatcctgcttgtatcaggaaactcagaagcagtttgccttgtcaaatcaatctcaatgggccatgtccacataactgatcacccatggctgcctctcctattatctattatcactgaaacttagtagcctgctctttttttttttttttttagagctattgcgtatcttccctgtttgggatccttgtacctggtttgggttttcccttccttgtgacaattataatccagatgcctcttctttctgtttgaattacggtagtgcattgccttagtggcttgcctgtgcctctgggtggattacatatgatagtaaagcccacctgtttggatgggagtagaggaagttggtgtagaccagctgtggagctgaaggcacagtctgccccacccccacctccccactgtggttagtcagaggcatcctgctccaagctctgcttttccttcctctgaaacaatgccattcttgcttctattgctacacatctccttctggctcaggtgaaatccatgcccttctgcttatagacctaaagttcaggtacttattattggccattgatcttgaatttgccctctcctagtgctgcagtcccacttcaaagccattttctgaggaggatggtttaggtctggcaattgtccttgaaaaatcccacccatgttgtaccaccttggtgagtcatatgccactcatcagcttgggaatgatggctgccaactcccaatctcccaggaaggcagggggcagaatctttttttcacttggcctgctacctccattaaaaaaccattctcttacagtttaaaaaaaaaaaaaaaaaaaaaggcggcc

SEQ ID NO: 1832 - DNA, 995 bp, Homo sapiens
acagcaaaaaggaatggcccatcagcggaggtaattggggcttgggtgctcaaagttacccagaaataattattacagggcatgctgatgggtcagttaagttctgggatgcttctgcaataactctacaagtattatataagctaaagacatctaaagtatttgaaaagtcaagaaataaagatgacaggccaaacacagacattgtagatgaagatccatatgccattcagatcatctcctggtgtccagaaagtagaatgctgtgcatcgctggagtttcagctcatgtcattatttatagattcagcaagcaggaagtaatcacagaagtcattccgatgcttgaagttcgattattatatgagataaatgatgtggaaactccggagggtgagcagccaccacctttgccaacacccgtgggagggtccaaccctcagcccatccctcctcagtctcatccatctaccagtagcagttcatctgatgggcttcgtgataatgtaccttgtttaaaagttaaaaactcaccacttaaacagtctccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctggttcttcatcaccacacaattcagatgatgaacaaaaaatgaataattttatagaaaaggcaaagatatcaaggaagttaagcttacctactgacctaaagcctgatttagatgtaaaggataactccttg

SEQ ID NO: 1833 - DNA, 2066 bp, Homo sapiens
gcggcggcaaaatggcggcgcctgaggagcgggatctaacccaggagcagacagagaagctgctgcagtttcaggatctcactggcatcgaatctatggatcagtgtcgccataccttggaacagcataactggaacatagaggctgctgtacaggacagattgaatgagcaagagggcgtacctagtgttttcaacccacctccatcacgacccctgcaggttaatacagctgaccacaggatctacagctatgttgtctcaagacctcaaccaagggggctgcttggatggggttattacttgataatgcttccattccggtttacctattacacgatacttgatatatttaggtttgctcttcgttttatacggcctgaccctcgcagccgggtcactgaccccgttggggacattgtttcatttatgcactcttttgaagagaaatatgggagggcacaccctgtcttctaccagggaacgtacagccaggcacttaacgatgccaaaagggagcttcgctttcttttggtttatcttcatggagatgatcaccaggactctgatgagttttgtcgcaacacactctgtgcacctgaagttatttcactaataaacactaggatgctcttctgggcatgctctacaaacaaacctgagggatacagggtctcacaggctttacgagagaacacctatccattcctggccatgattatgctgaaggatcgaaggatgactgtggtgggacggctagaaggcctcattcaacctgatgacctcattaaccaactgacatttatcatggatgctaaccagacttacctggtgtcagaacgcctagaaagggaagaaagaaaccagacccaagtgctgagacaacagcaggatgaggcctacctggcctctctcagagctgaccaggagaaagaaagaaagaaacgggaggagcgggagcgtaagcggcggaaggaggaggaggtgcaacagcaaaagttggcagaggagagacggcggcagaatttacaggaggaaaaggaaaggaagttggaatgcctgccccctgaaccttcccctgatgaccctgaaagtgtcaagatcatcttcaaattacctaatgattctcgagtagagagacgattccacttttcacagtctctaacagtaatccacgacttcttattctccttgaaggaaagcccagaaaagtttcagattgaagccaattttcccaggcgagtgctgccctgcatcccttcagaggagtggcccaatccccctacgctacaggaggccggactcagccacacagaagttctttttgttcaggacctaactgacgaatgacatttttttcttcctgtcccctcctaccccagtccctaaaagaaatggggaaaaaagaaaacaacagcaagtcagaaaaaaaaaacaagagagagaaattcatattattattattattataatacaatattttttttaaaagactgctgcatccttaggaaggatcagaaaccatgctgcccgtaagagtcacaacctgtgtgtgcgcgcaaggttagcaacaaacgtacccgcttggcaagcccacccttcctgtggcctctgtgcacgcaccttccagtgaacagagactcttcaccttcgacccatccattgtcccagctgggaaggggacattcccactagttctcattcattcttgcttttatgaaaaataaaagtgaaaaacctccatcaaccagctacttgcagcatctcctgaggacttgcttctcctgcctctggggaagagagggaagagaaagcacagagcagagaagcagagatgttccttgaactgcccacaagttttcaataacttttatttctgttttgtaatgaccaaaggaatgaggctgacataggtatatatatatatttttttcctttatttgataaagagccaattctttaaacccatgagtttatgccctgggctccttagcccacaatagtgtaataaaagtgccccgggctggtttgtgcttaaaaaaaaaaaaaaaaaaaaaaaaaaaaaaa

SEQ ID NO: 1834 - DNA, 519 bp, Homo sapiens
taaaagtttagcggtctaaactagcaatctaagatgattgtgaaataaaggcatttaaaatcctcctacttgcttatcggaactaccataccagtcaggataagctaagccacgctgcgctaacaaatggcctgcagatcttggtgctttacactactagcaaatgtttcttttacgcttctgctgcctgtccactgggggtcagcagaggccgtcttctctgtcagcatcactctaggatgccggccacccagcagccttctctgtgccactcagcagagggagaagagacctggggagccacgtgctggctcttgttgcttctctttggaagtgacaccgtcactttcacatatgtttcatcagccagagaaagtcagctatggctggctcaatagagccagtaagtctaatcctcctgaagcagaagctctgcagagagaggagccaaatatactgaacataatacagtagacaagagaatgtgtgtgactctgaaaccattaagggagtaaaaaa

SEQ ID NO: 1835 - DNA, 1543 bp, Homo sapiens
  misc_feature (1055)..(1055): n equals a,t,g, or c
  misc_feature (1143)..(1143): n equals a,t,g, or c
cttcgccgtcatccgcttcgaaagcatcatccacgagttcgacccgtggtttaactatagatcaacacatcatcttgcatctcatgggttctatgaatttttaaattggtttgatgaaagagcatggtatccactaggaagaatagtaggtggtactgtttacccagggttgatgataaccgctggccttattcattggattttaaatacattgaacataactgttcacataagagacgtatgtgtgttccttgcaccaacttttagcggccttacatctatatctactttcctgcttacaagagaactttggaaccaaggagcaggacttttagctgcttgttttattgctattgtaccaggctacatatctcggtcagtagctggatcctttgataatgaaggcattgctatttttgcacttcagttcacatactatttatgggtaaaatctgtaaaaactgggtcagttttttggacaatgtgctgctgcttatcctatttctatatggtctctgcttggggtggttatgtatttatcatcaatcttattccactgcatgtatttgtgttgttactgatgcagagatacagcaaaagagtctacatagcatatagcactttctacattgtgggtttaatattatcaatgcagataccttttgtgggattccagccaatcagaacaagtgaacacatggcagctgcaggtgtctttgcattgctgcaagcttatgctttcttgcagtatctgagagaccgattaacaaaacaagagttccagacccttttctttttgggtgtatcactagctgcaggtgctgtgttccttagtgtcatctatttgacttatacaggttacattgcaccatggagtggcaggttttattcattgtgggatactgggtatgcaaaaatacacattccaattattgcatcagtgtctgagcatcaacctacgacttgggtgtctttcttctttgatctacatattcttgtatgtaccttcccagcaggcctttggttctgcatcaaaaatatcaacgatgaaagantatttggtaagaraggtttttaatgactactttgatatggaatagttatttttctttttgagattatttactttaaatttttgttttnctatgtttgactctatatattcaagataaattttctcctttattttgcataggtgcttaaccaagaaaaattcactgagaggctgggcatggtggcacacgcctktaatcccagcactttgggaggccgaggcgggcggatcacctgaggtcaggagttcgagaccagcctggccaacatggtgaaaccttgtctctactaaaaatacaaaaattagccgaacatggtggtgcatgcctgtaatcccagctactcaggaggctgaggcaggataattgcttgaacctgggaggcggaggttgcagtgagtcaagatcaagccactgcactccaccctgggaatcagagcgggactctgtctcaaaaaaaaaaaaaaaaaaaaaaaaaaaagggcggccgc

SEQ ID NO: 1836 - DNA, 1112 bp, Homo sapiens
ccacgcgtccgcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagagaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttgtaaagtaatctcacaagctgccaaagaacacatcccaagcagtaatcacagatgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaaaaaaaaaaaaaaa

SEQ ID NO: 1837 - DNA, 1684 bp, Homo sapiens
  misc_feature (736)..(736): n equals a,t,g, or c
gtatccgcgacgagctatccgggaaagggccgaatgcgatcaaacctaatccgcgagacttgctaaggttctgtgctacaaattgatgtttagataaacttcagtgaaatgactcttcaggaattggtgcataaggctgcctcctgytatatggacagagtagctgtatgttttgatgaatgcaacaaccagcttccagtttactacacctacaagactgtggttaatgctgcttctgaattatcaaattttctgctgttacactgtgactttcaaggaattcgggaaattggtctctactgccaacctgggatagacttaccctcttggattttaggaattctccaagtcccggctgcttatgtacctatcgagccagattcaccaccgtcattatcaactcattttatgaaaaaatgtaatctaaagtatatccttgttgaaaaaaaacaaattaataaatttaaatcttttcatgaaacattattgaactatgatacatttacagtggaacataatgacctagtgctcttcagacttcactggaaaaatactgaggtgaacttgatgctaaatgatggaaaagagaaatatgaaaaagaaaaaataaaaagcataagttctgagcatgtcaatgaagaaaaagcagaagaacacatggatctgaggstaaagcattgcttagcctatgttctacatacatcagggactacagggataccgaagattgtcagantgcctcataagtgtatagtaccaaatatccagcattttcgggtactttttgacatcacacaagaagatgttttgtttctgkyttcacctytgaccttcgatccttctgttgtggaaatatttcttgctctatcaagtggtgcctctctgcttattgtaccaacttctgtcaagttgctcccatcaaaattagccagcgttctcttttcccatcatagagtgactgttttgcaggcaacaccaacattgcttagaagatttggatctcagcttatcaagtcaactgttttgtcagccactacttctcttcgagtattagcccttggtggtgaagcgtttccatcattgacagttctcagaagctggagaggagaaggcaataaaacacaaatatttaatgtttatggtatcacagaggtatcaagttgggcgaccattwataggattccagagaagactcttaactctactctcaaatgtgaattgcctgwacaactgggatttccacttcttggaacagtagttgaagtcagagatactaatggcttcacaattcaggaaggcagtggccaagtatttttaggttgttttatatttgttgattgggaatttttttttcaagaaaaatgatctgatgtgttaattttattcctttcgtctttttcttttgtctatctcatgcttttcagtgataatttttattctcattcatatagtcatgaaataccaaatgttacaataattatttcagataataatgtctaacacattaataaaagtaatttagagactgtaacttggaccttcatatttatatttatagccaaaattatatttaatcagtagtctaagaatttttttaattccataaattttaagaaataaatttcattttatctctgcttaaaaaaaaaaaaaaaaaaaaaaaaaaaaaaaaaagggcggccgc

SEQ ID NO: 1838 - DNA, 1766 bp, Homo sapiens
  misc_feature (1743)..(1743): n equals a,t,g, or c
  misc_feature (1748)..(1749): n equals a,t,g, or c
gctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgcgggccctggttcgtgccgaagggacccaaccgcggagtgatcatcaccatgctggtcgccaccgccgtctgctgttacctcttctggctcatcgccatcctggcgcagctgaaccccctgttcgggccccagctgaagaatgagaccatctggtacgtgcgcttcctgtgggagtgacccgccgcccccgacccaggtgcccagctctcggaatgactgtggctccactgtccctgacaaccccttcgtccggaccctcccccacacaactatgtctggtcaccagctccctcctgctggcacccagagacccggacccgcaggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcggtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcctttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccarcctgcaggagtgggaagcaacacgcaggggtcccggacctctcmagccttgccctyacgcttatccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagactaggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaaaaaaaaaaaaaaaaaaaaaaaaaaaaaaaaaaanaaaannaaaaaaaaaaaaaaaaa

SEQ ID NO: 1839 - DNA, 1542 bp, Homo sapiens
ccacgcgtccgctttctgctgctagataaatgctgatgtttatttttaaaccaggaaacattgatcctgtaacaatgcccgattacaattgctttattacaccccagggctgatggagatgtaatcacttggctaatggatgtgggtgcaggacagatgctcgcttgctggcctgctttcctgcttgcattctgatgagctgcaggagtgcgcctggccttctgcaggtggagctgctgtcagagcttcgtttcactgatacccaaagccatgtctgactgaaataaaacaggttccctttttttttccctttggaaaatgccaactaagggagactaatcagatatcttaacacaatttcatccaggcttagtgctaacaagattgcggggctttttagggtttaagaagatgagaaatgagtgtgcacgtttcacacgttgacttgccggtttttccatgtcatacaaaaaagtcctggctgtttctccgaactggctgcctgcattcccgtctttcttttgtttttaagaaatagactgaattcagctgttaatcctctagtacagtatccatgttaaaatgtttttccattgcatcttttatgtgaattcaaaggtcagaatttattgtctgtgatattgagaccatgtgtacaagaactactttttgcttttcatcattcactccttagcaaacgtttcgtaagtaccctctgtctgtctgctactatatgaggtgctgcgaaattagtgggcgtggctttttatatttttcattcgtgtgtagcctaagtaaggtgactcaagatgatacaccgagagaaaaatgcaaaatatatttggttctcatttctgttgctgtcgtttcctttttaaagacgatttatcaactgctgccatttggaacttcctataagaaactaaaaatgatctatttcagtgttcctttcgcctttcctctgctttctgaataaatggtttcagtaacccatgctgttctctccctattctacgtctttctccctatgttgaaaaaagattcccacagtttctgatgtgtgtgtttatagtcttcaatgtatgttaacatgttaggaactgagtatcttaagagatgtcttagaatgctttagttttcataatttgtcctttatgtatttttcattgtatttgctgttttgacatggaagtaatttaaaaagttggtgcaggaaaggactctttactgttgcacattttggttttctgatatgtaataaattcatggcttggcagctgacatgatgtttcccagagagaaggagatgtatttctgcagggtccagaccaaaagagccatttacagcatgttctcccatgttccattatcagcctgatgaaacctgccctgccaaggcataaacttttgtactagctgtctccatattatgttcaataaattctgtgctctgaatataaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1840 - DNA, 1558 bp, Homo sapiens
ccacgtcgtccgaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttatttttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggttactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaaaaaaaaaaaaaaaaaaaaaaaaaaaaaaaaaaaaaaaaaaaaaaaaaaaaa

SEQ ID NO: 1841 - DNA, 2767 bp, Homo sapiens
gcgtccggttctagatcgcgagcggccgccctttttttttttttttgatatggagtcttgctctgtcttccaagctggagtgcagtggcgcagtctcagctcactgcaacctctgcctcccgggttgaagcggttctcctgcctcagcctgagtagctgtgattataggtgcacgccaccacacctaatttttttttgtatttttagtaaagacggggtttcaccacattggtcagactggtctcaaactcctaacctcatgatctgcctgcctcagcctccccaagtgctgggatgtgcccggctgagacttattttttaatagacttttacaaatgtatgcaaaggaccagttattaaaaaagacagtaagtgaccgccctggtaaatagattctaaaattcaatgaataagaaacagatgaatgtcagacttgtcctaaacccttttcctctatattctgtctatgtcatccctaattagccctcacccatgctgctcttcatttcttctacagaaactgaactagacaaccttggctactcgtctatatactcaattgagtaatttaggttcaggatcacaactaatttagattcataatcacagtccagttttcttttgttttttttgagacggagtctcgctctgtcgcccaggctggagtgcagcggcgcgatctcggctcactgcaagctccacctcccaggttcacgccattctcctgcctcagcctccagagtagctgggactacaggtgcccgccaccacgcccggctaattttttttgtatttttagtagagacggggtttcaccgtgtcagccaggatggtctcaatctcctgacctcgtgctccgcccgtctcggcctcccaaagtgctgggattacagccgtgagccaccgcgcccggtccagtttttttttatctatcatgttcacaaagtaaaagtttactttctccttaaattaaaagattgagtaacctctaaagtttcatcctgctctaatatgcagttaaaaaggttaaaaaaaaaaaaaagctagacagaactacatacaaaacaatggttacatgtgatcagttgtacatttgatactctatagtaaatttctttaaatgaataattaaaaaggctgaatccttactcaataggtggaaataatgggtcatcttcaggaataaatacaaatggatcttctttaaatccaaataacttcattttctttgatggaggaggaccacacacgccatctttcttactgccattattctctaaatcctcagttgcatgagctatttctgtgtcaccagttcctgtgaatgacggactttccagcttagagggatctgtgggtttcccttctgtgagatctgcagggctcagctgtgtgctttctctggtctctgcagatttaccctgaagctttggctgacgtttattccacggcattgaagattttttcaccaatactgccacaaaaaaccctccagtattctgatgatggggtaatatcctaaggcatcgctccaggtgcatggcctgcagcttttctgggtccttcggagggaacatggtaggtcggatctgggtgtgtctgctgtgaggaacagcgtcccagtctgtaaaccactgcccatctttcgtcattaccttccactgtgtgattccaggcatccacttcagccctggcagttcattagacacatcagcaagctccaaagcaccttcacttttttccagtaaagatgctatgactgcttcatcctcaatagggtttagtgaacacgtggaatacaccatccttccaccttcagccagctgttcagccccgcgtgttgcaatccgcagctgtaagccatgtagctgcaagctatttaaggtggtccactttttccaaacatcaatgttttttctcatagtgccgtctccactgcaagggacatcacataaaattcgatcatagaagaggatctctttcctgccgtccacatctatctggagcctgggtatgctggaggcatcatggttgaccaccatgatgcaggggctgctcagcctcttggcttgatggacgagcaggtagcagcgcttgttgtccacatcattcgcaataacaaatccctctggaaaggggacattcatgtcggcatgtagcatttcaattaactgtgtggtctttgagccaggtgctgcacacatatctaagatcttatgatgaggccgcacgttgaggagcagtggtgggatcatgctaacagcttcttgacgactaatatttccagattctgtttcactaactagaaactgatgaaacttttccaagtgtggcgattttctcaagatttttcgacttaaatttgtgtgccaggcaagttcttcaggataccaactcagtggctgtggaacttcaactttctgaccgtccacctccaggtcctccaattccttaaaatatttgttctttaagcaatggagaatctcttttgcgtggcttttgtaaccagtaattcttaaagtggccgggagcggctccctgagagcgtccatgaactggccccactcgccctcgggcacgatcttgagctcctggtagtagtgctcgaacagcttgttctccttgacgatctcggggtagcctccttcccagcccgcctcgccgcgctttccaccaccctcggcgccatcctccgcgtcctccggccgctgctgttgctggagccgccgaccccgcgaccgccgccccatagcccacgcggccgctc

SEQ ID NO: 1842 - DNA, 1077 bp, Homo sapiens
  misc_feature (1036)..(1036): n equals a,t,g, or c
  misc_feature (1038)..(1038): n equals a,t,g, or c
ggcacgaggggaaagccatgctcccaggactccttccttgcagccttaaatcggtctgtacggaaaattccgcgccttagaaacccacgcttgggtgtaacttattattgttcttcctgacctacttcctgtttatcacttccgggttcatcattttggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcggaggacacgaagcaaatgatgagtagcttcatgctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctgaaaaaaaaaaaaaaaaaaaaaaancncgagggggggcccggaacccaattcsccggatagtgagt

SEQ ID NO: 1843 - DNA, 3143 bp, Homo sapiens
  misc_feature (1396)..(1396): n equals a,t,g, or c
  misc_feature (1442)..(1442): n equals a,t,g, or c
  misc_feature (3099)..(3099): n equals a,t,g, or c
  misc_feature (3132)..(3132): n equals a,t,g, or c
  misc_feature (3143)..(3143): n equals a,t,g, or c
gcccagtaaaagctactaggtgacactatagaaggtacgcctgcaggtaccggtccggaattcccgggtcgacccacgcgtccggtagctcagctgcatttgcacctggaacccgcgctctcgcccaccctgctctagccctggcctgtggctgggacctccagcataaaccggatgctctgcccagctctgggcccatttctgctgtttctgctcagttcaaccctgatggcttcctttatgggtgacactccatgtcacccaggcgaactgtcagcctttggagtggcacccagtagggtctttacttccagtttcttgttcacagtcttcactccttcatacccctcactccctgggtaacatcgggccaccagtaatgctggttcctagctctgcaacaccatgcacggtgtagtagctaagagcagagctttcgggtgtgaagtacctgagtacagttcctgccttcccctgtgtgtgcctggaacagagtaaacactcaggaagcgttacccactgctgccattcccagagatgcaaaaggtgaggtctccgttttgccatctatacaatagagataataaaggctatcccactcttaatgtgtgccagtttctgtcctaggcattttgtagatgtgtgagcttatttagtgctttcttattattatttttggagatggtctcactgtgtggctcaggctgcagtgcagcctctgcctcccaggcttaagcaatcctcccacctcagcctttcaagtagctgagaccacaggcgtgtaccacccacccatggctaattttttattttttattttttattgtttgtttgtttgttttgagacagaatctcactctgtcacccaggctggagtgcagtggcatgatcttggcgcactgcaacctctgcctcccgggttcaagtgattctcctgcctcagcctcccgagtagctgggattacaggtgcctgccaccacgtctggctaatttttgtatttttagtagagacgaggtttcaccatgttggccaggctggtctcgagctcctaacctcaggtgatccacctgcctcagcctcccaaagtgctgggattacaggcctgagccactgcgcccagccagcctgttgtttttgtttttgttttgagacaagagtctcactctatcgctcaggctggagtgcagtggcatgatcttggctcactgtagcctccaccttccagattcaagcaattctcctgcctcagcctcccgagtagctgggattacagacatacaccacaacgcccggctaatgktggtttgkttgkttgkttgtgacggagttttgctcttgktgcccaggctggartgcagtggcacaatctyagctyactgcaacctccatctccngggttcaagcgattctcctgcttcagcctccccagtagctgggatnacaggtgcctgccaccatgccgggctaattttttatatttttagtagagatggggtttcactgtgttggccaggctggtcttgaactcctgacctcaggtgatccaccccaccttggcctcccaaagtgctgggattacaggtgagagccaccgtgcttagcccttttaaaaatgtttaaaaattattatttagtcctttcaatgaccctaaggtaggaactgttatctccattttgcaggtgagaacaccaaggcccagggaagatatatcacatttgaacccagattcagatttgaatccaggtggcctggctgctgagtgcatggtttgagtcactccctgtcccccagcttcctctgttccatcactctgggttattttcctccttgaagttatcagggattgatactatcctgtgtttcatttgcttgtttagcacctgtctgctctcacctagaatgttagctctctaagggcagggactgtatcctgccacattggcccacgtctggagagcctgtggcacatggtggatacaccatggatttgttgaatgaaggcgccccctgcaagccaggccctcaccctggcttctggctgtgggcccaggggtgtcctgggagcacaaccctagctgaattcctgcctgccctcccctccaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctcccagacccagggcagtgtggtgggaggggtgttccaaagagaaggcctggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccactaaaaaaaaaaaaaaaaaaaaaaaaaaaaaaaaaaaaaaaaaaaaaaaaaaaaaaaaaaaaaaaaaaaaaaaagggnggccgttttaaaggatccctcgaggggccaaantttacgcgtgn

SEQ ID NO: 1844 - DNA, 689 bp, Homo sapiens
  misc_feature (309)..(309): n equals a,t,g, or c
tcgacccacgcgtccgattttctgataagacgattactaagacaaacttctatcctttcacttagtaagcatcatgacatcatatataatcaacctatctttcttcttacctttggcaactcggaaggtcagtgctaagccttgtggttaaccctagtagtgacatcccttcttatgtcttagtaatcgtcttatcagaaaatatcatataaaataaacacaaagtaaactttttacttaaaaagatctgtagatatttcactaactctattaatgctttggtaatagctatttaatctataatcctgncctagatcaagttttgaggcctcagtgttattcattccttgggctaagagccactgaaatgggataattattggtacagttacttcctccttttaaatggtttctgttctgccatttactctttatttgaaattgccttcttttaaaagttattcttaatattgtaagctatttgaaaataggtgagccataaaaataaatattaataatgtatttctaattatcttatctaacaaaaataataataaatatccactttagaaaatttggaaaatcatgaaggtataaatactaaaatcgaaattctctataagatcaatattcagatttgacctcaggcaaacacagaaattaaagttaaaaaaaaaaaaagggcggcc

SEQ ID NO: 1845 - DNA, 1859 bp, Homo sapiens
gggcggcggccagaggsctgcccggctcccggaagcaggctgtgaggggcgggagcgctgctggaacccgagccggagccggagccacagcggggagggtggcctggcggcctggagccggacgtgtccggggcgtccccgcagaccggggcagcaggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagccctgctcttctcagccttcgaggcctggtatatccatgagcacgtggaacggcatgacttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgcctcctgtcggaccgccgcgtgctgctgctgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggtaccaccttcagcccatgcacctgctgtcccttgctgtgctcatcgtcgtcttctctctcttcatgttgactttctctaccagcccaggccaggagagtccggtggagtccttcatagcctttctacttattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtacagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgatcaaaaaaaaaaaaaaaaagggcggccgctctagaggatccctcgaggggcccaagcttacgcgtgcatgcgacgtcatagctctctccctatagtgagtcgtattataagctagg

SEQ ID NO: 1846 - DNA, 1569 bp, Homo sapiens
  misc_feature (999)..(999): n equals a,t,g, or c
cccggaattcccgggtcgacccacgcgttcgctytcaccatctcccacctggatgattgtcacagtatttcaagccaccctggtccaaacttgccacacttagctcattctctaaactgcagttaaattgctctatgactgaatgatcatgggaaggcctgggccctttctcctcccctcctctctaccaatcttggcatcaaacacatcagcaagccatggtaactcacctgtcactccctgaacacataatgctgttcttttctacatgatcttgtttctgctcctccctctgccttgtggggcttttttacaatttttcacctggctaactcttactcaacctttgaaatttagctctggtgccatatcctctargaaaggtacctctkaatccccagactaagtgaaggtttgagtgcggacagccttggagaatgggagagaatgaggaaaaacctatcaaggagaaattccctagactaagcatgactgtkaggtgaaaaagcaatggtgtcttacattcaggttcaagttcttttgtgktatctgctgctcargaagctccctctttttcctcaaagagtcagcaacataagartgacttartggccttgagttcctcgtgatttcgcattgaaggagaggagaatgattggtgcttagggagaagctgtgctgggaacacatttcagtcataggcaagtgggcaaatggacaaggtaggagaataaagtcccctcctcctgcatccatactgagaattaaaattaaaaaaaaaaaaaaaaaaacatagggatggaatcactaggcatggtggctcatgtctgtaatctcagcactttggggggccaaagtgggaggatcacctgagcccaagagttcaagaccagcctgggcaatgtaatgagaccctatctctacaaaaaaagtagattaaaaattttagccgggcatggtggtgagtgcctgtaatcccagttactkggaaggctgagncaggaggattgcaggaccccaggagttgaaggttgcagtgagttatgattgcaccactgtactccaacttaggtgacacagtgagacccctctttcaaaagaaaaaaaaatcatagggaaaatattgagatacataattaagccatttaatttggacataaaaaaaggcagagctagaagtctagaggatttttgaacgtctagtctgttaattataataacactaagagaagattttatttatttatttatttatttaattttattgtttttgagacagaatctcactctgttgcccaggctggagtacactggtgcaatctcaggtcactgcaacctctgcctcccaggcttgtgcctcagccacccaagtagttgggattatagctgtgcgccaccatgtccaggtaattttttgtatttttagtaaacacagggtttctccatgttggccaggctggtttcgaactcctggcctcaagtaattcacccacctctgcctcccaaagtgctgggattacatgcgtgagccaccatgcctggccaaaaaaaaaaaaaaagggcggccgc

SEQ ID NO: 1847 - DNA, 3541 bp, Homo sapiens
gcgtccgctaacctgtagataactatagatgaaactcacattttccttcccctggttcaccttgacagcattgcagctctggtcagccacagaatgccaggcagtggtggacaccatgatagccgtgtggtcagaagggaagggcacgggagtgagctgggaaccttggctgttggggaagttgcaaagctccagtttcctctaagtgtgcctttatgatccgcactggcgacagcaggctttgtctttccttagaaagactttgtgcctgttctcacttgaccagatatcgtgtacggagcacttgctggcagtaggccaagctctgcacattcatgaattgctttgtctcacaacaccctgagccgtaggtatctttattgaccatattttccagatgaagagacgaaagcccaagagaaccctgttaatgctcggccagatcagaggagacaaaacaagcacccctgccttcatgggttgtgtggatgaatgagggtcggcctagggctgtcccctcgcggtctgtccggtctgtcggtacaggcagcagatgggccacttgttcctggaattgcagaagcagataaccaagtgtagaaaatgtatgtatccctcttctaccccaacagaagcaccgtctttttgctttttctttttttttttagttacagatatgataggtaggtttttttctatggtgtaagcatttctgctgttggattttgtttgctgtttgaagacctgcctaactcgtctcagtaggctgtataaatcgtttaatgaagattggcccttttctgaagtgagaaaaaggatggttgctgaagaacctatctcgagaatacactattgacagactcacggtgtctgtgtgtctcacatcctggaattacttgcacaccattgtggctatgtgttatatcccagaatatggaattgattttgatgtttagaaggccaaagcttacttagtaaatgccacactgattttagcttaccattttgtagtttttttctgtgggaaataacaaaaaaattattgattgaggatctatattgattttacagagctattttagaggaagtatttctcatttaatgaacactttacattggactttccatcttaacaagacactgccccaggtggaactctgtcttcacaacacctgagctgcccagtggtgtcagattgactggtgtcagtttaaccccgttaagtttaaaggatctgtgcaccctcatctggaagcaaagctccgccttcggctgctgtggcccgcctgcccgcagagaggcttgctgggaggtccaggccgcagttcccgtccagctcctggagtcagagctgcaggatggctgttgggggtccttgaagcctgtccagatgcacttgggatgggtttttttgttttgtccagactgtttctgtagattcctaatataatgagccattataattttgaacaatttgtaaagagtacttccagaggaacctgttaaccattcaaccattaggtctttgctgtaagtgtctgtttttaattttctggcagtgcttctgagaattctgcaaagcctcaagaaaaaatagagtaagctgtcttagccaggcccctgtagctttggtcacagcacttcctggtgtgacaaggactcagaccccccgggagccccttggctatcctcagcactgtttattcctcctcaggctctgcctggcaccctaccctccctggcactctttctttgtcaggccactcgttgccaccctgagactccagctcatgtctgatttgtgcatcctacttaactgatgtgtttttcctcctctctgtgtgtgaggatgttgtcaccacctcacattggctcttgagtgtgaagtgtcttgctgcacggcagaaacagacctagagaagtcccttggtttggccagtattgtgttgctgacaggcggtggatcaagagttaaaatgtaggaagtccatgttctgtcccctttgacaagccattttcttaatctgtacaaagggaacaatgtctgcaccacgaggttggggagattttcagtgagagtggatgtgaagagtgtttcgtaaaccataaagcagtttattgtcattgatgattctcagctttgcatgaacctgagggacaccagaccacttgctctaggagcccatattctgggttctttgtcctaaactactttttgggccttttcctaaaaatacacattctaagagtcaaggtaagagtgttcctaatttggtgcatggatgagagttcatgttagttttcattgaggctggaagttaaacctgagccattttcctgtccagctgcactttgccacaggctgggcacactggctcatacctgtaatcctagcactttgggagactgaggaggattacttaagaccacgtgttcaagaccagcctaggagtatagtgaggtgccatctcttttaatttttaaaaaatagtcctagtgactcttaccaggccagtcaccatctccaggagcccccctgtgggagtatgttcagtgtctgccctttgtgaagtggggccttttgtcccgccacctacccccagggcacttaaggcctgggtgtgtttctgccggcagggacttgaaggtgtctggcagtgaaggaaggagaggatgaagggaggctggagagggagtggcgagcggccagaggcaggcggggccgtgggaagggaaagcagcacaggcaagctgagtgcacattggtgatgagatacagagatccatgattgaacttctagtgtatcttagcccactggggctgccatgacaaaacaccatagagtgtggctcatcaacagcaggagtctgttgctcacagctctggaggctggaggtccagggtcaaggcactggcagattgcatgtctggtggggccccgcttcctggtccatagccagcaccttctcactgcatccttatgtggtggaagaggcaggggagctctctggggtctcttttgtaaccccattcttgaggcttgtccactctcatgacctaatcacctcccagaggccctgcctcctaacaccattaccgtagagtgagagcttcagcctatgaattttggggggacatgaacattcaagactaatattctttcagtattccagttactgaatggtgtgtagtattcagtggagaaggtagctgaaattaaggggttaaaattgtaataatggccggttgcggtggctcacgcctgtaatcccggcactttgggaggctgaggccagtggatcacaaggtcaggagttcgagatcagcctgaccaacatggtgaaaccccgtctctactaaaaatacaaaaaattagctgggcgtggtggcacacgcctgtaatcccagctactcaagaggctgaggcaggagaatcgcttgaacctgggaggcagaggctgcactgctgagctaagatcgtgccactgcactccagcctgggcgacagagcgagactccatctcaaaaaaaaaaaaaaaa

SEQ ID NO: 1848 - DNA, 1073 bp, Homo sapiens
tcgacccacgcgtccggagaataacaatagtaaataataaagtcatactgaaatgggatgctaaattacagcttgaagcagaggactcaaatttgtgcctttaacaaatctcatctagtccctgatcaaacaagcttatggcatgtcacagacatcaaaggtccctttctaaaaatcaggaatttaaatctgtgaacgtcagtggtctatatatatttttttcttataatgaagtctttaattaaaacctactttttactatggactttaaaaaaacttcttcctctttccacactcattccaattatgctctctcctttggatatattcttttctgataatccccacatcgattgcagtggtcatcactttgtgccttacctcttgattgggctagacacggaccctcagtttacctgcctttatctgctgatcctgactttattggtatttgtcttctctctcaccctgctgtcccctccttcaccaggatgaaaatgagcaggaaggcccaaactttaggatctaggatctggaacttctcctttattactttattggattgacttctctagatcaagctttttaaaaatctgcctctcaatccacttaagattagagtatttaaaacattgatttttttaaaaaataaaattttaaaaacttttttacagtttactttgttacagcaaaactttacacgcctgtaatcctagcactttgggaggccaaggcgggagtgtcacctgagcccaagagtttgagaccagcccaggcaacgtactgagaccctgtctctacaaaaaataaaaataaattacctggacatggtaacgtgtacatgtagtcccagctactgaggaagctgaggtgggagcatctcttgagcctgggaggtcaaggctgcagtgagccgtgatggtgccactgtactccagcatggggacagaaggagaccctgtctcaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1849 - DNA, 1860 bp, Homo sapiens
  misc_feature (1846)..(1846): n equals a,t,g, or c
  misc_feature (1848)..(1848): n equals a,t,g, or c
  misc_feature (1853)..(1853): n equals a,t,g, or c
ctcaccagmsggaaagtacgagtcggctcagcctggagggacccaaccagagcctggcctgggagccagkatggccatccacaaagccttggtgatgtgcctgggactgcctctyttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaagagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcggtcggatttggggagggccctgaggacctggccccgggcaagggactctccaggctcctcctccccctggcaggcccagcaacatgtgccccagatgtggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaaaaaaaaaaaaaaaaaaaaaaactcgagggggggcccgtacccaatcgccngngatgntagtata

SEQ ID NO: 1850 - DNA, 1865 bp, Homo sapiens
cgaacccggggtggaagggaatgaagaaaatgactcttctctgaagacaggacttgagaaaatgcggagtggcaagatggcacccaagccccagtctcgctgcacctctacccgctcagcaggtgaggccccttcagaaaatcagagtccctcaaaaggccctgaagaggccagcagtgaggttcaggacacaaatgaagtgcatgtgcctggtgatcaggatgaaccacagacattgggcaaaaagggcagcaaaaacaatatctctgtttatatgaccctaaatcaaaagaaatctgactcttccagtgcttcagtgtgtagcattgatagcacagatgatttgaaatcttccaactctgagtgtagttcttctgaaagctttgattttcctccaggcagtatgcatgcaccttccacctcctccacttcctcctcttcaaaggaagagaaaaagctcagtaattccttgaaaatgaaagtcttttccaaaaacgtctctaaatgcgtcacaccagatggcaggaccatatgtgtaggggacattgtttgggccaagatatatggcttcccttggtggccagcccgtattcttactataactgtgagccggaaagataacggccttttagtccgacaggaggcccgtatttcatggtttgggtctccaacaacatctttccttgctctttcacaactctccccctttttagaaaacttccagtcacgctttaataagaagagaaagggcctgtatcgcaaggctatcacagaggcagctaaggctgccaagcagctgacccccgaagtgcgggcttgttgacacagtttgaaacgtgaacatgggcagtaaggtaggcaagaccattggaagtcaccacagattttctagtctagttaggaataatttctaccaaaatagcgtggccagattggagagagaagttgcactcagttggctggctttttaatacttaccttatagccatttttagactgaggagcttaaactgaacatataatcaaattttgtgttaaggaagtgagattttagcagtatttttcagttttgaagttcgaaaccatcccaaggcataggagccatagcctcaactgaaattgaatttttgtagggactgttaattgccatttgtacctaatactgtatatatacatatatatacgtgtgtgtgtatatatatatatatatatatatatatatatatatccgtgtatgtatatatacacacatatatatgtatatatacacatatatatatatgaaatacagcctgtcactgtgtgacacagattgcatatttgggattgcaataagggcttggtgagctgggggaatagtggatatttaatgactacttgttttttaaataatgaacacttagcctttctatgcgcataatggtgtaaaagttagatggttaggtgtttgacaaacagatggttgcaattcagttacagactggggaaatagcccagtgtttgggattaaaactgtcaagactggataggtgttagtcatcactgtctttcgtccagtggggatttaataaatactttcaagcttctggtttgggagtttagataggtttgattttggatttgtaaatagtgattgctaaatttggtcagatttctcctgactggctgttcctaaattcttaggatatgtcccagtaaaattatactttgtgaattaattgtcatatgtgtaattgttgcattttggatgtacctaatttgataattaaaacaaaataatttccgtttaaggtatctgtttgcaggtcagaaaatgagaaaatgtaattgtgtaatgctctgaaatgtaaaaaaaaaaaaaaaaa

SEQ ID NO: 1851 - DNA, 1133 bp, Homo sapiens
aggatttttccttgttcaaccaaaatctgagcattctttctatgttgaaaacactgaaaaactaatttwagttaatgaactagaaagaatattgattttwaagaaacagaaaaatactacttattttccttctcaaataacgtttctttcaaaaacttctggctgaagtataacatgctggtagttaacataaatcttgtctttctcttgttctttatctttctttgttatttagatgcttgtataaatgtcttttgtttttattaagtgcctaattgacagagcttaatttgaagaagtgccctaatttattgaccacttaagaattgcctttattggggtattttatttgttcctgcgtctttttgatgttgttcagtctactcatccctgtgagtatgtgtgggggacagctgatagaagggaggagagtgtgtctatgctcaggattgccctttagccactcagccagagatccacagggagcaacaaggacagtttcacatgcttagactttcttggaagaaacagtgaggaggagtaagtcgtgagtagtgtcaagctggatgtagaattgtcctaaggcagttgaccccaccttccaacatgttttcactttatttgcccctccctacatttgggttaggttccatttggatttgcagcaataatgactttatttctctcttggtcaggatttggcacataaaatccttttattatagaactagctattttagttacatagtaatgtaactaatggagagatttatagagaattttgkttttgctgtcatatatgtccattttggagacagatatgatagaactagaaattaagttgcatttctgcaagtgccatttgaatgaacttcaagtatcttcttaattattaaattttctgatgaaggcattgtaacaaatatatagtattattaaatctaattaatatttggaaatattaataaataggtattttatttactgtaaaaagtcaaacttcattatgtagataaatcttattcttttcattctttcccctgtttacatcctttttacaaagcttagtcaccaattaaagctttcctatcaaaaaaaaaaaaaaaaaaaactcgagactagttctctctcct

SEQ ID NO: 1852 - DNA, 1089 bp, Homo sapiens
  misc_feature (38)..(38): n equals a,t,g, or c
  misc_feature (48)..(48): n equals a,t,g, or c
  misc_feature (60)..(60): n equals a,t,g, or c
  misc_feature (92)..(92): n equals a,t,g, or c
gaaggggagtgtgcaggcgttaagtggtacgccaggtnttccagtcangagtgtaaacgncggccagtgattgtaatacgatcatataggcngattggtaccggccccccttctttttttttttttttttttttgtagtaacatccagtattttaatatttatgcttgataagtcatttaagttgaagactctttatgtattaatttcagcaagtaacataaccacacagaatagacaatgaaagcataattagtcattatacacaattataatttgataaaaaatttcaacatatacagaagtataaagaatgtgtatctatcatgcagcttctacaattatcattccaactcctcgtttctttgatattgccaacaatttacaccctgccccaattccaaatttggaaacaagtcccagatattaatataatttcctcttcaacatttcagtatgcctgagagattcttgtttaaaaaaaacattttttttgaggggcacagggtctctctctgtcacccaggctggagtgtaatggtgtgatcttggctcactgcaaacctctgcctcccaggctcaagcaattctcctggttcagcctcccaggtagctaggactacaggcgcacaccactgctctaggaccgtgtactcttttagagatggggtttcaccatgttagccaggctggactcaaacttctgagctcaggtgatccgcccaccttggcctcacaaagtgctgggattacaggcataagccagggtgccaagccttgttttaaaatttaatctttatgctctgaatggaaaggctataaatggagttcaatgaaaggaaaaaacatttaaaaaatagaagttctttctttcttctttttaagatggagtcttgctctgttgcccaagctggagtgcagtggcacgatctcagctcactgcagcctcccctgggttcaagtgatcctcctgccttagcctcccaagtacctgggattacaagcgtgcaccaccaggcctggctaattttttgtatttttagtagagatggggtttcgccgtgttggccaggctggtctggaactcctgg

SEQ ID NO: 1853 - DNA, 2939 bp, Homo sapiens
  misc_feature (2500)..(2500): n equals a,t,g, or c
gcctaggaacattttttaaggactcagctgtggcttttagggcttggttcataccatgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccataacccctaactggacaaatgaggtctgtttctttgggcctgaggctgtgcatataaagtcttattttgggactttacaaacttgtcctaactatcttgtggatagtgggctgtgacaatctggaatagagaacgttcacacttcgctcctttaaagaagcgaccccagatctgcaagggagtagattctgctatcttggcctcacagcccttcctgttgattacaaagcccgtggaagaaaacagaacacaccctcctcagttccgtctaaatgtgtttcttctgcttcaattacaccagttctggggcaaagacactgatgaaacaacacccatacctgaaaagaataaatgtgtgactttcaaatcccctttcgcagtgaaagaaacagcaaacacttaagattcagcatctgttctccagttgcactgaggaatgcactgtctcgcagcaccagctctgcagagcccttgccccagactctttgcggttttatttatatgtatttccatatttcattcctgtgtgtcactgctgcattggtgtggcagcaagtgaccaaatgctacaggtcttactatggacaccaggtcaggtgcaaccacacaaaacaaagccagttccatgagctgcctatgatatgcattgcggaagtaacattttacccagggtgtgccattgcagtgatataaatatatttttttcttagactaaatatgagctgactatctcttttgatgtgtgtacataggtgtgagtgtgtstgtatgcgtgcctgtctgtgtgcgggtgtgtgtatgtgcrtagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatctacacgcatcctgtatctacacgtgtattttgtagctgtcacactaaccttaataagaattctacagctttggacagaggcattttcaccttaatggygaagtaatttaaaatataaatccattcaggtgacaacccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcgaacgaatatatgcaattcatatacttttggagatgaacgtagatatgtgtgtcagctttgagatggtgtgyccyggattaatactttgtctccccaatatcacagaaaaatacatgcccagtgactcttgaggttaaggtagttgggatgaaatggcctcaggcaatttcacattccctaattacctggaaagttctacagtaattaatatgcagctaactcctgttgccctcacaagagcatcagccttctagaatcggagctccggagtgtgaagattcagtattgatatgatatgtataccaaactccagccaacttactgccatttttcataatctgagtggctgccttgcttatcctaagctgtggttgcagaaaccgtggccatttatataagctataacatcaaatcagggaaaaatgaggaaaaaaaatagattctgaaccatttattgttgaataagtagagaaaatcatcaataaatatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggtaagggtaggaggccaacttcaggatctgggtctragcccgtgggsaagccctggccgagtgagctccaatgctaactcatgtgccgatctctagagcagtgggaaactaccccgctgcaccaaatcaagtagcttcaccttgtgtatgcaggccccaagttattttttagcaatcttacgagtgaaatgttctggtgggttgaaaaacgttcttattttaaagaaaggttgtgctcgctacactgctggtgtgtgcrttctgagacctcttgtattccaatctgtgaagggatatgtgtattaatccgtacacccgtatagcctcaatatttgtctgaagacacttaaattctgacccataaggaaagttcctagangccaatattttcacttatttaacattctccaaacaacatcaagcattgatacacactgaagagtgcgtttattttttgtatcactctaagtatgttggaatatgcaaggactgtggttcaaattagaatgtataaggcatattataatttagttcatactgaaaaagaaattaacagaacattgttcggttcacacgttccaaaatttgagtgatttctggagttagacatagattttctattttgttttaatttgtcaaggtatttttcttcccttcatgaactttaggtacacataacttatgtcatttatttatggtcttttatacctagtttgtaaaattgtaaaatagcaaactaaatgcaaagagtttgcatttgaaaataataaagtagttaccgtatacaaccctgcaaaaaaaaaaaaaaaaaactcgag

SEQ ID NO: 1854 - DNA, 1441 bp, Homo sapiens
ggcacgagtacacatgatgttgcctgtcattagcctgtttttaattagtttacaccttcctatcttttgcttccaaagactcttactttttaaaggatttctttttatagccaacagtagtaaccttcatataaaataaatattttctggtgttttcctgtttttttacttttggtggtttttctgtatacttacatgttttattcatggacgccatcctttgccactgtgtcttttattccaaaaccaggaagtgcttcccaccttcgtatttttatccttttccccctgtgaactcaccatttgtgtatcttctttccatgtctgtcttgctttgttgcctgcagttatttgtaaaatattcaaaatattacccaaattgagatgagttgtagtatctggattttattgagtgttactaagcacatttgacattagaactaaaggcagtaggctggtgattagaagcagcccaagtgggtttgcttgaaattcagtcaagaatatctgtctggttccttgctatcttctcgaatgggctaatggtatcagggctatatttcgtagacaggaaggcaaaaacagaagggaaagtgacttagtttcattgagagagactagatcagggtcagaacatgaactttcatgtccctaagtttcactgaagaaagctcaggcctctttgcttagtggtctgtaaagcctaagagaaggtggtccggtcgttttcctgtttgtccaaatgtcgtgagaatgatgacattaataagagaagtttctaggggcttgctatttcatgtcactcaaggtagtagatcctaactctaggaactgtaggctgtgggtgacagattccttaaaatgcctcactgcgtggcagacctgatgtgtgtggcaaattaccctgcttgaagggagtcatgctggcctggcaaaggcagtaacctgtgtacttggggaactgttaagatgcacccttaaggagctgagatgattgcagagtcataaactcttaagtctatttgccactggacatttgcagagatgatcatatttacttccctcctcccaccactcttcctctcagtttcctttttactttatttttttctccctttcctggtaaaagtattagtatgtttaacatagtgttaggtggcagataggctgggaagagctagtattgtaaaggaacactgatgtgtactggagcctactagctctcaatccattgccccagacttggggagagagagcacattctctatccagagaaataagaatatgcagtttatggttgtcctgtggacattaactgactgtgaaggtaaggtatatgccaaaggcagtgatatgcaggtgatagattcaccaggagatgatatgtgacttttcttgtattttaaagctctgcttcttttttaaaaaaaaaaaaaaaaaa

SEQ ID NO: 1855 - DNA, 1014 bp, Homo sapiens
gaattcggcacgagtttacatcagaaaagagctggaagtcttcctgcaatgaaggagaatcctcttctacttcttatatgcatcaraggtcacctggtggtcccaccaaactgattgagatcatctcagactgcaactgggaggaagatcggaacaagattttragcatcttatcccagcacatcaatagcaacatgccacaatcacttaaggtgggcagcttcatcattgagttggcttctcagcgaaagagccggggtgagaagaaccctcctgtttattcttctcgtgtgamaatctctatgccatcatgtcaagaccaagatgatatggctgagaaatctggatcagagactcctgatggtccattgtcccctgggaaaatggaggatatctctcctgtgcagacagatgccctggattcagtgagggagagattacatggaggcaaaggtctgcctttttatgcagggctttctcctgcagggaagcttgtggcctataaacgtaaacccagttcaagtacatctgggcttatccaggtgagaattatctttaatctgggtatagcacctttgtatacacctaggtagtatcatgatttttcagagccctttatggtcctgatatcctttatcttgacatttcctgggaactgggtgacaaaattattatctctttttgtaataggcctagtttagatgcatacctagagtgaatttttgtcacatttatgaacagaaacgtagagccttgtattagttttaattttctttctaatcttcccagaaagttgctcttcataaactttattgcctgcaggctctagtgatactttgacaataaagcaagggtaatcagggattcagtctagctcttggaatttattattagcagataggtttcaaaacaaaaccatggttagaacggtaggtgtaaggggaagatgaaattgacttaaagataggcaatatatgtttagaaacttggggaaaaaaaaaaaaaaaaactcga

SEQ ID NO: 1856 - DNA, 1692 bp, Homo sapiens
ggcacgagaggaaagtgacatggctaggtggctcttaccctgccttccgcctctccacagtgtgacaagctggctgctgactgtgcccacgagctgcggcgccatggggtcagctgtgtgtctctgtggccggggattgtgcagacagaactgctgaaggagcatatggcaaaggaggaggtcctgcaggatcctgtgttgaagcaggttggcaaggggagggcgaaggaagcagagaacaggggagtcggcctctgcatcctcaataacaagatcagatactcccactcaccaggtgcttactgtggcaggtgcagggctgagcatgggacacacattatttcctttaatcctgtaagggagataccagctccattctacagatggcaaaactgaaacccagagaggtttagaaacttgttgaaggtcacatatgtcctaagtggaaaggctgtctagctccaaagaccatgcacttgacccccacaccagctagcttagaaggtccaaacactatttggcactaccagatccttccacttagcaaagacagcagatcctggtgccagggcacagggctcacctggatgtggggaggagtggctctggcacctgccaatactttgggtcctacaggccctgcttgaggtctttggcctctttggtctttggtctttttctcctggaacagaagttgaaatggggaggagacctgggcagtgctcttggaaattaacccttcacttctctgcccctgtgtttcagttcaaatcagccttctcatctgcggaaaccacagaattgagtggcaaatgtgtggtggctttggcaacaggtgaagtttgggggcagctggtaataagaaagggcatggaggatgtgtagtgcggtagcatccagtgcccagatctggctcgggagttggttgaggaacatgtcattcttttctctgctttttgaggcccaaggggtcagcattcccagtttgaggtctgagagccttaggagcaggctcctgggaagtgtggaaaaagtccaaggcccaagagaaagagctctccagggatcctgagctccagggctctcagcagtgccctgtccaactgggcccaaaccttgtcactctgcatactcccctgcctgccatctccacctgtctgtgtgcccgcagatcccaatatcctgagcctgagtggtaaggtgctgccatcctgtgaccttgctcgacgctatggccttcgggatgtggacggccgccccgtccaagactatttgtctttgagctctgttttttcacacgtgtccggcctgggctggctggcctcctacctgccctccttcctccgtgtgcccaagtggattattgccctcaacactagcaagttctaaccctcctggtctgacactacgtctctgcttgtcttctcatttggacttggtggtttgtcctgtctcagtgaaacagcagcctttcttgtttacccatacccttgatatgaagagaagccctctgctgtgtgtccgtggtgagttctggggtgcgcctaggtcccttctttgtgccttggttttccttgtccttctttttactttttgccttagtattgaaaaatgctcttggagctaataaaagtctcatttctctttcaaaaaaaaaaaaaaaaaaaaaaaaaaaaaaaaaaaaaaaaaaaa

SEQ ID NO: 1857 - DNA, 835 bp, Homo sapiens
ggcacgagcacaaaccctagaattcccagggtacacctgttagttgctaaagatatttcaagaacagttatctctctggtaaagtttatttgctcctgtgcaaggtttcatttctttcaacagagtgaaacaacttggggtacaatgttattgttagtatattttcttcttatgtctgtaatatttggcactaaattctttcctttaataatacacatgtttaacccatgcatacttaaccttataaaacttgttttttctctcatgcctggaagccatcaaactccaaatgttcaggcaaccagagcctcagatgatggctccgctttgctaggaacccccagtagacctctcggaagcatccgacagcagtttaccccaaaagaatgccccctgtcagcaggaagcagctaagaccagtcattgtcccatattctcatggcagttagatacacctcttcagagaggggaaataatatgggagtgctaggaagggaagaacatggctggctagggctccataccctggctagtcctggctagggctccacactcacggacctaactgagaacaggtatttctcgcccaaatgttgcatttcccaagaccaccctggctggacattgagaggaacacactgacaggcaccagcatgctggtaggccactgactgacagaacaatgcagagtttggctggggcagctggaggacagtctgggccactgagcagcctgacttcaggggaaaaccatctcccttctgactctcccatctgctggtagctatttccactcaataaaaccttgcactcattaaaaaaaaaaaaaaaaaaa

SEQ ID NO: 1858 - DNA, 2994 bp, Homo sapiens
gagcccgagcccgcggagcagctgaagactgggggagcgcgttcggcctgtggggcgccgctcggcgccggggcgcagcaggttccgtcagccctggcgcccaggcgcatctgactcggcaccccctgcaggcaccatggcccagagccgggtgctgctgctcctgctgctgctgccgccacagctgcacctgggacctgtgcttgccgtgagggccccaggatttggccgaagtggcggccacagcctgagccccgaagagaacgaatttgcggaggaggagccggtgctggtactgagccctgaggagcccgggcctggcccagccgcggtcagctgcccccgagactgtgcctgttcccaggagggcgtcgtggactgtggcggtattgacctgcgtgagttcccgggggacctgcctgagcacaccaaccacctatctctgcagaacaaccagctggaaaagatctaccctgaggagctctcccggctgcaccggctggagacactgaacctgcaaaacaaccgcctgacttcccgagggctcccagagaaggcgtttgagcatctgaccaacctcaattacctgtacttggccaataacaagctgaccttggcaccccgcttcctgccaaacgccctgatcagtgtggactttgctgccaactatctcaccaagatctatgggctcacctttggccagaagccaaacttgaggtctgtgtacctgcacaacaacaagctggcagacgccgggctgccggacaacatgttcaacggctccagcaacgtcgaggtcctcatcctgtccagcaacttcctgcgccacgtgcccaagcacctgccgcctgccctgtacaagctgcacctcaagaacaacaagctggagaagatccccccgggggccttcagcgagctgagcagcctgcgcgagctatacctgcagaacaactacctgactgacgagggcctggacaacgagaccttctggaagctctccagcctggagtacctggatctgtccagcaacaacctgtctcgggtcccagctgggctgccgcgcagcctggtgctgctgcacttggagaagaacgccatccggagcgtggacgcgaatgtgctgacccccatccgcagcctggagtacctgctgctgcacagcaaccagctgcgggagcagggcatccacccactggccttccagggcctcaagcggttgcacacggtgcacctgtacaacaacgcgctggagcgcgtgcccagtggcctgcctcgccgcgtgcgcaccctcatgatcctgcacaaccagatcacaggcattggccgcgaagactttgccaccacctacttcctggaggagctcaacctcagctacaaccgcatcaccagcccacaggtgcaccgcgacgccttccgcaagctgcgcctgctgcgctcgctggacctgtcgggcaaccggctgcacacgctgccacctgggctgcctcgaaatgtccatgtgctgaaggtcaagcgcaatgagctggctgccttggcacgaggggcgctggcgggcatggctcagctgcgtgagctgtacctcaccagcaaccgactgcgcagccgagccctgggcccccgtgcctgggtggacctcgcccatctgcagctgctggacatcgccgggaatcagctcacagagatccccgaggggctccccgagtcacttgagtacctgtacctgcagaacaacaagattagtgcggtgcccgccaatgccttcgactccacgcccaacctcaaggggatctttctcaggtttaacaagctggctgtgggctccgtggtggacagtgccttccggaggctgaagcacctgcaggtcttggacattgaaggcaacttagagtttggtgacatttccaaggaccgtggccgcttggggaaggaaaaggaggaggaggaagaggaggaggaggaggaagaggaaacaagatagtgacaaggtgatgcagatgtgacctaggatgatggaccgccggactcttttctgcagcacacgcctgtgtgctgtgagccccccactctgccgtgctcacacagacacacccagctgcacacatgaggcatcccacatgacacgggctgacacagtctcatatccccaccccttcccacggcgtgtcccacggccagacacatgcacacacatcacaccctcaaacacccagctcagccacacacaactaccctccaaaccaccacagtctctgtcacacccccactaccgctgccacgccctctgaatcatgcagggaagggtctgcccctgccctggcacacacaggcacccattccctccccctgctgacatgtgtatgcgtatgcatacacaccacacacacacacatgcacaagtcatgtgcgaacagccctccaaagcctatgccacagacagctcttgccccagccagaatcagccatagcagctcgccgtctgccctgtccatctgtccgtccgttccctggagaagacacaagggtatccatgctctgtggccaggtgcctgccaccctctggaactcacaaaagctggcttttattcctttcccatcctatggggacaggagccttcaggactgctggcctggcctggcccaccctgctcctccaggtgctgggcagtcactctgctaagagtccctccctgccacgccctggcaggacacaggcacttttccaatgggcaagcccagtggaggcaggatgggagagccccctgggtgctgctggggccttggggcaggagtgaagcagaggtgatggggctgggctgagccagggaggaaggacccagctgcacctaggagacacctttgttcttcaggcctgtgggggaagttccgggtgcctttattttttattcttttctaaggaaaaaaatgataaaaatctcaaagctgatttttcttgttatagaaaaactaatataaaagcattatccctatccctgc

SEQ ID NO: 1859 - DNA, 512 bp, Homo sapiens
tttttttttgcagaaaataacagctttattgctacagatgtgagagcatttacaaaatgccaaggaaaaccattccgttttgagtctctggagcctgaactctcaccatgtaccagaaaagaatgcccctctttcgaactttcaaacagttgggattatttttgtttcttatcatcccaattatttgctcaagtttgcctccattgggycccgttcagagtttcttgggctgcttgtactagtcacagctccacttccatctcttctcaggaagaggtgggcacaagacacatctgagccccttagtattgtgatggtggccaggaaatgatcaaagggtagcatttaggaaatcagcaaactaaagcctcaaatcaaaggtggacaaatgcattctcaactcaaacaggttgggtaatgctttcataagatacattatgttttkgtgtacacagcacacaaattttattatgtctacaaacagattcaggaaagatctccaggctatttcc

SEQ ID NO: 1860 - DNA, 746 bp, Homo sapiens
gacgtctttctctgacttggttttaaggccagccgcgtgctcacactgggcttacagaaacaggagacgccgtcctcggccgtctggggtgggctgtcagcacgtcgtgtggtcaggtgtcaggacaagcgggcgtgagcgagtggaggtgcatctgcctctgccctggagaacggatgtgctacagctgtgcgcggcgtgatcaagcacctgttgggtggacggcacacctcccagtggccagctggagacggagggctggaagtacttgcccggctcctctctctgtaggtttggtcttcggccttgcagctgccctggtgcttgcagattgcggtttgatggaccaggcacttttcatctcttacacagccagtggttcagcactgagtcatgcttgcttctgctacgcactgatttgttctattccagtttccacgtacatcgttttggtgacatctctgcgttatcatttatttatatgcgagtgtattttctccaaaacttctctacgagggaatgcacctgcttattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcact

SEQ ID NO: 1861 - DNA, 1461 bp, Homo sapiens
aattcggcacgagttttgctctgtttacatagctttatacctttttatatactaaattgaaatggataggtagaagcaatattttcagaattggtcattgtcctgaataaaatgagccactgtgttctctcaggcaccatgcaagctcacccaatattcatataccacaaaagggtgtttttcctgcttaagtttatattctatatcatattctgttttttttttctggatatttccactttatattgttctctttcaacattttgtaagaagtagtattcctattctctgctgttacaaagactatgaaaatacatgcaactcatttaaagaaacaggtggatgtctggaagttttctctacctaacactttcacatataaaatttatgatgkttggkttctatggtawttaacattggcaagaaaaaataactcccaatgaagtaactaagaccacttgttcyagtycttcctgtagtggaaagagrtagagaagagtgatagtaacaaagtattctcattactctagaacagagattgscaaacatttttctgtaaaggsccagatggwatatacttttggcttcgtggsccatagggtctctgttaaaactgctcaactctgtctttggggtgggaaagcagcagtagacactttgtaaatgaatgggaatggctgtgttccaataaaactttatttacaaaaataggctgtgggcagcatttagcctgtgttctgtagtttgcccatccctgctctataaaaagagtaggaaactatgccccagggccaaatccagcctgaagcctgtttttgtttggtcacagagctaggaatggtttatttgttttcaaagagttgttaaaggaggagagggaagaggagaggaaggaaaaggtagaagaggagaggaagggagagaaataggaagaggaagaagaggaagaaaaccttatgtggcccacaaagcgtaaaagttgaccatttggacctctatggaaaaagtctgttagatcttgctctgagagattgtttacttgtaacttccttgataatttcaacttatggatttgattttgtgctcattttctattttcctatgcttatagtcttcgtaatatgaagcaagtaagtttattagtcagataaaatacagaatttaaaattttggtaatgtattggctatcagaaaaaatactgattgctttctatgtcactttattcttttgaaatttgagattttataagaaattttgaaaatgtatattattctcttgtcttgaaaatgtttttaagtgggaatataagaaacaaggatgtgttgctgcttaattctgtgcctgaactttggagtcttctgatctgtgtttgggacagagaatgctctagctatgctaaaaccttttcaataattgtaacgttgtttgatgttagcaaaaaaaaaaaaaaaaaactcgta

SEQ ID NO: 1862 - DNA, 2143 bp, Homo sapiens
ggcacgagatttcttatcacaatgttgctgttagtagtaacactagtaaatctgagtatttataagctcataaagcttgttacagccttaagcaaaaagcttggggccaagggcgttttaaaaaatgcacactttatgaggtgcaactgcggagaaatgaggacgcgttcttaagctttggtattcacatggtggtggtgctggtagaggctgttacatttcttccagtgaagctgttcttgcagccgccttggaattcacttcagggccagtttatgagccaccccaagtaatctgcttggagtctgagcatcataccttgtatttgaccaaaatatatgtaacaaatttaccattttaaccattgttaagtttacaattcagtggtatttgcagtgttgtataaccgtcatcactgtctatttctagaactttttcatctttgcaaactgaaactctgtacccagtaaacaatatctccccatttcccttccctccagcccttggtaacctcaattctactttctgtctctgaattggcctattccaggtacctcatataaggggactcatacaatatttgtccttttgtgtctagcttatttcatatatatttattcaaagctcataatgttttcaaggttcattcatgttgtagcatgtatcagaatttcatttcctttatggctgagtaatactccattgtatgtatatactacgttttgcttatccattcatctgtttatggactcttagttgtttccatcttttggctattgtgaataatgctgctatgaacattagtatcttgagtccttgctttcaattcaatttttttttttttttaaacaggatctctcaccccatcactcaggggggcgcaatcacgactcattggctcactgcagcctaaacctcccagctggagcaattctcctgcctcagccttctgagtagctgggactacagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagaatcacattttcttgcttagtcatgtgtccctccttgagttgccccctccttgtgggtttacactacatttgggagtcattgtctaatgctgacaagcacaccctctcccattatttgtgcactacagatctcctgctgatcagtcacctttgttgctgctgtgtagacagagccaggcctcacctgtttgtttaggccaagatgccatggacatgcagcgttagtgatcccactagctgcgacagccaggcccagaaaatgcctggcgtgagagccagcagacagccaggccggggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggtgaataaactgacatgcatgcttcaaaaaaaaaaaaaaaaaaa

SEQ ID NO: 1863 - DNA, 543 bp, Homo sapiens
  misc_feature (463)..(463): n equals a,t,g, or c
  misc_feature (483)..(483): n equals a,t,g, or c
  misc_feature (520)..(520): n equals a,t,g, or c
  misc_feature (528)..(529): n equals a,t,g, or c
aattcggcacgaggccttttgtaaggggagattatggttgaattgattacaattgcatgaagatggtatatagatcttgttgctctctgagggtatttatgggaaattaactttttatgtatttaattgaatttagaaatatgttgcatccacttttcacttaaaaatatgtgaaccagaatggccaccacggggaccaagcccacgtcatgctggtgctggttcctcctggccatgtgctggtttgtgcagctgagaacagaatgggaacgggcatttttatttgtccccatcgcccgggagcctggtcggttgtgtcgcttctcaggcaataagcaactgaatggactggcagtggctcttcaggcttttaggtttgctaaaaacaaaacaagccaaaaaagatgcgcctgacttcctctcgtgggccaatggcactgcccaaggggagcaacggttcctnggggccacggtggaggatgncccacctgttccagagtcccaagaagccctgaatcgncaactcgnncacttgcagcctgt

SEQ ID NO: 1864 - DNA, 600 bp, Homo sapiens
  misc_feature (594)..(594): n equals a,t,g, or c
gaattcsgcacgagtgcacctgccaggtcgctagtaagtggctaagctggcctgagaacccaggagtcccgtgctgacactgttgcctgctgtgctgcccactgtgcggtggtatgtgggcatctgtcaccttattctactgcagtgtgtgtaagacatctgcccgtctcgtaggcaaagcttgccatcaaagtgctgggtgatgtgtgtctctcctgtgtctgtgtgcccctttctccccagcctgcattttattaataattggtgtaatgtctcatcttgacctttgcctgtctttctgttgggttggtttgtttttcattgctcgctctttctctcctatgggggctaattagggaaataaactgagtagctttttaaaaatgtcattcccaggcccctgccccagagattctgtgtggatcagcaggaggcctcakgttctgtgttgtttaaaagcttcctggggagggtctgatgtgtakccagtttgggtgaggggccctggagaacctkggaaatgggagtcagttgttacarctctgagctttatgccacagatagaaaatgatgaatgtaggctgggtgcggtgnctcacc

SEQ ID NO: 1865 - DNA, 2187 bp, Homo sapiens
gctttggctttttttggcggactggggcgccctccggaagcgtttccaactttccagaagtttctcgggacgggcaggagggggtggggactgccatatatagatcccgggagcaggggagcgggctaagagtagaatcgtgtcgcgctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgttagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaaccctttgaccagaattacgggcggaggagtgcgcacccaagtgttctacgccgaccaccccttcatttcctagtgcgggacacccaaagcggtccctgctattcattgggcgcctggtccggcctaagggtgacaagatgcgagacgagttataggcctcagggtgcacacaggatggcaggaggcatccaaaggctcctgagacacatgggtgctattggggttgggggggaggtgaggtaccagccttggatactccatggggtggggtggaaaagcagaccggggttcccgtgtgcctgagcggacttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgacaaaaaaaaaaaaaaaaaaaa

SEQ ID NO: 1866 - DNA, 1862 bp, Homo sapiens
ggcacgagctctgcaaagctccctctgctccagcacgtcctgtattttttcaactttggatgtttgcacaagctattatcttttgcaagaatgtcctgccccctcctatccatctgtggaagtcaacctttctttagggcccagaggaaaacctatcaccttctacaccttcccagatgcccaccatttgggttaaactctgcctcctccaggtttgccatggtcttttccctctcttaaagcactggtcccagcctatgccattgtgtgtcaccttggctcctgtctcctactggctgtagatctttgggargggaggaactggggaattttcatcctggggctatgggatagtgcttacccctaagtataaaataagcaagaatccttgaattgaaaagctccagtgacttgatagcttccaacagcccctaaagatggggtagtccactgctccctatataggaaggaagaggttcacagtctcatggatttagcagccttcgtagcctcaggatctttcccaatgtccccagttctcctgctgggccagctgtggtctctgagaatgctcagttccctgggctaggctggcttatggggccctccctcctggacctgggtccatgtgaccaagtggccagccagcgagagagccctgggtgatgagcatctggaagtcagcttgcttgtctgccctaatcacagccctgggctctaccctcaagtaccctactcacatggtccaagagggaaccactcttctgtcattccctccccttctgctcctcatcctacccacccagctgttctgggcaagatcctgtgggcatgatggaatcctcccttttctctaccatccatccctttgatcacctaatcctrcarctgccctccaaccaaggtgttctttctataccaaaaaatctgatcaggccatcactcctctgtttaaaaccattcaacggctacccactgccctcaggataaaaactaaaattcttaacaggatttacaaattcttcacctggcccttttgagataagaggatttataatcttttcaaagccaacaagcatcctgagacaatcttaatttttgcagctgtccaagctatttaagattgatgaggtctgcamtaagttgttaaatggtgattaatttatctggcctgaatggcakgtgaattccaaggggatcatttttctctaccttccttgctgcacattgggacacagcaaggccaggacacccttyttaggtgactgsgtaaccaggttcattaaggcagtcagcgcagagaagaagcagaaaatggggaggagttgtgtaaatgaaattgccgataataccaaaggaaccccaagagaggttcagtctcccaacaattgcagctttgctgcaacatggcagggtgggacaggggtaggtttggatctgggctgctttgccmtggaagtggggttacagggcagggagaggcttaccatcactgagcatctttaattgactttgtcattttastgagaacttacaaattgagctattcttcattgagttatatttggaagcaggttcaatacataatacagtcctccctctagaatttctgctttatgtccacgtgatgcagcttgttcatttctgaattccttttaatgacaaaaacatttggaaggaatgtaaagactcaaaaaggggatggcatgtaaactatagttggaacaatatgtggccatttaaaagaagtgttgtccaggaggtggaggttgcagtgagctgagattgcaccactgcactctagcctgggccatagaatgagactccttctcaaaaaaaaaaaagaaaaaaaaaaactcgag

SEQ ID NO: 1867 - DNA, 984 bp, Homo sapiens
  misc_feature (762)..(762): n equals a,t,g, or c
  misc_feature (879)..(879): n equals a,t,g, or c
gcaacaacaacaacaacaaaaacaaaaaaaaaactagcttgggagaaactgaggcagaaaatccaaagaggaagtgagacgataactataaaacagcgatccccttcaccacctccctagtgtgctcaaagtttcagtctctttactagaaaaccacagctttatgttggagttagtgttggagcttctgggggcaaggatatggctttggtagtagaagcagtaataataatctttatcgagtgccaggctctgtgcattattttatccagttctcacattaaccgtaggagacaggtagtgatagccccttttggtgagtctgaaaactgaggcacccaaatatttagtgaagggcctgcgttttcgtaggtgacaggctgcagagccaggactcaggtgcctgtgttccctgcgtgactctgtgtgtcaccactgtgactcttgcacayacagggcagccactaggattgggggtgctttgctgaaaggggggtgctatttatcaacctgctctttgtcccatagacagtgctgaagtaaccccgcctgtcctctctgtgatgggggaggccaccccagtgagcatcgagccgtaagtgcagccctgcccctggccgaggggtgtgggtggccacactggtgcagtgtgtgcaggtgggccctgggagcaacaggagggttccgtggggcctgcagagggctgagagggcctccttgagcttctgtatgtggccctgggctttgctgtccccgccctgnctctgtgtggaagttgcagggaagggcaaggaccggctcagcttgaacttatctctaggagagttgaaaggggggtccagaggctctttcccatctgtaaacctgcagctgcttctnccctctccagcctctggaccttgcctttctggtggtgccaggtcaggctgtcctcccaagcccctagaagccagactccctacacctagctgaggccttgctctg

SEQ ID NO: 1868 - DNA, 2136 bp, Homo sapiens
ggacgagcagccgcagtcgccactggctgcctgaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggcagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttcttttttttttttttttttaagacggattcttactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaaaaa

SEQ ID NO: 1869 - DNA, 1673 bp, Homo sapiens
cggcacgagctggaaatgaaatttgcccctgtttatatgtacctgtcttttatttgcctctgtcttttttattgcaactcaatagacacacaccattgctttgtctctgattatttggcatttgaatcgtcaatgagggaagcttttacagaacttttgatactaataaaaggtgagtcaaatgttttaaaaaagatgcagaatcatcatttatgtcagagctactgactcacacttaaattgcagtgttagcactgaaaaagaaatgtatatggatgggaatatagattgcaggccaattaggacccctcttttgaagttggaattgagggatagctactgttctcttctatctttgagggttaggagaactttattcagtgttgaataactgtattcctcctgtttattaatgtttgttgtgggggtcttctattcagcacccatctctgcctgtcctgctcccccgcccccagaggaggatataataagaggcatgggacaggggcttataataataagacatgggaggggttgattacccagtgtcttcaagtaacttttacgagagatttgaaatagccagcgatcaatgcaaaatagcaatggccttggcagaatttgcacatacatactcaatgtttacagtttaaactctggtgtcagacagggtcatagttaccccgattggatgcatcccatctctggtgcagaacctctaaaacttgggaaatcattgaaagtcatctgcttattaaaaaagcagattctcagactcacatcagactaggagaagtcctgagaaatctaaatttttagcacatgctttgggggattctttacatcacgtgtgtttgggaaactgtgctgattgatgtccatggaaagcagcctcaggcatggggaggggctggaaaagaattatttaggtcagtttcgggatcttagattgtttcttggctacactggccactttttaaagtgtgcttagaaagagtatgacacctttttaattttcaaaaggacttgggttcagtgtatgtccttatgttaaagaaacagccctctttgtagttactctagaaataggtagaatggcagaaagagcgctggctgtctgtgtttgaggcctgttttgtacttcatgtggccatgtggtatgggaacatcctgggatttctgtgagcctctgtgaactcagattccccatctggaaaacaggagtaacaacactggttggaacctttatggagtgtaaataaagtgatagctctttgtaagcgacgaagagccaggtcagtgtttaattttattttctcagaaatagtactagttattaaggcctttaacaaaaaaaaatctttgaaaaggctaatgggggcctggtatagtgtgtcatgcctgtaagcccagcattttggcaggctaaaggggggaggatcacttgaggccaggagtttgagagcagcgtgggtaacatggtgacatcctgtctgtacaaaaaataaaaacattagctgaatgtggtggcatgcgcctatagtcccagctactcggaagctgaggtgggaagattgtttgagcccaggagggtgagggaagctataattatgccactgtactccagcctgggcgacagagtgagatcctgtcttaaaaaaaaaaaaaaaaaa

SEQ ID NO: 1870 - DNA, 1757 bp, Homo sapiens
  misc_feature (1590)..(1590): n equals a,t,g, or c
  misc_feature (1603)..(1603): n equals a,t,g, or c
  misc_feature (1618)..(1618): n equals a,t,g, or c
  misc_feature (1667)..(1667): n equals a,t,g, or c
  misc_feature (1671)..(1671): n equals a,t,g, or c
  misc_feature (1737)..(1737): n equals a,t,g, or c
ggcacgaggccatgtctgtggcattccattgtttgctagaccttgttcgtggaatcacaagtatgattgaaggagagctaggagagcttgaaacagaatgtcaaaccaccactgaagaaggttcttcaccaacacagtcgacagaacagcaggatttacagtcaacatcagaccaaatggataaggaaattgttagtagggctgtttgggaagaaatggtgaatgcctgctggtgtggtcttcttgctgcactctcactccttcttgatgccagcacagatgaagctgccactgagaatattttaaaagctgaactgactatggctgctctttgtggaaaactgggccttgtwacttcaaraaatgcctttataactgcmatatscaaaggttccctgcctccccattatgctcttactgtattgaataccaccactgcagctacactttccaacaaatcatattccgttcagggccaaagtgttatgatgataagtccatcaagtgaatctcaccaacaagttgtgscmgtgggtcaamctttagcagtccagcctcaagggacagtaatgctgacttccaaaaatatccagtgtatgaggactttacttaacttggcgcattgccatggggctgttcttggaacatcatggcaacttgtcttggcaamtcttcagcatcttgtgtggattctgggattaaagcctagtagtggcggtgccttgaaacctgggagagctgtagaaggacccagtacagttctaacaacagcagtgatgacagatttaccagtgatktccaatwtacwwtcaagattgtttgamagctcacagtatcttgatgatgtatcactgcatcatttaataaatgcactttgctccttgtctctagaagcaatggatatggcctatggaaataataaggaaccatctctttttgctgttgccaaattgttagaaactggtttagttaatatgcaccgaatagaaattctgtggagacctctgactggccatctacttgaggtctgccagcatccaaactctcgaatgagagaatggggagcagaagctttaacttctcttattaaagcaggattaacatttaaccatgatcctccactctcacaaaaccagaggctgcagttgcttttattgaacccgttaaaggagatgtccaatattaatcatccagatattcgactcaagcagttagaatgcgtgttgcagattctgcagagtcagggagacagtcttgggcctggatggccattagtgcttggagtcatgggagcaatcagaaatgatcaaggagaatccttgatacgaactgcattccagtgtcttcagttggttgtgacagattttctaccaacaatgccttgtacttgcctgcaaatagttgtagatgttgcaggtagctttggcctccataaccaagaactcaatattagtttaacttcaataggtttattgtggaatatttcagattattttttccaaagaggggaaactattgaaaaagaactaaataaggaagaggcagcacagcaaaagcaggcagaagagaaaggagttggtttaaatcggncattccaccctgnaccggcatttgatgnttgggggtatgctttatgcaaaattgggtgaactatggggggatcccgnctgntgcaaggaaaagtgcaaggcaaacttggtttacaatgggcccatggacttttccggttaactgggnaatggtattggaaggatgga

SEQ ID NO: 1871 - DNA, 1106 bp, Homo sapiens
ggcacgagctgagaggtgtgccctgacatgggtccagaaacatggttgacttgatattgcttctcttccacagtgcagttggctgtaacctgaaaagtagaggggcccttcagacccttcatgactctatgactttgtcctctttctattcctcgaaaacttctctcatttgagccattcctgtcctggtgagagatatgcaagttgctgcttctcctctttgtaccaagtacggtggccccatttgggttaaagccatgagcccctgccaagtctgaccatccacgcctacatttaccccaagctcctcctttgtggccaagaaccatcactttcttggaccccaccctttctcttcccttccagctgcattggtaggtatcttttggagtctttgctttgggagtggctgcacttgccacagtgtgatgtgggcactaggggccttgtggtcctgctgggcttcttttctcaccaaggcttccctcttgctccccatctaagggggggttctgattcacgctcctgccttcaacaaaatgcaggagactcacagatctctcttgaaatcaaagccataatgtccagactgccacctttgccagttttgcttcagtgtaatattagggaaaagctagaacactggtttcagagccacacagaccaggttgtaatctctgctgtatttgttgtatgacctctgccaagtcatttccctgcttggtttcctcatctgtgaaacatgaaaaatattatttagctcataaatggttttgagtgctggggttgagtgtgaaatgtttggcctcggccaggtgcagtggcctgtaatcccagcactttgggaggccgaggcgggcagatcacctgaggttgggagttcgagaccagcctgaccaacatggagaaaccctgtctctactaaaaatgcaaaattagtcgggcgtggtggcacatgcccataatcccactactcgggaggctggggcaggacaatcgcttgaacccaggaggtggaggttgcagtgagccaagatcacgccattgcactccagcctgggcaacaagagcaaaactctatcttaagaaaaaaaaaaaaaaaaaaa

SEQ ID NO: 1872 - DNA, 909 bp, Homo sapiens
  misc_feature (894)..(894): n equals a,t,g, or c
  misc_feature (896)..(896): n equals a,t,g, or c
  misc_feature (899)..(899): n equals a,t,g, or c
gttttgaagtaaaattgaccagccaaatttataggtagtctgcacaattttgtatccttttttaataatgaaaaattactatgaagaaatactgaacaaatttttatgtgcaatattttatagacctatgtatctgaagcatgtttacactggcgtttttttttttaattaatttcctaaatgttaagtatgatagamcaagctgacccaaatccttaagtttacaaagctgttggaaaactttgtgtcctgatttcaacaatcacgytttgtttgaaagatgagccaagctcacagacactaaattttatgtcatgccataagctggagaggagccatttggctacagctgcggaacttcattgaggagcaaatgaaaggcacatggtacgagcacgctggtgcagttcatgttcttcctgcctgtgaattgaatactgtcctggtagcagttttgggtcggtcaggagctcaaggctggtttgtgtggctgactacggatgagcactgaagttgcctcaaagaattaakgggtgtccacaccagcctctgggggtctttggtgttagtcttccaggtagagctggttttacaagtaggtggccatctacaggatgtgatgtgagcgatgccagacagctctctctgaccccaggtaatgccctgaatctggtgatcctggctgatctgtgaccaatagagattagctccttgggatttggggtcctaaaaggtccctgaaaaaatgcaccccttgtctttaagccaacattggtgaaggaactgagaactcttagggttacataaaraaagacccctgttgagatagtttatgcagatacytggraggaartagagatgccaggaggaattctgagaccggccatagagcgngncanaaggctccaa

SEQ ID NO: 1873 - DNA, 1508 bp, Homo sapiens
  misc_feature (80)..(80): n equals a,t,g, or c
  misc_feature (1498)..(1498): n equals a,t,g, or c
gaaattamccctcactaaagggaacaaaagctggagctccaccgcggtggcggccgctctagaactagtggatcccccgntttgcwkgaattcggcacgaggggacgcagggcaaagcgagccatggctgtctacgtcgggatgctgcgcctggggaggctgtgcgccgggagctcgggggtgctgggggcccgggccgccctctctcggagttggcaggaagccaggttgcagggtgtccgcttcctcagttccagagaggtggatcgcatggtctccacgcccatcggaggcctcagctacgttcaggggtgcaccaaaaagcatcttaacagcaagactgtgggccagtgcctggagaccacagcacagagggtcccagaacgagaggccttggtcgtcctccatgaagacgtcaggttgacctttgcccaactcaaggaggaggtggacaaagctgcttctggcctcctgagcattggcctctgcaaaggtgaccggctgggcatgtggggacctaactcctatgcatgggtgctcatgcagttggccaccgcccaggcgggcatcattctggtgtctgtgaacccagcctaccaggctatggaactggagtacgtcctcaagaaggtgggctgcaaggcccttgtgttccccaagcaattcaagacccagcaatactacaacgtcctgaagcagatctgtccagaagtggagaatgcccagccaggggccttgaagagtcagaggctcccagatctgaccacagtcatctcggtggatgcccctttgccggggaccctgctcctggatgaagtggtggcggctggcagcacacggcagcatctggaccagctccaatacaaccagcagttcctgtcctgccatgaccccatcaacatccagttcacctcggggacaacaggcagccccaagggggccaccctctcccactacaacattgtcaacaactccaacattttaggagagcgcctgaaactgcatgagaagacaccagagcagttgcggatgatcctgcccaaccccctgtaccattgcctgggttccgtggcaggcacaatgatgtgtctgatgtacggtgccaccctcatcctggcctctcccatcttcaatggcaagaaggcactggaggccatcagcagagagagaggcaccttcctgtatggtacccccacgatgttcgtggacattctgaaccagccagacttctccagttatgacatctcgaccatgtgtggaggtgtcattgctgggtcccctgcacctccagagttgatccgagccatcatcaacaagataaatatgaaggacctggtggttgcttatggaaccacagagaacagtcccgtgacattcgcgcacttccctgaggraaccccaaaacccctggacaaagagaagcgggcagaatatgcctcacacggaggtgagcccctgaccaagacttcaaagtcccacctcccgtcacccagctggngggggagcca

SEQ ID NO: 1874 - DNA, 1762 bp, Homo sapiens
ggcacgagccagaccaggagtgtccagtccttgggccttggtcagcctggagcagttgctcggccccctgtggtgggggcactatggagcgacatcggacttgtgaggggggtcctggggtggcaccatgccaggcccaggacacagagcaacggcaggagtgtaacctgcagccctgccctgagtgcccccctggccaggtgcttagtgcctgtgccacctcatgcccgtgcctctgctggcatctgcagcctggtgccatctgtgtgcaggagccctgccagcctggctgtggctgccctggagggcagctgctgcacaatggcacgtgtgtgcctcccactgcctgcccctgcacccagcattctctgccctggggcctcaccctgaccctggaagagcaggcccaggagctgcccccagggactgtgctcacccggaactgcacccgctgtgtctgccacggtggagccttcagctgctccctcgttgactgtcaggagtgccccctggggaaacgtggcagcaggtggccccgggggagctggggctctgcgagcagacgtgcctggagatgaacgccacaaagacccagagtaactgcagttcagctcgagcctcgggctgcgtgtgccagcccgggcacttccgcagccaggcaggcccctgcgtccccgaagaccactgcgagtgctggcaccttgggcgtccccacctgcctggatctgaatggcaggaggcctgtgagagctgcctctgcctcagtgggaggcctgtctgcacccagcactgctccccactcacctgtgctcagggcgaggagatggtgctggagccagggagctgctgtccctcttgccgcagggaggctccggaggagcagtcgccctcctgccagctcctcacggagcttcgaaacttcaccaaagggacctgttacctggaccaggtagaagtgagctactgcagtgggtactgcccatccagcacccatgtcatgccagaggagccatacctgcagagccagtgtgactgctgcagctaccgtctagacccggagagccctgtgcggatcctgaacctgcgctgtctgggtggccacacagagcccgtggtgctgccggtcatccacagctgccagtgcagctcctgccaggggacggggtttcgccatgttgcccaggctgttcttgaactcctgggctcgagtgatccacctgcctcagcctcccaatgcgctggggttacaggcaggaaccactgcacccagccccctgacctcatcttttaagcaaggctgacattgctatgcaggcttgttgggtggacttggtgagggcacgcgtgtgaagtggctggcaggtgcctagttctgttaagcacctgccatatgataacctgaggtcccactgtgtggcagatgaaggggaaacagaggtggaaggcacccgtgccacctgggtggagcacagtggaaggcctggtgttggctctgggcgtcctcctggcaccagcctgaccactctgcctctcttactaacccatctctccctcacgtgtcccctgggaggtgacttctcaaagcgctaacaggctccgctgggtgagtccacagctgtccctcttgtgatcatgggactcagcagcactgaccacgtccttccacgctctctcacctgcccccaactgggggcccatgacttggcattagcatgttccaaataaagtgatactggcaacaaaaaaaaaaaaaaaaaaaaaa

SEQ ID NO: 1875 - DNA, 1353 bp, Homo sapiens
gacaatacatgcatcatatcttttgactttgaaggatatctcatgtcaaaggaatcaagttatgatttatagaggattcagctggaataccttgtgggtgctggctgagggtggcaaaacgcctaccgagacatgaaggttttagccactagttttgtccttgggagcctggggttggccttctacctgcctttggtggtgactacacctaaaacactggccatccctgagaagctgcaagaagctgtggggaaagttatcatcaatgccacaacctgtactgtcacctgtggccttggctataaggaggagaccgtctgtgaggtgggccctgatggagtgagaaggaaatgtcagactcggcgcttagaatgtctgaccaactggatctgtgggatgctccatttcaccattctcattggcaaggaatttgagcttagctgtctgagttcagacatcttggagtttggacaggaagctttccggttcacctggagacttgctcgaggtgtcatctccactgacgatgaggtcttcaaaccctttcaagccaactcccactttgtgaagtttaaatatgctcaggagtatgactctgggacatatcgctgtgatgtgcagctggtaaaaaacttgagactygtcaagaggctctattttgggttgagggtccttcctcctaacttggtgaatctgaatttccatcagtcacttactgaggatcagaagttaatagatgagggattggaagttaatctggacagctactccaagcctcaccacccaaagtggaaaaagaaggtggcgtcagccttgggaataggaattgccattggagtggttggtggcgtgttggtgaggattgtcctctgtgcgctaagggggggcctgcagcagtgacagcttcaagaacttaacagccttgctcctgaagaactggctgcccaggaagccaagctagctttttaggggagtgttccagctgctggtagtggatcagcttagagggaacactcccacagccaaaagaatgagtgggagaaatggaggggacaatctcctgggagctatgcgcagtaacctaacttccttatgtcccatggatctcttcctgatcttccctgcccattgggtacccaggaaactgcaagcattgcctgtgttcctgggaagagttctaagaagcttgcattcattttctaccctttatgacttggatgcctccccacctccatttcccctcttctgagctgtgtattcatgtagagggatgtattcagcctttttagtgaacattttttttcaataaaagtaattcacagtaaaaaaaaaaaaaaaaaaaaaaaaaaaaaa

SEQ ID NO: 1876 - DNA, 3951 bp, Homo sapiens
  misc_feature (3871)..(3871): n equals a,t,g, or c
  misc_feature (3903)..(3903): n equals a,t,g, or c
gagctccaccgcggtggcggccgctctagaactagtggatcccccgggctgcaggawttcggcacgagagctgctccgtgctggagggaagtgagagttttattcaggctcagtacaactgtgcctggaaccagatgccctgtccgtcggcgctggtgtatcgagtgaacttcagacctagatatgtcactaggtataagacagtgacacagttggaatggaggtgctgtcctggctttagagggggagattgccaagaaggtcccaaagaccccgtgaagaccctccgccccacgccggctcggcctcgaaacagcttgaagaaagccacagataatgaacccagccaattctcagagcccaggaagactttgtccccaactggtacagcacaaccaagctggggggtagatccaaaagaggggcctcaggaacttcaggaaaagaagatacaggtgctagaggagaaggttcttcgactcacaaggacggttcttgacctccagtcttcccttgctggagtgagtgaaaatctcaaacatgccactcaggatgatgccagtagaacacgggcaccagggctcagcagccagcaccccaagcctgacaccactgttagtggagacacagaaacgggccagagtcctggtgtcttcaacactaaggaatctggcatgaaggacatcaagtctgaattggctgaagtcaaagatactctaaagaacaaaagtgacaagctggaagagctggatggaaaagtgaagggctacgaagggcagctcagacagctccaggaagcagctcagggcccgacggtgaccatgacaaccaacgaactctaccaagcctatgtggacagtaagatcgacgccctgagagaggagctcatggagggcatggacagaaagctggctgacctgaaaaactcatgtgagtacaagctcactggcctccagcagcagtgtgatgactatgggagcagctacctgggagtgatagagctcataggggagaaggaaacaagcctgagaaaagaaataaataacctccgagcccggctacaggagccttcagcccaggcaaattgctgcgacagtgaaaagaatggtgacattggtcaacagatcaagacattggaccagaaaatcgagagagttgctgaagccaccagaatgctgaatggaagactggacaatgagtttgaccgccttatagttccagagccagatgtggattttgatgcaaaatggaatgaactcgatgcaaggatcaatgtgacggagaagaacgctgaagaacattgcttttacattgaggaaacccttcggggcgccattaatggagaggtgggtgacttgaagcagcttgttgatcagaaaatacagtctctggaagaccgtctggggagcgttctcctacagatgaccaataacactggtgcagagctcagtcccccaggggcagcagccctgccaggagtgtcagggtcaggagatgaacgggtcatgatggaattaaaccacctgaaggacaaagttcaagttgttgaagacatttgcctgctgaacatccagggaaagcctcatgggatggaaggtgccttgccaaacagggaagaccgcgcagtacgcgacagcctgcaccttttgaaatctctcaacgacacgatgcacaggaagtttcaagaaaccgaacaaaccatccagaaacttcaacaggattttagttttctttattctcaattaaaccacacagaaaatgatgtgactcatcttcaaaaggaaatgagcaattgtagagcaggtgaaaacgctggcatgggtaggttcactaaggtgggtgagcaagaaaggacagtggacaccctgccgtccccccagcaccccgtggctcattgctgcagtcagctggaggagaggtggcagaggttgcagagccaggtcatctcggagctggatgcttgtaaggaatgcacgcagggggtccagagggaggtctccatggtggagggcagggtgtctcatatggagaaaacttgcagcaagctggactctatctcaggaaatcttcagaggatcaaggaggggctcaacaagcatgtcagcagcctgtggaactgtgtcaggcagatgaacggaacgctcaggtcgcattccagagacatttctggcctgaagaattcagtccagcagttctacagccacgtcttccagatttctactgatttgcaagatctggtcaaatttcagccatcagcaaaggcgccctcgcccccgccgcccgcagaggccccgaaggagccgctgcagcccgagcccgccccgccgaggcccagcggccccgcaaccgcagaggaccctgggcgacggcccgtcctgccccagcggccccccgaggagaggccgccccagccgccaggctccaccggggtcatcgcggagacgggccaggccgggccccccgcaggcgcaggcgtgtctgggcggggtctgccgcggggcgtggacggccagaccgggagcggcaccgtccccggcgcagaaggcttcgcgggcgcaccaggatacccgaagtcacctcctgtagcttccccaggagctccggtgccttctctggtgtctttttctgcggggctcacccagaagcctttccccagtgatgggggcgttgtcctctttaacaaagtgctggtgaacgacggggatgtttacaaccccagcaccggggtcttcacggctccttatgatgggcgctacctgatcacggccaccctcacccccgagagagacgcctacgtggaagcagtgctgtcggtctccaacgccagcgtggcccagctgcataccgctgggtacaggagagagttcctggaataccaccgccctccaggagctttgcatacctgcgggggcccgggggcattccacctcatcgtgcacctgaaggcgggagatgcagtcaacgtcgtggtgactgggggcaagctggctcacacagactttgatgaaatgtactccacatttagtggggttttcttatatcctttcctttcccacctctaaggtggctggggagatgtcaggggaaagayagatagttgtaaaaactctaaagctttaatatattcggtttgtatgtaatggaagcacggggctagagtttccacataggccccaacataaaggccttccctcgctgttgaggccaccatgccttactgcatccagccaggctgcagrgagtgaggcacacggtgaacatggccactgacttttctgccactctaactggacaactggaagacttggaaaggcctccacctgtatctacactctgagggccctggactgggcctgagcttgccacagaggctccgtctgactgtgggctgggaggagggaggcaggggagagccggtcacggtggctggtctttactgcagggcagcactgtggccagctgtctgtctttacactgcatgcagaagtttaaacactgaagtgccgaagtggcccgtgccgccgcacagagaccccgactttagtttgggctgttccacgcttggctcaccattgccgcctgggacttaacctgctcaggcgggccttcgcccagctgcaaatagggatgcgttagagactgttcccaaagcttgttgggctccttaaatggcatgtacaatttaagtgcaaagacagggagtgtcaataaagatggaaagccatttccagttaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagnacatccccctttcgccagctggcgtaataacnaaaaagcccgcaccgatcgcccttcccaacaggttgcgcaacctgaat

SEQ ID NO: 1877 - DNA, 4784 bp, Homo sapiens
aattcggcacgagggaatgtcactgcaaatgtctcgactgctgtgaggtgtgggcccctgcggtgggccaggcctttggaatctgctctgggctgctttctggaattgctccgtggctccccagctcctctctccacatgcaggcggcaggagggctgacagaacggctttgtctcacatctcggagttcttgggtggtgagtggtatgtgagtgacacaggaataagaggggagtatcagacagagacaagaggccttggggtccctggcagctttgatttgggggcattgatgacacttttgttggctcccatccatgttctgtgccctgggcttaggattttactcattttttttttcttttcgtcgcaataagtcatgaggcaatgtggctgttattatccccattttatagatgaggaaactgtcttgggaaggtaacgaatttgcccaaggccacacagctagcaaatgacacagctgtgcttatacccagctctgcctcctatgcctgggccaacctgcccaagcctgcccaccactgagcatggcctgaccccacagaacgggcgccagtgtcagggctgactttcacagggtggagcgtggaaatacaggtatcttgggcctaactggctgagagggctttccccctgcacggagccgaggaagctgtatttccagacgtctttcctagatggtttaattgatctgccaacaagtatttattggctcaatggctgagcagaggaggctggcagctagccaaggcttctggtattgatgaaggccagagagagtttgctctcacgatgactacaaggacactgtctccttgccagagctgcactcaagaccttctcgctagacccccgtgcatctcccggggtagtgaggtcctcccagcctccaggacatctggacttggcccctctgggcctggtcgcccctttgcccccatcccttatcaatctgtcctgaccccagctcacctccaggcctcagccgaggactctggctctgcatggggagtttagcactgagttcttctgcatctgcagggttcactcatttttccacccataggccttctttccccaagtggttatgaagttcctcagggcagggatggaaacccaggaggtatgcatggtgaactgggaagattagggacatcatatgtgcctatttacttgatatcgcttggatatttgtttcctccaaatctcgtgttgaaatgagatcccccaagttggaggtgggggttggtgggaggtgattgggccgtggcagatacatcatgaatggcttggtgccctcctcgtggtaatgagtgagttctcactattagttcatgtgggagctggttgtttaaaagagcctggcatctctcttactggctctcttaccatgtgacacacctactttccctttgcctttcgtcatgagtaaaagcttcctgaggccctcagcagaagccgtgccatgtttgtacagcctgcagagccctgagccaaataaaccttgtttctttataaattacccagcctcagatatttctttatagcgacacaaaacagactaaaacattactcttgaaaggaaagctgtgcatgtggcaacagatttaaatactaccaaagggcgtatggtgaaataacccctcctgagtatctcggccccccatccgctcctgctggcagccactattagcagtttcttgtctttccagagacatttgtgacagataatttttagatcatactgaaaacattcccctgtatcttgttttctcccttcaatggaccttggcagttatctactatcagttaatgtagagctgcttcattctttcttagcagtcgcatgggtccatgatatggttgtgttataatctaattacttagatccccatatttggacatttaggcagtttccaatctttgagcatacattttgatcccaattgaaatttcctttctgccccctctagctaattaacatccccaagcctcagttttcccatctgtgcagtgggaataattatatgtacctttcagagttgctgtgagtattagaagtgatgcagaaatgaagcactgcccagcatgaggctcacagtaggttaatattgatatgcgttccctgaatttctgattgcggtgctgagctcatcttgcgcacctgatgaaggctcgtgaatgactttgtttccagtttaaaatacagtagaatcacgttaattttttctctttttaaaatttattaatttgatattaaggaggcttcagacacattgttggattaatattatttgaggtgtctaattcagccagtccttacatagtgtgtagtcaacataagacacctagccctttacttcacagaataagcccataatgtgtgtgttttgcttttctgttattgctgctgctgctaatggtgaaagtggtggctctttgctgtggcaactgcatcttggccttttcaaccaccctatagcagcccttgcaacagagtacatagtcggtgctcagtaaatgcatattaatgtcctggcctcccaccaactgaataagcttttctttcctctgccacagggggacttgagtcacagttggctggagcagaggggctggctatgagctgcccctgagtgaccctttttccatctctcattgtgtcctgtgtacagcacatctgtccctgcacacaggccaagcagaggctgcttgatgggtcaggcatgtcaatgcaggatcctgacattcagaaactgccccctaccctttgtttgaaaggaacagtctctcagttgagaaaaggcctcgatcagatgctgtggcccttctttgaaggaggttttcatattaacatagtcataattcggttcatggaagtctggcttgcagaaaggtggctttgaaatgcaggtgacagcatttgaaatcaggcttaatcaggacaagcatcaccgtgggccacagcatggtcttgtgggaagagcagggttcaggggtcttccagcactggcttggcttcagtcctgacttggtttctaattagctgtgaccctgaacaagtcatttcatgcccaagccttcattttctccatctgaaaaacaaacttactttgctacgaggtgtcaggatcatggattaatatatagaaagtgactgatctagtgcctagaacgtagctactgaaaaagcggtaggtttaaaaatggctaattatgactattactgctctcataaattggtaaaattacagttattaaatatagaaataattatggttattaaattttggtccacactgtgaaactgaaggatttcacacgagggaatctgtggtggtttggatggtcttggactcgtttctctctaagatacatgatggaaatgccacctgaggttcacaggccattgtgagtttgttgcaaatgagctgggagtgtttagccttccctgtgagcggtttccggctgcatgtcttattcaagtgtttctctaaaaggccgcagctccccgtggtgacttgcctggtggacatgcattcacaaggatacccaaatgagcagcaccttcaccagctgtgtgcaggcagacattcagcagggatgagctgccgaggtggcggccctgagggccggcgtccacctctgcgaaaatagtgacttggtctagttgtgggctggccattattggacctttgggaaaaagggaaggggaagaggtaaagggtctcaccttttcaggccctggcagaagggtgaaggcaaaggccccagacacagggatagaagagatggtatctggcagccaatgcaagacccaccttttacagatgggagctgactggaccagagagctgggaggctttgcccaaggttacctgccaggtagtggcagaacctgaactaaaacccaggcctccaatcccccttgaaaatgttccccatcagaaacaagggagtgagaattcaatgcagtttctgagtccgtattgaaaaacacagctgtgggaggatgtaggagcttaggaggagagtgattagggccaggggtgatgctgatgggttggagggactttctgaggggaggccttggagcttgggcagagtttagaccagtgtctccccacaacacacacagatgaagaccctccatggcttctcagtgcctcctgcatgtcagagaccctgtcctggccgccgctcagaccatacaaccagggggttagcacagtcacagatacccaggtaagaactggtcttcctgtttagtacctgcgtgacctgggcataagtttcctaactttgcagttcctcggtatcctcacctgtaaagtgggcatagtgatggcacttaccccgtagagttgtcagcaacacttctcaaacctcagtgtgcattcaagccacctggtgaccttcttaaaatgctgattctgacttagtaggactgggtcgggcccaagattctgcatttctaacaagctcctggatgatgctgatgaagatgtaacacagatcaagggcccccaatcacagcttatccccacgccccaccatccacccatctacccgccatgctgaatgatcccgcagccaagctaaaatgcatattccagccgggctttgtggctcacgcttgtaatcccagcactttgggaggccgaggcaggcggatcacttgaggtcaggagttcgagaccaccctgtccaacacgacgaaaccctgtctctactaaaaatacaaaaaaaaaaaaaaaaaaaaa

SEQ ID NO: 1878 - DNA, 929 bp, Homo sapiens
  misc_feature (145)..(145): n equals a,t,g, or c
tttttttttttttttttttcagcttggtggtttcctctttattgatgtgcctcctaccttccccccacaatttcagtcccttccaactacccccaaaaaagaaggtagtgaaaggaagggattgctggggttctgagccccttgngasgtcagaaagggaacagaaaccaaaacaatcactggatgtgacacagactgacaatcaagaagtctacagcaggatgggaaaggcgggcagagaaaggggaagaaaggagaaaggagagttacaagatgccaactccaccattacccctcctaagagaggctggagagaaagccacaaacattaagaagtgccggtcctgaataagggaggtggtgtttgagcttgaaggaggaggaggtcaagaaaggggggccacctctctctttgtagaatgagacccccctccagctcaggggcagcagcttcacagaccgtagacactttcgtcactgtaggcaatgtagagaaagaagtcttcttcatggtgttcctggtacagctgacccattgtggcactggtgggtggaatgacattgttgacaaagaaaaacaaggcatcctcagctcggagatgaattcgcttccggatcaagaagtagaactgaccaactgtgagatcagaaggcaccaggtatttctttttgtccaggtctcctatccgagctttgggagccttttctactatcaccggcacccggtccgggtatttctttcggatcttctcgccctcagagcggcgcttctcgaacggatgctcttctttgtacacgaacttcatcctcccgggaaccgggctggacagggctgggctgagggaacccaggggggccgggacggggggcggcgacgacggcggcgacgcgcgggcggattcagcggagcggatccacgaatttgcgct

SEQ ID NO: 1879 - DNA, 1367 bp, Homo sapiens
  misc_feature (112)..(112): n equals a,t,g, or c
aatcatgagcctccagaagagacagatggcccaccaggagctgttgctctggttgccttcctgcaggccttggagaaggaggtcgccataatcgttgaccagagagcctggnaacttgcaccaraagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggargtggatgggctgcccttccacaacamccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaaaaaaaaaaaaawwaaactcgta

SEQ ID NO: 1880 - DNA, 463 bp, Homo sapiens
gaattcggcacgagatcctacagggtatttaaactgtagctttttggataacctctactgactggacagaaaaaatttattttaccgtagtagttttctgtaagtttacttttaaatttgtagagttataaactgcctgggccttaattgaaattagaaataaaacaattagatgacctcaggtgagcctattacaaaatgctcttgtcataacattaaaagtcatacaattgataccttatttcaggttttgaataattcatttgaaacatgttaatttttatactattagcgaccaacctttttgtatcctctctttttgaaatattaatgtacaggagttttcagaataattaacagattatatagatctgacttgaggctaggagtttgagaccagcctggccaacattcgcaacgagtgaaacctcgtctckactaaaaraaaaaaaaaaaaactcga

SEQ ID NO: 1881 - DNA, 806 bp, Homo sapiens
accttcttccatgtttagtcccttgggctctgctaccctcctgctggaggtgagagcatcctgtgtgcaaccagagatgccctctggctttcagacctgcctgcttttcaccctcagccctttctcactcagcaaaattgtgggggtccctagtcagcagctccctgggcagctctctgagcaaggtggtctctgtggtcatgaaggagagccggctaggacagtgccggaaactcagctgcctctccccttcaactcagctggccccccgcacctgaagtgcacaggagccgggaagagagtctggagcccaccccggagggcagcacaggaggtgtctctgcagctggtgtcctgccacccctgcaggcagcacacgtcccgggcattctccttagccacagacagaacagccagtgccagagtctgctgtcgttcccctttaagcacactcattcaccacacccgaggaggccagaggtgcagggagcatgggctgtcgcttcccctttaagcacactcattcaccacacccgaggaggccagaagtgcagggagcatgggctgggtgcacctccgcaggagagaaggctgagccaccgccgtcccgggagcccggctcccaggcctctcgttttcccctacctccctaagacttttctgtcactctctggccattgaaaggcttctgttccttaaagtgctgttacactctcctttcccaggatgcagcaagccaaaacagtaccactgcacgtcagcctgggtgacagagtgagaccctatcttaaaaaaaaaaaaaaaaa

SEQ ID NO: 1882 - DNA, 925 bp, Homo sapiens
  misc_feature (49)..(49): n equals a,t,g, or c
ttcctgaagagcaaggcaggtgcactcccaactggcagccccactgtgnaaattctaaatattctgctttcagtctcaggttgtcttctttcttgctatcgtggtagcaactgtytgcatcctcttcagaacatgggagcccccaagctatggatcttttcccatagaaaaacaaggctgggggcggtggctccgacctataatcccagcactttgggaggctgaggcgagctgatcacctgaggtcaggagttcaagaccagcccggccaacatggtgaaaccccatctctactcaaaatacaaaaattagccaggcgtgatggcacatgcctgtgatcccagctactcgggaggctgaggcaggagaatcacttgaccctgggaggtgaaggttgcagtgagctgagatcgtgccattgcactcctgcctgggcagcagagagagactctgtctcaattaaaaaaaaaaaaaaggaaaaacagctgtcagaaccttcatttgtagtgaagtgaaaataagaccgtcaaatccttaatgtgtttcctttgctacaaattctgcaatttaatggagatcaaagctttaaaggatctcaaactcaamatacttacgcatwggragcaggcagatttcacagatgagtgaaacagaccatttgagtctgaaaggagtgggatctccaacagcttaggtcagggtgtgtacttccctcatacttagctcagacaacttttggcatgtagcaccttcagttcagtagtgaccttctattgttaaagaaataaaaaaaattggcccagctccgtggctcatgcctgcaatcccaacactttgagagggtgaggcaggaggatcgcttgcgtttaggagtttgagaccagcctgggcaacatagtgagaccccatcgctataaaaaaaaaa

SEQ ID NO: 1883 - DNA, 546 bp, Homo sapiens
ggcacgagctctccagcacctccttggaacagatgccctgctactttacaaggcttgtggaaaagagaaagagaacagtagcaaaagcctgtgtagttcatgaatagaagttagcatcgtagtgagtaagcagtactgatgatctgtgaaatgattctctgtggacttgagcatgctaaaaagatcttgaaaaaggaaaacataaatctttccaaaacctcacatgacccctgtatgctttcgccttcttgaagctttggaggagagcataggtgtggatgaaatggagtcttttaaaagttgttttggtttttgtttttgtgtgtgggtttttaaagagagcatatcctgccacgtagaagaaaatccagggggtggctgtcctcctacaggaaggaggtaaacaagcatttttccttaagggctctattccctcagcctcgctccctcgaaggccacacttggaggccaggaagttaatccattaaaaaaaaaaaaaaaaaaaaaaaaaaaaaaaaaaaaaaaaaaaaaaaaaaaaaactcgta

SEQ ID NO: 1884 - DNA, 642 bp, Homo sapiens
aaaacagaccatttaaaaactcagacaagattatatttaatatattaattactaaaaaggcacaagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagccttatttgtgattttgggagtggaagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggaaccttatttgaatgtgtttttttttttccatgatgtccaattttgttgtgggaaaggatttggataaaatttttgtttaaattttggtagatttttatctatacaaatttaaataaaattatgttttgtaag

SEQ ID NO: 1885 - DNA, 463 bp, Homo sapiens
  misc_feature (14)..(14): n equals a,t,g, or c
  misc_feature (462)..(463): n equals a,t,g, or c
gaattcggcacganttacaggcatgagccaccgctcccgtccttgactggtgattttctactgaaacccagacatgttaggtattacgagactctgggtcttactgaaaccttgcttcccacgctgctactccagcacaggaggggaggtgctgccgcgttgctgtgaggtggaggcggaagtccaggttccccactcagcacccatggactctagagaagggggcactgtgccttactttggagggtgtgggagtcctagattctactagaccagcactggctgtgcggggtgggggtgtcaccttactgctctttcatggcctccactttcaccatattctcaggatggcagtgaccttggagtggagagaggggatgtgattgggcaggagacgcaggaggcttcaaaaaaaaaaaaaaaaaaaaaaaaaaaaactcgggggggccccggaaccaattnn

SEQ ID NO: 1886 - DNA, 1440 bp, Homo sapiens
  misc_feature (38)..(38): n equals a,t,g, or c
  misc_feature (41)..(41): n equals a,t,g, or c
  misc_feature (1128)..(1129): n equals a,t,g, or c
  misc_feature (1440)..(1440): n equals a,t,g, or c
actttgtccaaatgtgtctgtcacatgtagtcagctgnagnaatttaaaatgaattgccaagtgaagagtctgtggattaattggccgttaattaacaggctttatcaatgtgtcctcaagggagaggcccaaccctaattaaggagctaaacttcctgagtgaggggctgtgaggatggaggtggaggaggcatctggggcgggtggtggccgggccagcagatggcgcctccctggctgagctgcccgcaccgccagttccctcatttccactcaggaaggcagagaaggcagagtgatctcctcaaggaagagcttccccagccttcgggagcagctggcagggcgtccgggaataagccctacacgccgccgcctgcctccaactcactaaccctgcgcctcttgtctttcagattcaacgcgttcaacagaagccatccccagcccagcttaaattataaagatagacaataactctgttccaatctgcgtggtgcttctttagtaaatactgtacagattttaccatggagaactttttttttagtttttaccttttcttaattacccttattccgaatggacgaacactttctaccactgctgaccattgtaaaataccgtgtatataaatcccattgaaataatgccctggaatagaacatctcaaatgctgcttaattacagactcaggtcgattacttgtatttcatgtaatgttcctccaagttagacatctggtgcaagaccaaccgggagaccatggaattgtcaaaagtacaaactgacagtgtgtatatttaatttaaagacttatttaaaaactcacaagctctcacctagactttggagagcagtctgttttctgtaatgtctgatactagaaactaatttgcttattttagttgtattcaagatttgaagatgtattttatagacaagttctgtttttgaactttgtggaactgttccaatcaatcaatttcccagttatgatgagtatttacattatgaatgtataacccagacatgatttgtaaagccgacagtatgtttctattacacaacactttttgatacagcgtctcttgtcttcactgatactggagtctccgttgtctgcnnggtcccttcgagtttctagttacagacacaatcatactgtgattttatttttaatatggatatgctatcaaactgtgatacacttataattcactggtcctgcatcaggagatggagtggggaaaactgtatttaatacagtttgtatctgaataatctgtatggtttatacagtttgtgttgttcagagatgtttaaagtttgatctttgtttttctaaagattaaaaaagcacttgccccactgtaaatatacagcatgtaaaatttctrtagtatataaatggcagcaaatcacaaaaaaaaaaaaan

SEQ ID NO: 1887 - DNA, 935 bp, Homo sapiens
  misc_feature (510)..(510): n equals a,t,g, or c
ggcacagggtgaaagccagctaaaccccaagtggagaagtgaaagacatggttgttcccataagtttattgctcacattatgaaagaagccatagtcatgagtgaaccactccctaggttgataaggaaaccaacacggaagatctctttctggaagaagcagccagcctcgtgaaggagcggcccagccgccgggcccgagggtcgccttttgttcggagtggcacgattgtccgttcccagacattctcgcctggagcacgaagccagtatgtttgcagactttatcgtagtgacagcgacagttcaacgctgccccggaagtccccctttgtccgaaatactttggaaagacgaacccttcgctataagcagtcatgcaggtcttccctggctgagctcatggcccgcacctccctggacttggagctggatctccaggcgtcgagaacacggcagaggcagctgaatgaggagctctgcgccctccgtgagctgcggcagcggttnggaggacgcccagctccgtggccagactgacctcccaccctgggtgcttcgggacgagcggctccgtggcctgctgcgggagccgagcggcagacaagacagaccaaacttgactaccgtcatgagcaggcggctgagaagatgctgaagaaggcctccaaggagatctaccagctgcgtggcagagccacaaagagcccatccaagtgcagacctttagggagaagatagcattcttcacaaggccaaggatcaacatacctcctctcccagccgacgacgtctgatggagtgcattgtgcacatgaagtatttatccacctgttttattttcatgaagttcttagactagctgaatttgtctttaaaatatttgtgcaaagctattaatatacacattttgtaaaaaaaaaaaaaaaaaaact

SEQ ID NO: 1888 - DNA, 504 bp, Homo sapiens
  misc_feature (504)..(504): n equals a,t,g, or c
gcaggggcgaggggytggggaccgcggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaatgaraaaaaaaaaaaaaaattgggggggggccccn

SEQ ID NO: 1889 - DNA, 525 bp, Homo sapiens
ggcacgaggagaactgatgggggtggagagaagctccttgtgggaggagagggaactaccagcagagcccctcctaccgcagacacaggatcggagacaacctccaaccccacctgcctcctgaagtgctgctgacatgcaactgccttaactttgcctacctggcctccttatgatccccctccggcgtggtatggttggggggcttcttttgctgctggccacggcaaacaagctgcttgctgcttccttcagagacctcatggatgttcttacatgcccccgaccccggtagatggctccctgttgtttggggagcctggaaggtggttatgccttttggatgcaggagaggagcaagaaagagtggagagggagaatgggggagccggaccctgacctccctgggttctggttggagatgaaaaaattagaagcatcaggtctaagatcagcttctcttggaagcagagcctgagacaagatataaatgccagtcatttattaaaaaaaaaaaaaaaaaaa

SEQ ID NO: 1890 - DNA, 532 bp, Homo sapiens
ggcacgagccttgggccatctcctaaaatgatctttatcataatagctacagtaaaaagaaagaaggagaggtattaatgtgggtggaaatcaggacagtttcctaatgccgtggcttacaattctgagatttctccaggcatcaggacatgtgcgcgcacaggacttggctctcttaggagatacttcagtttgtatcagatgtggctgtggagggtgctctttaagcattgctaactatgagtgggtccctctcagaaggaaggactgtaagaggtatgaaacttctgagaaaacgagctgtcttctcttaccaagcgcctgcagccgtcaaaatgctgtaggctttagtcgtctgccagttcccaagctgagctgtctccttcatggataggatttgtttgtttagaaacaacaacaaagttcattctgtttataactcagagcatttgttttttctgctgaggctaaaatacttgtttattctttcctagaggagaaaagaaaaaaaaaaaaaaaaaaaaaaaaaaaa

SEQ ID NO: 1891 - DNA, 620 bp, Homo sapiens
gaattcggcacgaggaggaggggaggcggggtaagtttggtgggaaactctgtaatttccwtttttactttcacagcaatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctcagagtccagatctgaacgatgccgtgtccagtttgcgaagtcctattcccctcctcctgtcgtgtgcctttgttcaggtggggatgtatttcatgtagaaggtggaagaaggctgctatgactctttggatgggagtctggcaagaggaaattggaagataaaataaataataagtgaaataaaaaaaaaaaaaaaaaactcgagggggggcccggtacccaat

SEQ ID NO: 1892 - DNA, 817 bp, Homo sapiens
ggcacgagctcaggttgcggccggagagaaaggcctggggaccacctgactctgggccacccgggcctcctcaggtcttcggccagcgctgtcctgcccacggtagttggggttccaatggctgcggcttcttcctgtctgtggcttggacatgccattggccgcgtctctatttcctcatctgcgactcgggtgaccacagttctcagttcaccgtgttcggtagaggtgacatgaagtgcctggcacccatgtgggtttccctgtgggattctgacccgcttcggagctgcctcctgctcctcatcccacacttctctgtgtttctcatcctggcggctgtgtcctgtctgcccctctcaactgcaacacgctggagaggtcgggaccctgtcttgctcattatctgtctactaaagaacctgcaaaatggaaaaataacaatatgtgctgaattaattattagcttaaaatttaaaacttaagtagcatgatttgagtgcagccagcatcacctgccgtgagatcggtgctgtctacaggaggatggagcttttggtgaaccactgagctgggagtagctacgggcacctttacccagtcccaaaatgtggaacatttgagtttaaaaagcagaaaactctacagttaaaagccaatattaaggttgagtccattaatctaaattaatctgattttttatttctttaaataaaaaagtaatcctatgcaatcaaagttaaagttcgtatatggctccctatgaggtactacattccctgaagtgtcacaaaaaaaaaaaaaaaaaaaaaaaaaa

SEQ ID NO: 1893 - DNA, 614 bp, Homo sapiens
ggcacgagcagttccctgaggtttaagatcaaatataaattactctgcttttcgactcattcaggtagcattgtacctgaacctgattgctactttttcatcttaaatattatatttcctcatctaatctgccttcccctcatccacagacatttggagaaggaaatgggagggtgtctgttatccctttctctttgctttgtccccgttgttagactggcagcgtcagttgctcggtgggcttggttagagccgtgggtgaggcaggtggctggcggggacagggagaggctgagagggaagtggtggcatttactgctctgacacttccactgtccctgctggggatgctggggccaaggcctgtggggcctgtgaactgcacagccaggagcaaggaacccactaaatactccgtcacctccatgtcccctctacagtgttaaattattacataagcaggtgaaaggtagaaggcgaattatgtgagtaaatatggtctgttttctcttcagcaaaaatgactatttttgtgtgtgactaatttatttttattattgtaaagatacaataaaccggttgaaatatcaaaaaaaaaaaaaaaaaaaaaaaaa

SEQ ID NO: 1894 - DNA, 581 bp, Homo sapiens
acaaggtgtgtgtaaagtttatgtttgtaaactgaattctatcttaaatccaaaaagaactcgggagtaattcatttttgtagcataaagatccctaagttttattttgaaatatctgatttttacacgttaaaaaataacagggcatcgagaggattcctaggtgacatccagactcctttagctttgtgtgtgtggcaccggttagtctgcttctctctcctttcttgcactgcttcacacagccatgccctgccagcccgggcaggtgccttcctgtcaatgtacatttgggcttctgctcatgctgccctccctcccctcccctgcctcccaaccccgccccttttgttcctccatggagtacttccatgggtgtgcctcccccagccaagccataataggtggtttccccttcgcttctgtagcccttgcagacatcctctgtttacagtaggtgttgacttacttcccctctccccgstaaagccataaactccttaaggacaggtagcattcttagtatcttcgttcttctcaatgaccagtagaccattaaacatgtagcaaacaaatgtgaa

SEQ ID NO: 1895 - DNA, 983 bp, Homo sapiens
ggcacgagggcagctgcagagctccaggtttctctgcccacaagggcaggggctgcccctcgcccaggatgactctgccttccagagccttggcctccctgggggtgggagtgtgggggatgctaaggttaaatcaggtcacagtaagttgtgggggcagcaggtggagcagcagagtggcactgggagctttctcttgggtgtgcggtgtggccttggttctgcagccatcaggtgggggcttgggactgacttctccttctgaaggatgctgggaaggtgagctggctttggcagtgcttagagctccggggggttccccctcctagaacatgcaagctctcacaccggtgcgtcatcatcacacccatcatcaagcccacagtggtatactgaacacctgccccacaaagacggtggactgctctcagaggagccccatgaaccaccgatggttacaactatccaatgcctgatggcagacagccaggccaacctcggcttccactctctcttcctcaccctacaatcagccaaagtgacctgagtcatgtagtgtgaagttgctttctgctttctcttgtttgtgcttttgctgtttcttctgccccatactttgttaactccatgagttaaatgctacccattttcccagacaagtgctgcttctgcaaggaaacccttcctgatcccccacctatctgaaaagtacctctccagcttgcttcttcagggtgctgagcgttccttcccagcctgtcatcaccttcctccatacgctatggtgtgttcctgtcttctctagtcttgtcctcttttttctgttagattgtagctccttgctgacaggaaccacgcctgctccagcttcatacctcccactgctacagcacagaacctgcttctcagacttacagcaaatgtttgtttgctgaatgaattaattaaagataaagcaaaaaaaaaaaaaaaaaaaactcgag

SEQ ID NO: 1896 - DNA, 1381 bp, Homo sapiens
  misc_feature (1379)..(1379): n equals a,t,g, or c
cccgggctgcaggaattcgkyacgaggccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagcacttcagtccatctgccctccagaggagggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgttcatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtcaaaaaaaaaaaaaaaaaatntc

SEQ ID NO: 1897 - DNA, 968 bp, Homo sapiens
ggcacagcaaccgtcactgcctatcagaatcagcagattactcgcctgaagatagataggaatccatttgctaaaggcttccgagactccgggcgcaacagaatgggtttggaagccttggtggaatcatatgcattctggcgaccatcactacggactctgacctttgaagatatccctggaattcccaagcaaggcaatgcaagttcctccaccttgctccaagtactgggaatggcgttcctgccactcaccctcaccttttgtctggctcctcttgctcctctcctgccttccatctggggcccaacaccagccagctgtgtagtctggcccctgctgactattctgcctgtgcccgctcaggcctcaccctcaaccgatacagcacatctttggcagagacctacaacaggctcaccaaccaggctggtgagacctttgccccgcccaggactccctcctatgtgggcgtgagcagcagcacctccgtgaacatgtccatgggtggcactgatggggacaccttcagctgcccamagaccagcttatccatgcagatttcgggaatgtccccccagctccagtatatcatgccatcaccctccagcaatgccttcgccactaaccagacccatcagggttcctataatacttttagattacacagcccctgtgcactatatggatataacttctccacatcycccaaactggctgccagtcctgagaaaattgtttcttcccaaggaagtttcttggggtcctcaccgagtgggaccatgacggatcggcagatgttgccccctgtggaaggagtgcacctgcttagcatgggggtcagcagagtttctttgactctaggaccctaggaagcttaactctgtcatcatctcaagtatctgcacatatggtctgatgaagcctttaaagttaaatgaacatttgggatctgtctaaacatattt

SEQ ID NO: 1898 - DNA, 738 bp, Homo sapiens
ggcacgaggtaagaattacatcttgcagcaattagcctttgccacaatggtgtattacaaacaacttcaaaattcagtgactgaaaaaaattattttgtttctccagatgtttgagtcagctgggcaggttttgcttcacattgcaggtctgcaggtctgggtcttcctcacatgtctttcatcctttttggtcccattgagttattcagggtacattcctctcatggtgatggcagaggcacaccaaatggcaagcccaaccacgcaagcacttttcaaactgctttttgcatcacatctgctaacattctattagccaaagcaaaacacatagtccagcccaaaattaagaggctgagaaggacattccatctttagttgcagaaaatgcaaaactaccaggcatagaatgtagacacaggaaataataaagagtcagataaaataattcaacctctcagaccccataaagatattgattgaaatgtgtttgaaactgagggaaggatttggggtttgcagttattctcagtggaccagagaaagaagagatttgagagttctctgagcagcaggctatgagacagagcacattaaacagggagggctcttgaaatcaatacctgtgaaaaggagtgaaaggaagcaaaactgggcaaagggaaaagttgagctttgatgtggtctcagcaaagggttcaggcaactccatgggaagtgttggaacttgtggccct

SEQ ID NO: 1899 - DNA, 995 bp, Homo sapiens
ggcacgagcctgcctcagccttctgactagctgagactataggtgcatgccaccacaccaagctaatattttttaaccaataggatttagggtgttttgttgtgtggcaatggatatctgaaacagaaatcaatatgttacaccccttcccacaaatataatgacactccatatcctccttaacttgctgtatttttctcttgttgcatttaccacctggcttactgtgtatctacctatttgttattgtctccctatccccgctggaacacaaactctgggaaggcagagactttgtcttattcattactgtatctgagcgcctggaatagtgtctaagataggccctcaatacatatttgttaaatgaaggcatatatttaatttaacttgataagtttgctttttgtagacatagcaagtccataaaaaggaaagacaaattaatttaaattgcccatgccgacagccttccctcttatggacacaatatctggagatgtctaaaattactggcgggttcttccgcctttccccattggaggcatcccttcccagggggaaagggagtaagattctgctcctttaatacatactgacctcaggaggaaagggactagaaatgtatggactgaatgtctgtgtgccttgcaaattcatatggtgaaatcctaaaccccaatatgatggtattaagaagtgagacctttggaggtgattaggtcatgagggtgaagccttcaggaatgggattagtgcccttataaaagagacttcagagaattctctagccctctttatgccatgtaaggacacagtgagaagatgaccatctatgaaccaggaagcaggccctcaccagacatcatatcttccagcactttgatcttagacttcctagcctccagaactgcaagaaataaatgtttgctgtttaagccatccagtctatgatattctggtatagtagcctgaactaagacaaaaaaaaaaaa

SEQ ID NO: 1900 - DNA, 1628 bp, Homo sapiens
tccctctctcctgcctgtgctcaaacacccacagagaactctggaaggagaagaaaaacatacctctctccttccccggcctttccccacacacactgaggttgagaagctgggaataaacagcgtccaacacttttaaatggcggtggcagctccagacaagggagaagggaaggactgagagaagaaattattagactttttagactggctgaacccagaacctttacattggttacaaaatcatgcctggaggtgaaaaattcaatagcattataccaagtgtttgggcaacggtgtagagacaatagtagagacaagctacagctttagacagtggtagagagaagctacaactttagcttgtagaaacagctgttgggtgttcagcagatgcagtctaggtgcatgcaaacccactgtgtgcagcatgccttcactctcacgacaagggagccagaccttgtgtctgcggctggctgaatattgcatggaatctgtggattcacagaggcttcttctcagctaagagggagtgtggctggatgcatttctctgtggctcattcaatttggggtatactcatactactgagtctctatgaaggagtgataagctgggtcttcaatttccaaatgtttaccaaactcctactatgtgccaagcactattcccactgctttgagagctaacggtaaacaacaacagygaaaaaacatgtaacatcccaaccagtgcttctaaggatttaaaatatgctggtacttatgactttattcttacttctgtattatagatatgtatatggctttggggtatgtgtatatgtacacatatatgcacacatatacacacacacacatatatataatcagctgtccatagcctactcatctctgataatttatattttgtactcaaatttctcgaatacccctaccaaatcattctctcctccttaccaatattataatgtccctgacaataacataacaaacccagctctaacacctacagatttctttgagaacaaacaacttctacatgcaatttcttttctatactcaccaactggttttcttcaacctcctgcccaccctgtccagctcaggacatcaacaaccctttatggaaaccaccgaggtcagactggatgcagtcagttggactgattcatcatgactagttcaattaagagctgatcaccttcaaacagctctgactttggaagcaattgatttgactgcctctttggtcacatggccagatttacccataattttttgcaaacttggatgcatctttagatacagagcaatgctttggcatctgggggagggggttgttcctggtgctgtcacttgtacccactctcctgtttcctctccaactatgagtcacattttccctcaatatctcctatcttactttttgagtgatcagccctgactttcaagtctaaatttctcctccacgccaaaaacaaaacaaaaacagaaaaacaaaaaaagctttttgctgtatcacaccacctaaagtttggctagtgaacatgagcagacctcttctgaatcccacacatcagccatgctcttgcagccatgtagaggagctggaggtgggtgggc

SEQ ID NO: 1901 - DNA, 1001 bp, Homo sapiens
gaattcggcacgagatagcttgcatctcatcccagtaaaaccacttatttataacatatcaacgtattgacaaggttgaagagcaagattgttctgaggtgagatgcaaatttcaaaggggtgagcactaattgttccagtgattgtttatttattggctaggacataattactctctttgaggttacacatctgcctccaggttcctgtgtgcttgtgcccttgggatcaggccagggcagactgtgatcactgagattcaaactcccagartaatcagcaagagctttctagagaccaaggccaggcctgatccctgagggatgcatgagaaggcttggaatctcattctgctatggtggctctctcttgatcttcttggagtagcaaaaacagcaatgtgggcccaatggtgtggcctaaatgatcacaaaggtaaatgagtaaagggctcagcagatgagtaaggagccttgtcctgagaaattagcactgggctctgcattcagaaacatgtgataagcattgcccattgcacattgcctttattgtgtaaggacatgaaattccagttttgcatagctagtgatgaatacctgaagggaattgcagacatattttattttatttttaattgacagatggaattgtatatatttatcatgtacataatcatgctttaaaatatgtacattatggaatggctaaatcaaactaacctaggcattatctcatataattgtcatttttgtggcgagaagactaaaaatctaccctttcagcatttttaaagaatacaatgtgttttattaacaacagtcaccatttggtacactagatctcttgaacttcttcctcttatctaactgagatcttgtaacctttgataacagctcccaagcccttccccaaccactgctccacccgtggtaaccaccattctattctcaacttcctggtaatcaccattctagacacagggaagactctctaccctctga

SEQ ID NO: 1902 - DNA, 838 bp, Homo sapiens
gaattcggcacgaggagccactgcggctggccaagatgctttatattcttttaaaaccattgttgtgtctatctgttaactgcacaaatatttaccaaatgcttaccaagagccaaggactagacttggcactgggtagaaactagtaaggcatggtccttcttctacatagaatcttagcattttagagatgagttcccagacatggtccagaaggtcacagttcacaccattaggcaaggcagtatttgaaataaaagtcatgtctaatactaaatccagtatgttctctccttcaggattttactctcattgctgccccttggtttgctatgctcttccccagacagctgcacagctcatttaatttagatctcatttaatttagatctctcaattaatttagatctctgttaaaaaaaaaaaaaagccctaggcagcaaggtctaacatatcatcctcaaattaaagagaaagccctttggtgttatttttctttatagcacttaccaactcccagtagaatgtaaactccagtagggcacatatctttgcctcttttatttactgctctattcccagcaccagaacagtccttgccacaaagtaggtgctcaataaacatttggtgaatgaattaacctagtgttctttttacctacacatgcacacacagagccatgacactcctgccgaggaagctcgcggctctaagagggacattaaagaaaagccaattcagtgcctgccaaagagtagaacatgttttgacagcaggatcagcttgggtggtggaccaacaatgggttgcagaccaagaaaaaaaaaaaaaactcga

SEQ ID NO: 1903 - DNA, 1887 bp, Homo sapiens
  misc_feature (778)..(778): n equals a,t,g, or c
  misc_feature (788)..(788): n equals a,t,g, or c
  misc_feature (790)..(790): n equals a,t,g, or c
  misc_feature (797)..(797): n equals a,t,g, or c
  misc_feature (822)..(822): n equals a,t,g, or c
tagaactagtggatcccccgggctgcaggaattcggcacgagctcagccccatcatgtgagctcaaagtgcttcacctcactgtgcctcagtttccatgtctgtaaaacagggtagaagtagaacttagaagagttataagaattaaactagagaagtgagcattgtttatatgtgcttgttgctatggatccaaaactgccagtaataacaataataataataataatagcttatgctttcgttgagcccttgctttgcacctggccagtgacaggcacattatcagtaacacaaatgcaagtatctcatctaacccttgcatcaacgctcagagatgggttttatcaacatccccattttacagatgaggaaaactgaggcagagcagttgcacaacgtcgcagctgttcctggtgcttcacccagatcctcattgccagtaaaccattcatcattcagcctttgctgatctgtgcctaatggcttataccaatactttctccggagaattccttagctagcaaaagccatttcacccagggagttatgctctcacatgctgaactggccaatgactaagcgatatgaggcgagaggagtcacaaaaaagtccagtcctcccgcttcgaggcagaatacactccagagacccacgtgagatcaaggctagccttagcctgagagcccattcttgcttggctctgtcccttcccccatcatccttccttccctcactttccttctcctgagaacccccaccttgaataaaccgcacntacccaaatntnattcttnggcttccaaggaacccaacccgccncacaacttgcagggattcggaccaggttttctccttccaaagggccccacgtgaaaccaccaagctgcaccaggttcatctcaaaatcagagtcatgggatcaaagaacagttgctgatgccaacccctgccggcatgagcccaccgctggggaaacaaggcgaaccagacatctcagactagaggagtgaatccaaggagagaagatgacaggaggtgtatttgttctcacgctgctaataaagacctacccgagactgagtaatttacaaaggaaagagggtgaatggactcacagttccacatggctgaggagttctcacaatcatggtggaaggccaaagaacagcgaagtcacatgctacacagcggcaggcaagagagcttgcgcagcggaactcccatttataaaaccatcagatctcgtgagacttactcactaccatgagaaccgtatgcggaaacgtgcccccatgttttaattatctccacctggccctgcccttgacacgtggggattattacaattcaaggtgagtttggatggggatacagccagaccatatcaggagagggcacagcattaggacgcagccggtggtactgtaattcgggtcgggggaggttgctgaaatacactcataagggtagtttaaaaagagcatcatcaaggagacaggctttccagccttggccttcgggagaaagaaagagagagtgaaaaaaacaggggctttaggcctgacgcgtggctcacgcctgtaatcccagcactttgggaggccgaggcgggcggatcacgaggtcaggagttggagaccaacctggccagcatggtgaaacctcgtctatacaaaaaatataaaaaattagctgggcatggtggcacgtgcctgtaatcccaagctgctcgggaggctgaggcaggagaattgcttgaacctggcaggcggaggttgcagtgagccaagatcattgcgctgttgcacaccaacctgggcaacatagcaagactcggtctcaaaaaaaaaaaaaaaactcgagggggggcccggtacccaattc

SEQ ID NO: 1904 - DNA, 1352 bp, Homo sapiens
ggcacgaggtgatccacccacgttggcctcccaaagtgctgggattacaggtgtgagccgctgcccctggccctaaatagattttaaataagttttctggatgcacacactagtaaacacaaatgccaaagacttgccttccaattctctgtctacctctaactcaggctgttgtcttggcacagttaaacaacttttctagcctcaatattttcatcttcaaaatcaaaaataaaatgtattacatatggatctatgacaaatagtgatatattccatgtgcacgttatcattaaacatgaattaaccaatatttaaatctttttttttttttttttttttttgagacggagcctgggcgacagagagagacaccgtctcaaaaaaaaaaaaaaaaaaaaaaaaaggtaattatggtaaaatgaggtcattagggtgggccctaattctaattcagtacaactgatgtctttattagaattgcaagtttgggcatcaagagacacactcacgcggggaagaacacgtgaagacacagggaggagacagggtttacataaagtcaaggagaagggcctgaaacattcttctttcacagtctcgcataaggaaccaaccctgccgaaaccttgatctcagacttccagcctcaagaactgtgagaaaataaatttctgttgtttaagccattcagcttgtggaacttttatatgatgactctggcaaactaatatggcattacacacaggggataagaaaataatccaaataagtatatgtatcaactaccataagagcagattgagttcctatcctaaaggaaaatactactattagataaattttagaaatttatctaataaagctataacaatcggtaaagctcataaattttcttactgtgaacttatatatgaatttaaaatggaaaggtattatgtactaattcttgtcccgatcagaaggtttacctgtacccctcaaataactatcaccagaatgaaggcagcagttacatgaagaagcacaaagaaccaccactaaagatctaatggtacccaatcccttttaaagtatgtctgtgtctatattggttaaccttttcttatctgaaatacaaatgccacatgatctcacttataagtggaagctaaacattgagtacagatggacacacacaaaaagaacaacagacacaggggtttacttgagagagaagggtgggagaagggtgagggtggaaaagatacctattgggtactatgctcactacctgggtgatgaaatcatttgtacaccaaactccagtgacacacaatttacttatgtagcaaacctgcacaaaacaaccc

SEQ ID NO: 1905 - DNA, 1690 bp, Homo sapiens
ggcacgagcagaactcttcctcctggacctttcttcccttcccttggaggtatccctttgaatcaggcctctctcttctcatcagtctgtagcttccccccttgtataacctgctttcctttttacatttattaaaagtggattttgtaaaagcatttcattgacacgcgacctatcacagacaatggaattcgtcagtggtggtaagactgaaatcctgatgcttttcacacttcttgtctcttgctatgtatttctgcctctagccttgccatgttttgccttttttttttctttttggccaattcctttttatatgtgcccacaacagaggtggggagacacggagcaccctgggtccttcccagcgctgctgggcaggccccgtctccaggccccagctgttgaaactttgaagggcaacaaacaaccatccacactgccggaccctaggctgttcagggaggcagctcatttccaccccggccccaggacacccagcctgtgccccacaaggatctctctaaatgggagggattgaggctacttttctgccaagccctattaagtagtaatgtggggaaacccactgtgtcagtgcaggaagccctagacaaatgttttcaaataaatttcactgcccagcctgcacagatttccatttgaagtacttcccatccaccctgacacccaaaggggtttttttgttttgttttgtttttgagacagggtcttgctttgttgcccaggctggagtgcagtgacgtggtcatagctcactgcagcctcaacctcctgggctcaagtgaccctcctgcctcagcctcccaaagttctgagatgataggcatgagccattgtgcctagcctattttgatttttttcttagagtcaaggtcttgctctgttgcccaggctgatcttggacttgcgagccaccatgcctggctgggttttttaaaaatagaatctcactgatagcctgcaagaaacagatgcagtgcctgcttccgtatcagtccaaggagccctcgtgtttgccacctttacctttgaacctccccctgcctccctgcctgtgtccgcttttgcagctcaatgcagccatgacaaggaaagaaaagacaaaggaaggccagagagccgcgcagttctctgcaggtgcagatgcaggcagtggaggtggcctgagcaggcagaaggacaccaagcgccctatgttgcttgtcattcatgacgtggtcttggagcttctgactagttcagactgccacgccaaccccagaaaataccccacatgccagaaaagtgaagtcctaggtgtttccatctatgtttcaatctgtccatctaccaggcctcgcgataaaaacaaaacaaaaaaacgctgccaggttttagaagcagttctggtctcaaaaccatcaggatcctgccaccagggttcttttgaaatagtaccacatgtaaaagggaatttggctttcacttcatctaataactgaattgtcaggctttgattgataattgtagaaataagtagccttctgttgtgggaataagttataatcagtattcatctctttgttttttgtcactcttttctctctaattgtgtcatttgtactgtttgaaaaatatttcttctataaaattaaactaacctgccttaaaaaaaaaaaaaaaaaaa

SEQ ID NO: 1906 - DNA, 1462 bp, Homo sapiens
ggcacgagataaactgaaataggtcatgcaaatataaaatattatttttaaattatttgtcataagaaacgatggtggccatattttgctttaataatggaaaaaatgtggttagcattctttggaaggtggtcatcagatagtagacattttctaggatttatttctacctgcatatgtggaaatgtgtactactttagatttatttaatggcagctaactcagaggcatcaaaatgtgctaatggtgtaatatggcctttgtcttgctgttctgttttgtaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggtgagtgcaagggagtagaaatctgcatcagcacatcagcacttggggatctaagtaaacctctcggggaaaatgaccaagtggatgtcatctcccagctgtttctaagagcccagatgtccagagtattgtctcaccttgatccctcaggccagaagacctgtgaaaaagccacactggttcagggactcactggacggttttgtgtccactctaacctgcaccgtctctaccccagagtggactcaaatcctcaagtcagtcctctgaacattgaagtcagaaattataaaagggctttggcaatatgttagcccaagaatttggcttcttccagaaattgtgccgaccttaacagtggcttaaatgatggtaaaacttttaagatttctaaaaggatggcattggagatacgttgacttttattaaacaacctatagttgtttaatgacttctaaaaaaatatctggagctcaggggttcaactgagggaacacatgttgagaatcattgtttactaattaaatgccaggtaaccgttgaaattatcaaaaacatcttccacgtaccagaaagcacctcagaggatagttctgttatggagaagatgaaatggtttagtagtgtaggaactatggaaaggtgagcttagatttggatagtaaaacctcaagaccctatttaaaaagtattttatgaatgcagcataaataatttaattcagtgttaatatgccaaggctagtatattgagctgaatgtgaaaagaaactcacattgggagaatgccaccttttccttataagatagctttgaagataccattttagacagatggaaattgaatagctttagaaaaggcaaatgtttgatcttggggaaaaaaaaaaaaaaaaaa

SEQ ID NO: 1907 - DNA, 1706 bp, Homo sapiens
actgcaccactgcccaggtctcccggctggatgaagacgtggtccatgaggaagctggctagctcagactggagagtagcttcaggaaaaaagacaagtggcctaaggaaatcacggcccccaactatcatctgagggctaaagatgagaagtagatcacttaataagacaaaagcctgtagggggaaaagaaaggatgtttaaaaggacagaatgtttcccaaggtagaaatgacactgtcaatttctccttggaatgggggcagggatactcgccttgttgctcccacttgagtcagtactcacctgctcctggatctcagtatccacatctgagaggcaactctggcagagttcacagaaggccaccattctgtccctcaaactcgacagctgcttctgtgggcacagtggcttgaaggggaagaatgaagacacagactcctctgttcccattatcccatctaagacccacactcacctggggaagcatctgatttagaaatgtgggttagtgtccagagaatggaaaaatagacaagagtcaaggctggcaggataacctgtaacaacaaagggtttgaaaaatgaggtttgggttaggagagggagagacagatagccagaaacacaccagtgaagaggagagaaaatgagtaaagggagagctaattccttttccagtggaaaatgagtgatattctggacattcttcagaggcatctacacgaagtagaaatgtcaccgctccctaatttactctacgtcttctagaatccctcaatattatccttggcttccaggaaatccaagaagaccctggaagtagagtccaccttctaagagaggaatgtaagaggtgacccccacccacctgatcttcctcgctttgtccactccacgcactgagacttgacacacctagtggccacctagaacgtaggtccttaaaatytagccccccagcccccaacccatctctagcctgtccactcacctggtgaggaacytytcctgtgtccacagcyttctgcaggagttggcaacatggctcatagagctcccagcgagtcaggtcatgagtgctttgggggagaaaggggaatgttatactggaaaagaacagagggaaccaactccacagacaccagtaaaaacgggatggggaagaggaggaaagccactcacttgtagaaggcagagaggcgtttcagagtggctgccagattatatacctcatcctcatctaggaaggacgactgagaaggaaagaagatccacaatagcatttcccccagaactcatcagtccacatcccccgtcttgcagcccctcccacccttgtttggggtgtcccattgtccagccccagctcctacctgtaacagctcttcaagctcctgctggaarcggtcagtcagcaaatctactagctggctgcgggcaaagtccgcccggctgaagaaagtgaattcgggattacagagcaggtaagagcatgcgccccagcctcaagcaccgctggctctgcatgcttcaccaccacctcctggagttgctgcaggaacagctccaggtgctgagaagaaaaggcagaagatggtgtgctgtggggatgggaggaggacactcttctggcgggaagtggaacggggttaaaagcattaaacttcaaggataagatgcctaaraaaaaaaaaaaaaaa

SEQ ID NO: 1908 - DNA, 1972 bp, Homo sapiens
ggcacgaggaatgcccttcctgccctgctgatctataaggggggtgaattgatcggcaattttgttcgtgttactgaccagctgggggatgatttctttgctgtggaccttgaagcttttctccaggaatttggattactcccagaaaaggaagtcttggtgctgacatctgtgcgtaactctgccacgtgtcacagtgaggatagcgacctggaaatagattgaactgatagtctagttgcatagatttctcattgtttgggttggaatacacgtcattgtttatttttgttcctttgtcttctggcttttcagctgttctttgtagtcccttttattatgcataaaataaagaaattcttagattaaatcagaatgctgaataaccttgtagctagcaataaggtgacttacagttgtataaacaggaagccaggcttttgaactgtttacttaagattctgtggtgtgacatctctgttattgtttccagtcaatatttacaaagcatcctaaagacagggtcttggaaattgtcttcagatgatcttagaggtctctgccaagtctgagagtataattctgtaggtattgtgttatttgcaacgtaaatagtgcattttcttaatcaaatgattgtaaattatatttacttgtaatcagttccatagctttagacggtggttagattttttttttccccaccagggtcttgtttaaaggggtgagccaccgcacccagtcctgaggggtggcctctgctgctggatttcatgtcttcctccagcatgactaagtctggaacagcaggaagggttgatgcttactgacctggtgatgttagaagacaagtagtttatggatttaaacattagagctggagtggggctggaaatctttgtaaaggaagttctttcagtaagatgcccctgcttgtctttgtctcttttttgtttaacaaggtaactttttgtttaacaaggtaactttttgtttaacctagattttttttaaaactttttttttttttcatattggaaaagtaattcatattcagtagaggaaaactgaccaaaacagaagcaaaaataagaaaattaaaataatctctaatcctactacctagaataaaacactattaatattttggtctgtttcctgccaaggtgttttctgtgtatacatggatattttgtttgtttttaaacaaaacgatgggatcattctgaacatactgttctatagtatggtcagctaataatatatcagacctttttttatattattaaatattctacaactttttaaaaatgtctattaatattccatcgtatagatgtgatataatttgcttgatggttgtctcttaaaaagaaagatagcaaatactttttttaaattacaaaagtgatagatgttcattgtagaaaatgtaataaacactgttaagacttaaaagccatataattccaccaaccaaaattaatcccttttgtcatatttctagtcatttttatagcctttttttctatgtatttataataattatcatttgcgtttttttcctttttttaactttaaaaatgtatattctagggtcaggggaaatgtaatctggaattaaatattagccttaaaattcacaattttgattttcctggcttttcaggaattgactaactgtaaaagagtcttgaaagtatttagtcaacaaacagagtgcattttttttttttttgactaagaaagctcgttgtagtagaaagggtggaatgtattgaaaattattagaagcagggaagtattgttagtctagcttatttcctttcagtcttttttcaatatttttataaacattgagtacttactgaatttagttctgtgctcttccttatttagtgttgtatcataaatactttgatgtttcaaacattctaaataaataattttcagtggcttcaaaaaaaaaaaa

SEQ ID NO: 1909 - DNA, 1282 bp, Homo sapiens
  misc_feature (675)..(675): n equals a,t,g, or c
  misc_feature (1195)..(1195): n equals a,t,g, or c
gaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcagggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattncttgtctcttcggaagctaacaccatgctataataggcactaaatagatgtctaaaaacaccttaagtatttgtctagaaatctggtgcattgtccagaaagaaccaaaattcmaaataatttcaaagggcctaaagcactakttaatcmaaattcattagtttttaatggtactaccactctcaaatttaaaatgtcatcttacgttcctcttcctcgcattggatttattgctaaaacctggtaaacactttaatccytttcaattccattaccactgctcttgtccagaattactcgcagactaatagtcacctgacttctccccctgcatcccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatccatgatctgtatccagcatcattttgtattngctcactttatacaccaccccccatgccacatcaaattaaattatcctgataaatgcaactgcaaaaaaaaaaaaaaaaaaactcga

SEQ ID NO: 1910 - DNA, 951 bp, Homo sapiens
atttcggaacgaggactgaagtgggagcggcggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatgcccagcccaccttataaatcatgcctgtttagatgtttgattttgttctgtttgctattgttatcttaaaggtgtataactctgacatgccagacatcaaattaagctcaaattaagctctcgtttaaatgtttaaacacctaatttatattctaattgatcccagccactgatgcatgtactttagctacttctgctaaataagcatattaattttccacatcaggccatcagatcttgagaaccaacagttatctagaattccgtgtctactaatgtttcacctgcatgcagccttcattaattttgtagcaaaatataaagtgatcattatgtagtttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattcaaaaaaaaaaaaaaaaaaactcga

SEQ ID NO: 1911 - DNA, 472 bp, Homo sapiens
  misc_feature (2)..(2): n equals a,t,g, or c
  misc_feature (471)..(472): n equals a,t,g, or c
cngaaaccccgtgaaccctccccgggttaaaaagccccccctaaatggggggaacgcytcacacgttataaaaaagcactagaatgttttgaaagcgagaaacaacagctgtgtagggtagctagcagttagtgttgtacagaagacagatatttgtgcatttytgcattttctaagtttgctgcaatgagcatgtattactttcatagttataaaacacatgcaaaatgcccttttaaaatgaaaaaaaatccatgagtgtaagtgatatatatgctttggaaagcctgggacggtcattgtttactctcaatagtatgtgtttgcctttgtctttttgagacattttgttttaatctgttgatgacaataacctgttgataatataacttgataacaaataaaatgacttatgattgaawmaaaaaaaaaaaaaaaaaaaaaaaaaaaaaaaaaaaaaaaaaaaaaaann

SEQ ID NO: 1912 - DNA, 1740 bp, Homo sapiens
  misc_feature (1310)..(1310): n equals a,t,g, or c
  misc_feature (1736)..(1737): n equals a,t,g, or c
ttattataataatgatgatgattccaaggaaaaaacctacagcgaatgttccatttctaccccgcacgcagacactctccctaacactgataacctgagcccccagcactggacggaagaatgctggcgtctccgtgtgtactggttcagggttctggccccagccttgtcaggaccccctggtgtccagagcccccacccctcccgcaacaagcagctgatgccccagtgattctctatacatttttcacctcggccaatatgtccaggaaaactgcttacttctcttttcttgcctggagccttcattgttcacccttacgttgcaatataggaattaatgctacaaaataaaagtaaagcttacctgaaaagtgcatagtttggggcaatggtatctacatctcccactgtgggaaaaccagcaaagcatcaaaactctcaattctcctgttaccraatgcagatctgaattataagatgtttatgtttgaccattgtttcaacaatgggattttgttacgaattatccctttaactgaaaccctcagttttactgtttacattattaggaaaacagggatatcttttgaatctaaaaatttgatgtacagcatgtgatttttgaagtttacatgtaaagtcacagtataggtgaaataacgtttgtcatattttgagacgtatcctgcagccatgtttttacgtgagtgttttagtcaaagtacatggtagacagtctttcacaataaaaggaaaaggattttttttcctccaaatgtacatttatcaacctaatgattgatttttttaaaaagagatttcgccccagtctggtttatgaaagttcattgccctaaactgtgctgattgtttttaatcaagttataaatttccaacctagatcatgtatctaccaactctcctgcattttccaaaaggcattgagcttaaatattagtcttgcttagagtaggttatccacttacatgctgcgctaaagccatgcctttgaaactccttgtttaaaacatgatatgatttttgtgggcagtttcagaaaagaaaacaaacaaacaaaaatcgaccctttaattattacttgcaactcaacagatctccctgccgtactgccttttccaggaactttacttcagggctgtccagattgcagttgtgccccgtgtatgtggatctagttcacagagtctttggaagccagcagtcgtgccctccgtatactgtccactcattttatgtagatttggtatcctcagcagccagtgttaacaccactgtcacgtagttancagattcatcttttatgtatttaaagtaatccatactatgatttggtttttccctgcaccattaattctggcatcagatcagtttttgtgttgtgaagttctactgtggtttgacccaagaccacaaccatgagaccctgaagtaaagataaggtacacatacattatttgagtaactgtttccttgggggccaatctgtgtatgcttttagaagtttacagaatgcttttatttttgtctataacaaacagtctgtcatttatttctgttgataaaccatttggacagagtgaggacgtttgccctgttatctcctagtgctaacaatacactccagtcatgagccgggctttacaaataaagcacttttgatgactcamaaaaaaaaaaaaaaaaamcycgggggggggccggtaacccatttnnccc

SEQ ID NO: 1913 - DNA, 377 bp, Homo sapiens
tttttttttggaaaacaaaagaaccagccattttawtccaagacctatgttctggggcagcaggaataaataaggaagggaggggacgggggcagggcaggtaggttctacgtcttgcagcacatcccacactttgatcgatgacagcagccgcagcagaaaatgcagatggggaagtgggtgtctcgcctccttcgcctctggaacatgggcatccagctggccctggctccagctctgtcctggggttgcagctctgcaagttgtcccgtctgttgtgggaaaacagagccactggtcaggctggcgaggaggaggaggagcaggaggcaagcggcccagatctgggagctcagtgccatcgtgccgtctgtctg

SEQ ID NO: 1914 - DNA, 1843 bp, Homo sapiens
  misc_feature (10)..(10): n equals a,t,g, or c
  misc_feature (24)..(24): n equals a,t,g, or c
  misc_feature (91)..(91): n equals a,t,g, or c
  misc_feature (213)..(213): n equals a,t,g, or c
  misc_feature (1633)..(1633): n equals a,t,g, or c
aaacccaacnccctccggtccccnaaagaaagcccagcccaaatcccaagccggcagtgagcccgcgaacaaggccctcaagacgcccagncgaacaagcagcccccaggaggccccgcaagagaactccctggcggcccaagcgggcagcttctgtgcggcagaactcagccaccgagagcgcagacagcatcgagatttatgtcccggagncccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcarggctsagccccgaagccagctcagtacctgaggggctgctctatgctgtgtatgcgcctctctggcatccgagacatcctcttggtggcgcttgctngcaggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgtaaaaaaaaaaaaaat

SEQ ID NO: 1915 - DNA, 857 bp, Homo sapiens
  misc_feature (800)..(800): n equals a,t,g, or c
gaattcggcacgagcgcaattcgtacaagctctcagccccatgctttttcttcctctgccgtgtttacccttctggagttgcagaatgaatcacccacccgagggaagcacggttgtttttttttytcttttctttttttttgagacagtcttgctctgttgcccaggctggagtgcggtggtgcaatctcggctcgctgcaacctctgcttcctggttcaagcggttctccttcctcagcctcctgagtagctgggagtacgggtgtgcgccaccacgcctggctaatttttgtatttttagtagagatggggtttcaccatgttggccagggtggtctcgaatgcctgaccttgtggtccacccgcytcggcctcccaaagtgctgggattgcaggtgtgcgccgccgcgcccggccaggcttttttttctctaggcctgctgtggccaccaaggctggggaccagggggcctccagggacagggatcccaagttgcacgttaatacacggagccctttytgagatgcaggttctacagggaactggattccacytcttttggggagatcaacccagcagcccaaggatcccctgatggtgcctgagcacagctgtgagaagggggtatctggatccttggggtgacaggatgggagaggtggagcatggcctgcaggctgcccccagaggccttaggtctctgctgactagctagaattctgaaaactgtgttatgtaagacgtttagcatctgcagtgccaaataaaggtgacccccacaacgacataaaaaaaanaaaaaaaactggagggggggcccggtacccaatcgccggatatgatcgtaaacaatc

SEQ ID NO: 1916 - DNA, 747 bp, Homo sapiens
aaaaaggaagaaaagaaaaaaaggaaaccagccctgtcatggaatttctctccttccctgcacagtaaagacttttgggttttcatggataaaatcaatgtcagtactgaaactcctactctcccctcccgccccactctcccccgttgcccgagatggccaagttcaggcctgtgcaatgccgcttccctctgagcctccctctcaagggccacgcaggcagctgcagcagggccagctgcaggatggggctgccggtcactgaattgtcgttcaaatgcatcatctttgtggcgtctttctcatgcgagcaaagccacgtgctctcctgtctgctgtcacatctgtgcctggattgcttaaatattgtttgtgatggggaggttttaatctggtgatgcagagggaagcagggctgtgggggcacgtttaattggctcccagcagcgtggggagtgcttctatggtgtgtggggttttttgttgcctccctctagaagtgttaccgttttcacgtcctattaatgtcctctggttgttaaattacagcagcacattacagtgcactgggttccctcctggagtgaatacaaacggagggcatctacttgtatttttagaagttttgggagaatttagtgatttgtggctwtgatcaatcctgttgactggtgtatgtctgcgcaaacctgtttcaaataaatcttttgttaaagtaaaaaaaaaaaaaaaaaaaaaaaaactcga

SEQ ID NO: 1917 - DNA, 676 bp, Homo sapiens
gaattcggcacgaggacgaggtaaaattattagaatggagtatgtcatcaggtcttttcctagtccttttctgcttcctgtgtgtctttgtaggtttctttgatttccattgttggtgtgatattttggtaaaaagcagctgactcacatcccatccaaatccccagtgcccttcagatccttcacaaatttggcattcagcccactccttgccaattgcttcctttcctcccaattcccacatgtctccttcctacgccatctgcttctcctcccttccttcgattagtgctttcgtctgctcttccaatttctttcattgttcaatgtcttttgcttcctcttccccctcctctcccctagaggaaattaacatacttaatacagctgatgtcataaagccccttttccctaagaagttaaatttctgtttctgcaaaataaatacatagctctgttgtgtgaaggtcaaaggaaacctgagtagtaaacctgaaatagatttttttggggttcatcttacataaagtgtcaatgcatattatgtattctatttattttccaaaataaattttctatttgggatttaaatatggtaagtcaacacaactttattgtaccagtcattggattgaataaatgacttaaaaataaaaaaaaaaaaaaaaaaactcga

SEQ ID NO: 1918 - DNA, 1441 bp, Homo sapiens
  misc_feature (1056)..(1056): n equals a,t,g, or c
  misc_feature (1081)..(1081): n equals a,t,g, or c
  misc_feature (1109)..(1109): n equals a,t,g, or c
  misc_feature (1328)..(1328): n equals a,t,g, or c
  misc_feature (1362)..(1362): n equals a,t,g, or c
  misc_feature (1419)..(1419): n equals a,t,g, or c
tcgacccacgcgtccggctccccgagccctgccaaccatggtgaacttgggtctgtcccgggtggacgacgccgtggctgccaagcacccgggactcggggagtatgccgcatgccagtcacacgccttcatgaagggcgttttcaccttcgtcacaggcaccggcatggcctttggcttgcagatgttcattcagaggaagtttccataccctttgcagtggagcctcctagtggccgtggttgcaggctctgtggtcagctacggggtgacgagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatgccccctgaccccaggccgaccctccccacaccctagggtaccccagtcgtatcctctgtccgcatgtktggccaggcctgacaaacacctgcagatggctgctgccccaacctgggacctgcccagraggttggagcagaaagggctctccctggggtggtgtttctcctctagggtattgggatgcatgttctgcactgccagcagagagggtgtgtctgggggccaccacctatgggacacggggtcgaaggggcctgtacactctgtcatttcctttctagcccctgcatctccaacaagtccaaggtgacagctggtgctaggggcgtggggttaataaatggcttatccttctctccacccaagtttccacctgaccaggtgaaaaacaaatcagaagggtaagatgatgacaggtcacatgaaacctttattaccctacagttgatatatgaggatcacatgcaagttacatactgaggatgtacagggaagttcccagcgctgaaccccagaattagacgttcgcatcagccccgtaggccacgtggacaccaccacagcctctctgtatgggggtctgcctctgtagcacttggcatgtaggggcagagcaaaaggggccangctggccagagcctggctgctgggnagargagggacttgtgggscacgccacntgcctatcattccccaytcatctattagccaaagtcactccccagaggcagagctagcccgttgtagccgtgtctgtgtggagggaaagcttctgagtgggcaagcctacacacagccccgagccccaagaggaggaagaggtggagaccagacggaacctccacaagtccatcatggttacagctggcttccccgcagcaccgaagacccacagcatnggccctgctgcccccgacccagctcagctgccangcctcaccttgccaggaattgaaagaaagttattgagtactaattggcctcagagtnacaggaagctcaagttaaagtg

SEQ ID NO: 1919 - DNA, 573 bp, Homo sapiens
gaattcggcacgagcttggtagccttagaactgcatgagctgctttaccactgggaaacacgagcacagcctagcttgattttgtatgtggtatcagatctaaggtggatggaattcaggacttcctgtctactctttgattttgttttatttttagaaatgttttattttgttttattcatttattcatcttcagagacatggtctggctctgttgcccaggatggagtgcatggtgtgatcataggccactgcagtgttgagctcccgggctcaggcgatcctcctgcctcagctyccttagtagctgggactataggcacatgccctaccatgcctggctttgtctactttttgaatgatgtcycaaactagaaggtctattaatttaaaaaattaaggatagcatgccataattaaaaataataacagtgggaaaaggcaccttccaatgattcagacatcaacttgtgatttaaaaaaacgaaaaataaataataggaaaaaaaggggaaaaagttaaataaaaataaaattaaaaaaaaaaaaaaaaaactcgaggggggcccggta

SEQ ID NO: 1920 - DNA, 1846 bp, Homo sapiens
ccccgggctgcaggcttttcagtatatccatagttttgcctttctaagaattgcatataattggaatcatgtagtatgtagccttttaacactggcttctttcacttagtcatatgtatttgttacctccatatcatttcatgacttcataactcattttttttagcactgaataatattccatcatctggatataccacagttttttttacccattcacctactaaagaacatggttgcctccatgttctggcaattatgaatgaagctattgtaaacctgtgtgcaggttcttgggtcgacataaattttcacctcctttgggtaaataccgaagaatgtgataatgtgattgctagatcaaacattaaaattatgcttaggtttgttagaagctgccaaactttcatagtgactggaccattttgcatttccaccagcaatgaatgagagttactgtttcttcacatccatgtcagcgtttggtgttgtcagtgttctggcttttggctattttaataggtgtgtagtggcctctcatttgcatttccctaaggacatataatggggagcattatatgcctatttgccatttgtatttcttctttttgaaaaattaattttgataagaaatacttaacataagatctaacctcttaacaaatgttaaagtgtacaatgtacacagttaacactctgttgttaactatagagacaatgctgtacattggatctccagatccacatcttgcataattgagactttatgtgtgatgattgagcagcttcccattcccccatcccgattccctggcaagcataattctgctctctgatttgatgagtttactattctgggtacctcatataagtggagtcatgtagtatttgtctttccatgactggcttatttcacttagcataatgacctcaaggttcatccatgttgtagcacgtgtcggaatgtccttcttttttcaggctaaataatatcccactgtatgtatatgccaccatttaaataatccattcatctgccaaagaacatcaggttgttgtcgccacttcttgactactgtgagtagtgctgcagtgagcattggagtgctaatatctgtttgagatcctgatttcaatggttttagattggattgctgcatcatacagtatttttatttttaattttctgagaaatttttatactgttttccatagtggctgcatcattttgtattctcatcaatagtacaaggtttcccatttctccacatccttaccagcatgcttttttattttttttttgataatagccattatctaaacaggtgtgaggtagtatctcatggttttgacttgcacttctctgatgattagtgtgatgttgagtatttttcatatacatgttggccatttttgtcttctttgaagaaatgtctattcgagtccaggcccatttttacgttggattattagtgtttttgctattgagttgcaggagtttatttaatttctgaaattagatattaccacataggctgggcgtggtggctcacgcctgtggtcccagcgatttgggaggctgaggtgggaggatcgcttgaggtcaggagttcgagaccggcctggccaaaatggtgaaaccccatctctactaaaaatacagagaaattagctgggcatggtgctgcacggctgtggtcccggctgctgaggaggctgaggcagaggaatcgcttgagcctgggaggtggaggttgcactgagccgggttcatgccactgcactccagcctaggcgacggagcgagactccgtttcacaaaaaaaaaaaaaaaaaaaaaaaaaaa

SEQ ID NO: 1921 - DNA, 632 bp, Homo sapiens
  misc_feature (29)..(29): n equals a,t,g, or c
  misc_feature (46)..(46): n equals a,t,g, or c
  misc_feature (94)..(94): n equals a,t,g, or c
  misc_feature (162)..(162): n equals a,t,g, or c
cgcaattaatgtgagttagctcactcatnaggcaccccaggctttncactttatgctttccggctcgtatgttgtgtggaattgtgacggatancaatttcacacaggaaacagctatgccatgattacgccaagctcgaaattaaccctcactaaagggancaaaagctggagctccaccgcggtggcggccgctctagaactagtggatcccccgggctgcaggaattcggcacgagactatgtatatatgtttaatatctgtcttttgaaatgcagaaatagtttaaatgtttctttgtctatttttctttttttttaatgctacccagggaaatattttcatatcatttttaagtggcctgcctcaatgtatatttatttcttttgaaacaaaaaggttctggaaactgtttttctgtagctttaaatgaataggtgagcaaaatctatatgggatgtaatttttttgttcagtctcttaaaaaatactttgttttggtacatttggttgtgcttgtggggaaaataaaaacgcagagatccttatatatttatgttaaagtaatattttattatctacataaaacagaaatgcacaataaaaaaaaaaaaaaaaagctcgagggggg

SEQ ID NO: 1922 - DNA, 1295 bp, Homo sapiens
ggcacgagcttgtcccaggmctggagcagctgtggagaaactgggagggaagcccgtccagcctgattccaagcccacatgctgctcacaggtcaaggccgagggactgatttttgccggtctgactggactcaagttacttcccagttccttgcagagagctgtctttgtgagacagtgtcttgggttctggaatgatgggagccgtgctttgcaaatgaggagtgattgcgtgctcatctggcagctggtgggtgtcctgctggcatcaggcctgagcggtgaccgtgctcctctgattgtcctcactgcgtgtgacaaggcctgggccactgtgtgagtcgtcttgcgctccatgaagcctggtgtctgtgcagatgtgtgggtggcgttaaggttgggggacatttgtctttcacactggagaatgggagtctggagctggtgctactggtgaggaagaggcccggcctgctgccaggttcgcccacaccttccccctggttgttgggaaaaccaaccttggaatggccaaggcaggagatagcacctccccggtgaagatccaggagctctcatgagctccacgtggaaagatcaaggatctggagtctggagcccttcaggcagcaactcagtgaccatgaacctcagctctgtccacccggcacagcattgctgggagctggacccgggaggctgccggctccagagtgaggagggtccagaccatgcagacaatatgccctttttctccaaacaccatttcaagcaaacccgcaggtctcctccacggctgtcagcagcttctcgtagagcttctcataggactcatatggtggaatgtcgatccggttaaagctgaaaaaggacaaaagagagtcaccgtgtgggcagtccagccctaggaccaacctcaaggccaaggacaggcagtgagaaagacagggtctcgctaggttgcccaggctgctctcaaactcctggcctcaagtgaacctcctgccttgccctctcaacgtgctgggagccactgtgcccaatcaacacacagtaaaggggaagctcatttccagtatttgtgcaaagaaaaagacatcctttaagaagctatcgtagcaaaccaaaaaatacaaaattgtgacccagaggatgtacagtgacttctggctttctagggtgctgtggcaggtgctgtggcttttgagttctgatgatgacaaaaatattttggcagagactccatctcaaaaaaaaaaaaaaaaaaaaaaaaaaaaaaaaaaaaaaaactcgag

SEQ ID NO: 1923 - DNA, 408 bp, Homo sapiens
  misc_feature (330)..(330): n equals a,t,g, or c
atttagaataatgccctaaacttgtaatgtgagcaggtcttcagagtttcgagctgaagttacaggtttagagttgtccgttggaggtttttgtttcttcgtttaatgatttaaaaacaggttatgatacaagatcttcaaaatggttttaccacatgcatcatgacttagaatcttcgttggctcttttggtttttttcattcaaagttgaaatgcctcacctcttctttctttttctctctactaaccattttctactgagcacaccgtaccttatcagtctcataactgggccacctaactctsccctaagacagcactaggagttngacaccccagaraatctgtaagtcatgtactgctcatctaacgaacagtccctgctagccttgcctgcttcttttgca

SEQ ID NO: 1924 - DNA, 2094 bp, Homo sapiens
gccacccccttgatcctgtaactctataggtgccctgccttctgggtgtttctcatcagggctgtagatcatgaaggctcagatgctcttaagcctggcctggccccttcccctgagcacagctaacagctgcctaccgcagtttccaaggggattgtattctgctcactactgtcccagttgtttgcttttcttggaggctctaagttaaggaagcactgggtggcaaacttagagtttcctaagcatccttcagtattcttgctaagttgtgttctcaaaggcaggccctcccaggtgcctttggctcagtgggagaggagaactggaggagctgactctgtctccaacaagctccggggctgtgagcaagccctgcccttccctgaaagtgcagaatccccctgtctgcactccacagccaccctttttagatgggaaggaaagggatttgccaaagttcagttgatgtggartggcgctgggactcacatcctaattttctgacacttaagccaatagtctttcttcgtgaaaatgtaccttgtgtttagaggctctctgatgttcattctggttggtttcaggggtgtctgaktgcatcatcatgggaatcccaatgaacattggaaccgggctcttcaagctgcttcacaaggctgmcagggacccgaaccctcccaagaggcccctgatcttcgacacaaatgaattccacatcccccttgtcacatagtccaaagaaagaggggaccatgcctgaccttgactccttgtcctgtctccagctgatgtataaagagttttgtgctccctgggacgggggtcctgaggtccccacctatgccagcaatcagagaagccctcttggcatccccaggagcagcttctcctctgatagggtgcagctcacaccagtgaccctgactgtgccacgctgctcgggagagctgagggttttattgtttgcttgcttgaaacctaatctatagacggccccacagctcstgcacacactgcttccctggacttaaagcccagccaggtgtcatggtccatcccagctcactgcatacatccatcggctccccatggtgtcttcacacctgacgatgagccaggcctgagccccacacaggccagggcacattcttggattttccattccttggtcatgctggaatctctcaatgtgacatacttatgtaaatattgttactattatttatttgttccatttgagggatttggaatttttgttattttagttttatttttgaaaccaagcatctatagaaaccaagaaagtcagcatgtaagcgtcactggaaaaactggtttaagcaaatagagccgtctgggatttgtaactgaggtgcaactgtcatgaggcccaggcagctctgtaacatcttctatagatgcccctggctaccctgttgttttcatctacctcagacccctatcatggggctctaccctgtgacaagagccaaacccattctccatggcctatggaagcctcactggagtttggggcctgctgcaatggggatgagatggttttttgtagaattatacttacgttccttggatgatctctagttgattttttaagttctgagttgatgctgttaaggtacccggggtagccattggttcttggatctgtgttagaatgagtgctttcccttcctactgatgtgattgtggattaggaattcgtgaccgagtgatttttggccagtggttgggtttaaaattctattaaaatttgtagtttgggctgggtgctgtggctcatacctataatcccagcactttgggaggccgaggggggcagatcacttgagcccaggagttcgagagcagcctgggcaacatgacgaaaccccgtctctactaaaaaaaatataaaaattagctgggcacggtggcaggcacctgtaatcccagctactcgggaggctgaggcaggagaatctcttgaacctgggaggcagaggttgcagtgagccgagattgcaccactgcactctagcctgagcaacagagcaggatccgtctcaaaaaaaaaaaaaaaaaaaactcgag

SEQ ID NO: 1925 - DNA, 2240 bp, Homo sapiens
ccacgggcgctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaatacgatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtataacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggaaaaaaaaaaaaaaaaagggcggccgctctagaggatcc

SEQ ID NO: 1926 - DNA, 1707 bp, Homo sapiens
gcttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgttttttygagatcacgytactgggctc

SEQ ID NO: 1927 - DNA, 1965 bp, Homo sapiens
aagccaagcttggcacgagcaggacatggctcagcttgtgcccagagggagagttaagccgctgaccctgtagccagggagtgcacctgcaagcatgggggtggcaggagccacagagctggctgctgagaggagctgcagatctggagaagacagcctaggtaaaggtggacagtgtgagagctgctgatgagatagctgctgaataaaactacattttacctgcctatggcccgccaggttttctttcagctatcgcccatccacccagtcccctcgaacctcagcatgggctggaacctgaccctgggcatgacatttggcatagttgtggacctgacacctgtgtttgtcctagtcctgtttctccctgccttcctgttcctctcgctgccctcatggtcactcccaagagatccaacccatgttaagtatgggctggaggactgcatgaatgcctcatgatcttcccagaggcaaaggcacctactgccttccaaggtcagtgggaggttgggatcaacactgtttattatgcttaggacaaaaaagatggggagaaagatgtgcaaccttacaggtcatctttctgggatagaacacaatgggtcttctcctgcctcctggatatgttagtcaaggccagtccatgctacacatctagtctgacttctaaaatagaagcaccagatgaattcagccctgagagaattttcagcagctgtgggggcgctggaggaaacactattaaatagttttgcacctgagacagatagcctcactcgcctcaccctagtcctggtggcatttgtctcaggtgcaaaatttaagaaagaaaccttggagtgctcaccctgtggctgggtagatggtcctaaagtggtggttttcaagcctgagtgtgtatcaggatcatcaggggagcttgctaaagagcagttcctgcggtcagaccctcatgcattttgagcaggtgtggggactgggaaactgcatctgtaacctgctgtaatctaacgcttatctaaatactactgtgctcacacagagaacaccgcaaaagtagaggtgttcctccagagggcaggtgagcagatggcacagtctgcttggaattcagtcaggtgatgagagatgagatgaggcactcctagctttgggaagagggagctgaaagatgaacctttgcaggtgcccacggtcaaagtggtggtttaatgccatgccatgcccattttctgttggccttggcagggagttacagccctaccttaggacctggctccttatttctgctgtaggctctttcctgccctggccgagatggagtggaatgagcctagaacatcagctaatacatgtcctcagaaagataaaggtttacattttcacccccatcaaatctgaaagctctctgcctgtgtttttctaagggatagggacatcattactcagtccacaacctggactcatgtagggtcccctgtcagtaaaggagtcagtcaagcccaccaggtataccaaggactcttaccctcagcccctactccttggaaagctgccccttggcctaatattggtgtttagcttgagcctgactccttctcaacactaagagctgatgaagtcctgaagcagaaagagctctgacctgagagtcaaacatccttattctgatctcagctcagcccctgatttgttgtgtgaccctggatatgtcacttcctgtctttttgactttttaaaatgaagggtagactagaggagagcttctaaaactttaatgtggtcaacgaaatggaataggaaattccacaagtctgtccttccacaaaagcagcaaataaggtggcaaaaactcaaatttatgggaactctggaaacgaattgaaagtttacagcaatcaggtgaatacctaagaataaaagctggatttagtaagaaaaaaaaaaaaaaaaaaaaaa

SEQ ID NO: 1928 - DNA, 1854 bp, Homo sapiens
  misc_feature (57)..(57): n equals a,t,g, or c
  misc_feature (1844)..(1844): n equals a,t,g, or c
  misc_feature (1853)..(1853): n equals a,t,g, or c
gctgcggactgcagccccactcccgcccctcccccatcgtgctgcatgatctccacncacgcacgtccagggacagactggaatgtatgtcatttggggtcttgggggagggctcccacgaggccatcctcctcttcttggmcctccttggcctgacccattctgtggggaaaccgggtgcccatggagcctcagaaatgccacccggctggttggcatggcctggggcaggaggcagaggcaggagaccaagatggcaggtggaggccaggcttaccacaacggaagagacctcccgctggggccgggcaggcctggctcagctgccacaggcatatggtggagaggggggtaccctgcccaccttggggtggtggcaccagagctcttgtctattcagacgctggtatgggggctcggacccctcactggggacagggccagtgttggagaattctgattccttttttgttgtcttttacttttgtttttaacctgggggttcggggagaggccctgcttgggaacatctcacgagctttcctacatcttccgtggttcccagcacagcccaagattatttggcagccaagtggatggaactaactttcctggactgtgtttcgcattcggcgttatctggaaagtggactgaacggaatcaagctctgagcagaggcctgaagcggaagcaccacatcgtccctgcccatctcactctctcccttgatgatgcccctagagctgaggctggagaagacaccagggctgactttgacygagggccatggacgcgacaggcctgtggccctgcgcatgctgaaataactggaacccagcctctcctcctacaccggcctacccatctgggcccaagagctgcactcacactcctacaacgaaggacaaactgtccaggtcggagggatcacgagacacagaacctggaggggtgtgcacgctggcargtggcctctgcggcaattgcctcaccctgaggacatcagcagtcagcctgctcagagcgggggtgctggagcgcgtgcagacacagctcttccggagcagccttcaccttctctctgggatcagtgtccggctggccgacgtggcatttgctgaccgaatgctcatagaggttgacccccacagggtcacgcaggactcggacactgccctggaaacatggatggacaagggcttttggccacaggtgtgggtgtcctgttggaggagggcttgtttggagaagggaggctggctgggggagaaacccggatcccgctgcatctccgcgcctgtgggtgcatgtcgcgtgctcatctgttgcacacagctcactcgtatgtcctgcactggtacatgcatctgtaatacagtttctacgtctatttaaggctaggagccgaatgtgccccattgtcagtgggtccacgtttctccccggctcctctgggctaaggcagtgtggcccgaggcttaaaaagttactcggtactgtttttaagaacacttttatagagttagtggaaggcaagttaagagccaatcactgatccccaagtgtttcttgagcatctggtctggggggaccactttgatcggacccacccttggaaagctcaggggtaggcccaggtgggatgctcaccctgtcactgagggttttggttggcatcgttgtttttgaatgtagcacaagcgatgagcaaactctataagagtgttttaaaaattaacttcccaggaagtgagttaaaaacaataaaagccctttcttgagttaaaaagaaaaaaaaaaaaaaaaaaaaacccgggggggggcccggtaccaaattcgcccnaaagggggnc

SEQ ID NO: 1929 - DNA, 1768 bp, Homo sapiens
  misc_feature (483)..(483): n equals a,t,g, or c
gaagccagacagtgacctcaaatgttgccttggagtcccctacagcccctcagcagagggcagcacttgaatgcttagctccatcccatagttctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggmcacccatttytggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgnctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccagktgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattcyyccaggtgaatggggaagggtctgttccagcctctccctactcccatcccatttccaccaactggggaactgtgactatctatctcccccgacttctaccagggatgccttcagccaaggctgttctcaccagctgcctcagatgacaaatgaggctaatggacataatctacagtgtcctttttcacttgcaccttttttataagaatatattgtaatactaaaaaatattaaatt

SEQ ID NO: 1930 - DNA, 1308 bp, Homo sapiens
  misc_feature (36)..(36): n equals a,t,g, or c
aatcctcagtctggtctatattgttacttgcctgtntccactagaaggagtcacccaggcatttagtgaatgataatcctagaagttgagtctgagtacatcagagtttggcattatttgcaacatcccaggaatgagctataagactccattgctttctggactttagtgaccagctgatcttcccttggatcctccaataaaggggaaaaaatacttgtcttatgttgttttagcaagggagttcagccaagtgacaggaaagattccctggtctgcatctaaacattagtcaacagaaggaaaaggctcttttccttggagattttcaagttgaaaaagtacagctgcttggatggagtttctctcatcagaatagaaatatgctaggtggtcttcaagacctttttgaacctacagattctaaaccttagaggaagccagaatatgtgatcataccaggtgaggaaagttaggagatattcatcttaagagatatcctatttggcagtcacatgttacacttgagcaacaattgtctaggctagaaatatagaaccacacaatatttatcatcattgggtcaatttctccccctctatcaagtgaggagattaaggcttaaagaaaggaaaggacttgccagccaccacagggctcatgaggggcttgaacccatgtcgtgtgtctctaccacagctgactctcagctggctaatggagaaaatgtgaggaattacctgtcaaattagattgagctcagagtaaatagatgagcacatttataactctaaattagactttctatcaaatgggaccaaacatatggaaggggctgctgtcctgcctcaatttagccaagacttgtcttgtctcaaagccaagactcagcagtacatggattctgagaagtccagggtctgaattgttgtctctgattactggaaggacaggttaactgaatgtctgtgatcactaacaggtgatgggctttgtgcccactccagagatattgtgggagacaaattcttttaacagcctgtcctcccggcatcaggagtcattgaacaatcatggattgttgtgtttgggattttttttttttttggctttgtttttggtttttgtgtgtgtgtgtgtgtgctgcatgcacatgcgtccaagacttacgggtggtttaggggaaagtgctagcaacagtgtcaatgtcattgttaactatatttcatatttgaggtctcattgttttcaaataaacagtgttttccatgaaaaaaaaaaaaaaaaaaattcctgcggccgtcaagg

SEQ ID NO: 1931 - DNA, 2529 bp, Homo sapiens
tggcacgaggtggcacgaggtagattctcaatcaagtcctttagccttattgattaaaatagagacatttactatcacaaaatgatgcccccaaacagcctcaaacctgacacattagtttccctttcctgcctctgcccaaaatgaatgtttttctttctcttcccttgggttcttctctccctcccctcctcttccctccctctctcccttctctattcttccctctccctctctatttgtccttctctgctccaagtcctgccacaaccccaggattcatcagcctccctggacacatcccatccagctcctgaccgctcacctccttcactcctcatcctcagggccctttcctccatctgcctcagcccatgccagcggccatgctgtgcacctggaggggccacccacctgccaggaaacagcacattcagccatgcacctgactgcagcctccactctagcagattagctcagtcacctgtgacacactgttcctctggctctttgggactttcagcccatggacacctccatgcccatccctcaatctctgtttctccacatctctccctttccatctcaaatccatgctccagcaccaaacactaactctttccattctaaactccctctccccattgttcttcccttacaggcacctggcaaaactccagtcctcaacaaatgcagccaatggcgtttgctaatgccagcaggcctggccctgtccaactgtggtctcctccctcagctgggcctgcagcagcatccggcaaccctgctgctcctagttcagctcttgctcccatcctcctcaaagaccacactccacatcctcagactctgacaagcaggccaacccagtggtgtgctggcagatgcttaacaacaggctctagaggaggtggggaaagccctgatttgtagtgtttgcccattcttgtggtataagtattctcacaagaatctgaatatgaggccagactcagtggctcacacctgtagtcccagcactttgggaggccggggtgggtggatcacttgaggccaggagttcaagattatcctgaccaacatggtaaaactctgtctctactaaaaatacaaaaattagctgggtgtggtggcacatgcctgtggtcccggctactcgggaggctgagatgggaggatcactggaactgggaggtggaggtttcagtgagctgagactgtgccactatacccgagactgggcaacagagtgagaccctatctttaaaaaaaaaaagtaattaatagcctatcaaccaaaaaaagcccaggaccagacgattcacagccaaattctaccagaggtacaaaaaggaactggtaccattccttctgtgttgcaggaattcagggaccccgaatggagggactggctggagccttggcagaggacataaattgtgaagatttcatggacatttatcagtttccaaataatactttcataatttcttactcctgtctttattttaatctcttaatcctgttatcttcgtaaattgaggatgtacgtcacctcaggatcactgtgatgattgtgtttactgtacaaattgattgtaaaacatgtgtgtttgaacaatatgaaatcagtgcaccttgaaaaagaacagaataacagtgattttagggaacaagggaagacaaccatggggtctgactgcctgtagggtcaggcaaaaggagccatatttttcttcttgcagagagcctataaatgggtgtgcaagtaggagagatatcgctaaattcttttcctagcaagaaatattaatattaagaccttaggaaaataattgcatcccttgggggaggtctataaatggccactctgggagtgtctgtcttaagtggttgagataaagcctgaaataaggctctgggagtgtctgtcttaagtggttgagataaggccctggtctcctgcagtaccatcaggcttactaggattgggaaaccccaaccctggtaaatttgagttcagactggttctctgctcttgaaccctgttttctgttaagatgtttatcaagactatatgtgcactgctgaacgtagacccttatcgggagttctgattttgtccttgctgtgtttcctcagaagcatgtgatctttgctctgctttttaccccttaaagcatgtgacctactccctgtttgtacaccccctccccttttgaaatccctgataaaaacttgctggttttgcagctcaggttggcatcacggtcctaccgctatgtgatgtcacccccagcagcccagctgtagaattcctctctttgtactctttatttctcagaccagccaacacttggggaaaatagaaggagcctacgttgaaatattgggggcgggttcccccaatacttctgaaactattccaaacaattgaaaaggagggacacctccctaactcattttatgaggccagcatcatcctgatactaaaacctggcagagacacagcaaaaaaaaaaaaaaaaa

SEQ ID NO: 1932 - DNA, 1950 bp, Homo sapiens
  misc_feature (132)..(132): n equals a,t,g, or c
  misc_feature (225)..(225): n equals a,t,g, or c
  misc_feature (249)..(249): n equals a,t,g, or c
  misc_feature (577)..(577): n equals a,t,g, or c
  misc_feature (1933)..(1933): n equals a,t,g, or c
acctctcagaatcttctctcagcaacctgagtcttcgccgttcctcagagcgcctcagtgacacccctggatccttccagtcaccttccctggaaattctgctgtccagctgctccctgtgccgtgcctgtnattcgctggtgtatgatgaggaaatcatggctggctgggcacctgatgactctaacctcaacacaacctgccccttctgcgcctgcccctttntgcccctgctcagtgtccagaccnttgattcccggcccagtgtccccagccccaaatctgctggtgccagtggcagcaaagatgctcctgtccctggtggtcctggccctgtgctcagtgaccgaagctctgccttgctctggatgagccccagctctgcaacgggcacatggggggagcctcccggcgggttgagagtggggcatgggcatacctgagccccctggtgctgcgtaaggagctggagtcgctggtagagaacgagggcagtgaggtgctggcgttgcctgaactgccctctgcccaccccatcatcttctggaaccttttgtggtatttccaacggctacgnctgcccagtattctaccaggcctggtgctggcctcctgtgatgggccttcgmactcccaggccccatctccttggctaacccctgatccagcctctgttcaggtacggctgctgtgggatgtactgacccctgaccccaatagctgcccacctctctatgtgctctggagggtccacagccagatcccccagcgggtggtatggccaggccctgtacctgcatcccttagtttggcactgttggagtcagtgctgcgccatgttggactcaatgaagtgcacaaggctgtggggctcctgctggaaactctagggcccccacccactggcctgcacctgcagaggggaatctaccgtgagatattattcctgacaatggctgctctgggcaaggaccacgtggacatagtggccttcgataagaagtacaagtctgcctttaacaagctggccagcagcatgggcaaggaggagctgaggcaccggcgggcgcagatgcccactcccaaggccattgactgccgaaaatgttttggagcacctccagaatgctagagaccttaagcttccctctccagcctagggtggggaagtgaggaagaagggattctagagttaaactgcttccctgttgccttcatggagttgggaacaggctgggaaggatgcccagtcaaaggctccaagcgaggacaacaggaagagggatccactgttaccaaaagtcctgattcccccatcaccaacctacccagtttgttcgtgctgatgttgggggagatctggggggagttggtacagctctgttcttcccttgtcctataccgggaactcccctccagggtacccacagatctgcattgccctggtcattttagaagtttttgttttaaaaaacaactggaaagatgcagagctactgagcctttgccctgaatgggaggtagggatgtcattctccaccaataatggtccctcttccctgacgttgctgaaggagcccaaggctctccatgcctttctacctaagtgtttgtattttattttaaattatttattctggagccacagcccccttgcttatgaggttcttatggagagtgagaaagggaagggaaatagggcaccatggtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtctttttcaaaanaaaaaaaaaaaaaaact

SEQ ID NO: 1933 - DNA, 2105 bp, Homo sapiens
tccagaccatctacaactgcacggcctggaacagcttcggctccgacactgagatcatccggcacgaggagcaaggttcggaaatgaagtcgggagccgggctggaacagagtctgtgccgatggccgtcatcattggggtggccgtaggagctggtgtggccttcctcgtccttatggcaaccatcgtggcgttctgctgtgcccgttcccagagaaatctcaaaggtgttgtgtcagccaaaaatgatatccgagtggaaattgtccacaaggaaccagcctctggtcgggagggtgaggagcactccaccatcaagcagctgatgatggaccggggtgaattccagcaagactcagtcctgaaacagctggaggtcctcaaagaagaggagaaagagtttcagaacctgaaggaccccaccaatggctactacagcgtcaacaccttcaaagagcaccactcaaccccgaccatctccctctccagctgccagcccgacctgcgtcctgcgggtaagcagcgtgtgcccacaggcatgtccttcaccaacatctacagcaccctgagcggccagggccgcctctacgactacggcagcggtttgtgctgggcatgggcagctcgtccatcgagctttgtgagcgggagttccagagaggctccctcagcgacagcagctccttcctggacacgcagtgtgacagcagcgtcagcagcagcggcaagcaggatggctatgtgcagttcgacaaggccagcaaggcttctgcttcctcctcccaccactcccagtcctcgtcccagaactctgaccccagtcgacccctgcagcggcggatgcagactcacgtctaaggatcacacaccgcgggtggggacgggccagggaagaggtcagggcacgttctggttgtccagggacgaggggtactttgcagaggacaccagaattggccacttccaggacagcctcccagcgcctctgccactgccttccttcgaagctctgatcaagcacaaatctgggtccccaggtgctgtgtgccagaggtgggcgggtggggagacagacagaggctgcggctgagtgcgctgtgcttagtgctggacacccgtgtccccggccctttcctggaggcccctctaccacctgctctgcccacaggcacaagtggcagctataactctgctttcatgaaactgcggtccactctctggtctctctgtgggctctacccctcactgaccacaagctctacctacccctgtgcctgtgctcccatacagccctggggagaaggggatgacgtcttcccagcactgagctgccccagaaaccccggctccccactgctgctcatagcccataccctggaggctgacaagccagaaatggccttggctaaaggagcctctctctcaccaggctggccgggagcccacccccaatttgtttggtgttttgtgtccatactcttgcagttctgtccttggacttgatgccgctgaactctgcggtgggaccggtcccgtcagagcctggtgtactggggggagggagggaggagggagcctgtgctgacggagcacctcgccgggtgtgcccctcctgggctgtgtgaccccagcctccccacccacctcctgctttgtgtactcctcccctccccctcagcacaatcggagttcatataagaagtgcgggagcttctctggtcagggttctctgaacacttatggagagagtgcttcctgggaagtgtggcgtttgaaggggctggagggcaggtctttaagatggcgagactgcccttctcagctgataaacacaagaacggcgatcctgtcttcagtaaggctccacgagaagagaggaagtatatctacacctcaaccctcctagtcaccacctgaaataaatgttagggacactactccaacatgtttgttctgttcttttgttcctacaaagccacaggaagaacccaagagctcatagaatgcgttgggaacccaaggttctctgccctcctttgattcaatcatcctagacaataaaggcagttgatagctctgaaaaaaaaaaaaaaaaaaaaaaaaaa

SEQ ID NO: 1934 - DNA, 2277 bp, Homo sapiens
gaattcccgggtcgacccacgcgtccggacagcgtgagcccgcggcggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgatgccacatggaagagaaccagagagtggctcggcggcgaaggtttccgtttgtccgggagaggagtgactccactggctccagctctgtctacttcacggcctcctcgggagccacgttcacagatgctgagagtgaagggggttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgtatggaagccggcaggactttctctggcgcctggcccgagcctacagtgacatgtgtgagctcactgaggaggtgagcgagaagaagtcatatgccctagatggaaaagaagaagcagaggctgctctggagaagggggatgagagtgctgactgtcacctgtggtatgcggtgctttgtggtcagctggctgagcatgagagcatccagaggcgcatccagagtggctttagcttcaaggagcatgtggacaaagccattgctctccagccagaaaaccccatggctcactttcttcttggcaggtggtgctatcaggtctctcacctgagctggctagaaaaaaaaactgctacagccttgcttgaaagccctctcagtgccactgtggaagatgccctccagagcttcctaaaggctgaagaactacagccaggattttccaaagcaggaagggtatatatttccaagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgttaaaaaaaaaaaaaa

SEQ ID NO: 1935 - DNA, 1753 bp, Homo sapiens
  misc_feature (129)..(129): n equals a,t,g, or c
  misc_feature (1746)..(1746): n equals a,t,g, or c
tccacccagacccactctggatcccattcaaagaggtggcagtgaccctcatttaccaactggcagagggccccgaagtgatctgtgcccagatattgcagggctgtgcaaaacaggccctggagaagntagaagagaagagaaccagtcaggaggacccgaagagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcgcctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagsggttccgcacatcccgaactgagcggcacagcgagacctggcctactgtgtgtcacagctgcccctcacagagcgaggcctccgtaagatgcttgacaattttgactgttttggagacaaactgtcagatgagtccatcttcagtgcttttttgtcagttgtgggcaagctgcgacgtggggccaagcctgagggcaaggctataatagatgaatttragcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctctttttaaaaaaaaaaaaaaggcngggcact

SEQ ID NO: 1936 - DNA, 1043 bp, Homo sapiens
cccacgcgtccggagctctgcccagttctctaggtcttcagactttgacctggcccaggttttccatctgcatgtgaggagcaactggacaccggacagtggtaggacttgaatgaccagaaagtaaatggacaggaagccagacagactttgcatggaatgtggaaaagtccagagaagaattggctccttatgacatgaagaatgaatgaggtcccagcacataacatggtgccttcttttctccagtcccctggctactcttccagcagcattaccactgggtgcctgtgcagcagtattcactgtgataggaagtgagaagcagtctgagtgttcattgctgagggaatcaagggcaaaatatcatggatgcactcatggacaaataagcagcagtttgaagcaacaccctagatggatgtacagccatcaagaggatcttaaagtgtggtctttagtggaaaaaaagcagaagcaatgtatgggagactgagtaattacatatgagctcacatcactatctcttccgccactgtcatccatcatgactgatctgggagatgaaacagcacagatctaaaggacgtggctggagtgcaatggcatggtatcggctcactgcggcctctgtctcctgggttcaagcgattttcctgcctcagcctcccgagtagctgggattacaggcatgcgtcatcatacctagctaatttgtcccatagaatctcatcttctggattttgtggctattttttcatggtgttgattcattcataaggtaaaatttatatacagtgaaatgcattttatgggtacaattcaatgagttttgaaaagtgtgcacatccatgtaaccaccacccagattaagacacagaacattcccgtcacctcagaatgtttcccggtgccttcttcctacccctcatacagtaacattgtaataatttctattgccacatatatgtttacctgttctgaaacttcacagaaatggaattatatattatgtatttgtttgttaaaaaaaaaaaaaaaaa

SEQ ID NO: 1937 - DNA, 429 bp, Homo sapiens
  misc_feature (429)..(429): n equals a,t,g, or c
ctggtacgcttgcaggtaccggtccggaattcccgggtcgacccacgcgtccgtggacctcctgtgcaagaacatgaaagacctgtggttcctcctcctggtggtggccgctcccacatgggtcctgtcccaggtgcggttacaagagtcgggcccgggactggtcagcccctcacagaccctgtccctcacctgcagtgtctccggaatcaatatcggcggcggcaaatattactgggcctgggtccgccagcggccaggggagggcccggagtgggtcggctatatttcttataccggagtcgccgactacaacccgtccctccggggtcgactgaccatctcactgggcgaaagtaacagtttctccctgacgctcacctctatgacggccgcggacgcsgtcgtctattattgtgcgacagattn

SEQ ID NO: 1938 - DNA, 2860 bp, Homo sapiens
  misc_feature (753)..(753): n equals a,t,g, or c
ggcacacagggctggcaggcccgcggtggctggtgttgaggcatgaacaaattgtaccgggtatcccccaccccactctgaccaccagttcctccttggatatcactccccctgacaggcagcccacccaggcctggatttgtccctgtctcccccttttgcttttcccccatgactaatgggcaccaggtcttgctgctcctgcttctcacctctgcagtggcagcaggcccctggccccaggtgcatgccggtcagtggggttggatgtgccttcctccaggcctgccctctgtccaagcccggagtgggcttggtgggctccctggtggcccccagtgggtgccaggtggtgcccggggttattgaggggtggttgtatcactgtagggacaggcttcttgccccagcctggagagctgttttcttcaggaaggttctggagatggagacttgtttgcgaattcaccacaactccaggctgggaggctgggtctctgctctcagagccgagacaccagggaggatagccaggctgccctgcctgggaattctgctgggccgtcaaattcaacccgcaccaacgtgggcaggaggccacagtgtcctgccaggagcagagggctgaaggtctgcaggaggaagaccctatcctggtggggggcacctgctgcccaccctgcccccagcgtgcctggggggagcacacctgggcatggaggagtccagggtgctgggccacacaagagaggngggggagaggcctggacagtaggaagatcttgcccagggtcctggatccgccactctgggggtgaccttggacaaacctctgccttggccctcagtctccccatcaaggtttttccattcaggagggtttgggccatcttcagccaccctaccagccctgaaaaggatgtgactcctgtttctgggaagtgtgtggtgtgttaggtgggcctacagccctggttgtggggagggaaggatggagagacagcacagtgacagagcccagactgcaggctggagtgagggttccacttccccgctgctgtgtgtcctggaccagtgcctctgaaccttggcacttggggcagtggatattaacatctttccaagcccaattcttggggcatcagggcctccggtcctctgggaggtggcaggtcctcagattggagatgccatgggggggggaggtgcctctcctttggagggtatggaagtggagacaggagtggcctggcgcagctgccgtggttcttaggggctgggcccggggagcccatggggcttgtgcctagaaagcctgggctcctcactggggtctagatgtgcagacttcatgtctccccagctccagctctgttctctataggtcaagcctccacaatgccagaggcccagggctagccccctccacgtccctcctagatctacagctgcccctttgatgacagcgccattgagtcccctgggctgggggggtcatgcaggggtgaggcagctgcctgccgccggtactcattgcctggccaggcaggacacaggctggcgggcactgagagtgggccccacgaaatccattgtcaggttaccaggatgaagaacccaggctggtcgtggagtgcagggcggggcctgccggaagaattatgggcactgcagcaggagggcagcctgggccattagctcctgatgtcatcgatttgggtgaggggacagggaagtcagaggaagctggccagtggctctcacgcagacttacagcagtggagtggtgcctgattcctggtacagctgctcccactgagtctccagggatctgtggttcaggaccccctgcaaccccctcccagacccctgtactggtgggaggagaggacctagaggaaaggtgctgggcagataagcagctgagggaggccctgggtttagcttatcagtcttctgggccctcctgccccaggaagggcagcgaggaccatggtgttgcccctgtcatcgttatcgtcctggccatgagcttgcaggactgggagggccggagtcagccaggcagacggcagcacagcatttgcctgttggcaggtggccttggtggcttcccaaaggcaatcgctccacgcagaacaaaactcacttttttggggggtgaagcaccttggttcatttgtttagttcgttaattccagcagtctgtttctaagggaaacatggctgcagccggtcctgcgcctcccaccctcccaccaggtgcccagtgttcccaagggccccgaatcccaaccttattcaggcgtcagcatctctgcaccccaaatgcctgttagggaggatagtgaaggctgagccctcctgggcccatcaaaagccagcagtgagagaacacccccatctctctgaggtgaccttgtagggcagtccgtgctgtctggctggcctgggtgaggtgggcagggaccaaggcctggcgcctgggcctcgctggccttgctctgcgtgctgacttcatcctgatagtaccttgattttcctactgtgacttccccttctgtcgacttcctcaccaactttaaaattccgtattgagagcagtttcctaagttacctcaaatcctattcagaagaaggttcttcctggaagttgggagggcggaaaacaagtttagtcacagaagactactccatgtttgagcttctgtttcaagggaagtgagtaactgccggaggagccctgcccctctgcagtgtgtggtgttgccctgatacttttcagattgaggtgttacttacatgtaataaaatgcacagacttaagtgtaaaaaaaaaaaaaaaaaaaaaaaaaaaaaa

SEQ ID NO: 1939 - DNA, 524 bp, Homo sapiens
gggtccatattctccggatgagtgcatctctttgcctgtttacacaagtgctgaaagggatcgtgtggttaccaatattgatgttccatgtgggggcaaccaagaccagtggattcagtgtggagcagctctattcctaaaaaatcagtagaatctaatgacaacaaaagccatcttcacaaaagggaacattgattctttaagctttaaatcaaacatgtggtcagtctacatttgaaatgttagttcaaaatattaacatatagttatgttgttgatgtcactgaaattttaatgtgtaaaagcagcactgtgcatcttttaaagtaataaattaatggagttattgttaaaacagagtattcttttgacaacattaaatatttctgtgagaaagttcacttttccagtggctcaaaaatttgttttaggtccagagattttaagtggtatattaaccaataataaatattttggctgtcaaaaaaaaaaaaaaaaaaaaaaaaaaaaaaaagggcggccgc

SEQ ID NO: 1940 - DNA, 1163 bp, Homo sapiens
ccacgcgtccgccaagggtgctgattagggaatggttatggactaggagtatcagtaacaatggttagaaagtggctaacatttgttgagcacctgctgtgtgcctggccccggctgggagccttcgtgcccagagtgaccccgtctgaatgcagttctttgcctcattcaaactggggagtgggaggcagagctgcacaactcacaggtgccgagctcaagactcactcctgggtctgcctgggctgggctgtgcttgttgcccctgtggccaacacacgcgcacctttcacctgaaagccaggatccgcagaacgttccccgaggaggtcattgtttggcactatgatttgtctcttcctaaaaaggtgatagagttacactggagagagcagcatccaggtgcagcagggatgggcctggggctcacgggcaggggctctgtgtccggctggggcctggggtcctgcgctgcacctgtgtgtcagaagcactcagtaaatctttgctgatgaaggatgacaggatataggacatgatgcttgctgctgcattgcctgcaatcctggatgaatgcccaggttggctttgctccccgtcgggtggatgtgacgttagctgtgatgttaggtccctggctttaaaatacgacggaactgggaattgagggagcagttggggcagaaaggacagccccgcagaggcctggagctgagcagtgcgggcgacccaggagcagtgagtgcttccgtcacagccttcatcgcaccctgtggtcctcataaaggggatggaatctacgaatttagttttcccagcctccttaaaaactcattcatgccaggggcagtggctcacacctgaaatcccaccactttgggaggctgaggcaggctgattacttgaggtcaggagtttgagaccagcctagccaacatggtgaaaccccgtgtctactcaaagtacaaaaaaaaaaattagtcagacgtggtgtcacgcacctgtaatcccagctctttgggaggctgaggcaggagaatcacttgaacccaggaggcagaggttatagtgagccagtattgcgccactgacctccatctgggcaatagagtgagaccctgtctcaaaaaaaaaaaaaaaaaaaaaaaaaaaaaaaaaaaaaa

SEQ ID NO: 1941 - DNA, 3203 bp, Homo sapiens
  misc_feature (1306)..(1306): n equals a,t,g, or c
  misc_feature (2539)..(2539): n equals a,t,g, or c
ccacgcgtccgcccacgcgtccgtttttagtctaatgatattgagtagatacttaattatgtcagtctattatgtcagtttttaaactccaatgttcatcttttcttgatttatgctaccaactttattatgtattacattcttataagtagatgagtctgtttctgacgcttgctctctgttctgttctacttgtccatttaaatgttcttgctcgaaattgtttctatgacagtggctttgtagtacatccatggatttggttgggacactccctcccctacttctacttttctcctctttctcaacgtttatttagttatttgtggacctttatttttccatgtagattatagaggttttcagagatcctcagaaaacccaactgaaatcttacttgaggttaatttgggggagaattgagattttatgataataaaccacccttcccaaaagtatagactgtctccccaattattcttctcatcttatatgttctttagactaatttagactaatatgccttctcatattctgcagagagaaaggtctagtgtctcttcctctagttataagggcactaatcccatcaagggggatctaccctcctgacctcatctaagcacaattattttccaaatgccccacctcccaataccattgcattgaggttagagcttcctatgtgaatgggagggtggaggaaagaacacaaacattcagtttattacatatcttataaaatattatgaatctggttaaagtattttcaaagaaatgttttaactatggagaccagatgagtgaacaatgaaccttgccataaatatgacagcagagaaaaaatgactatccttgatatggtttggctatgtccccacccaaatctcaacttgaattgtgtctcccagaattcccacatgttatgggagggacccacggggaggtaattgaatctgaaatgctcttcctatctttctatgcttatttatcagtcctctgctaattcttttcaatgattgattcaatgatgaattcccatgctattctcatgatagtgaattaagtctcacgagatctgatgggtttatcaggggtttgcacctttacttctctctcgttttctcttgccactgccatgtaagaagtgccttttgcctcccaccatgattctgaggcctccccagccatgtgcaactgtaagtccagttaaacctctttttcttcccagtcttggatatgtctttatcagcagtatgaaaactgactaatacagtaaattggtaccagtggagtggggtgctgntgaaaagatacctgaaaatgtggaagcgactttggaactgggtaacaggcagaggttgaaacagtttggaaggctcagaagaagacaagaaaatgtgggaaagtttggaacttcctaaagacttgttgaatggctttgacaaaaatgctgatattgctatggacaataaggtccaggctgagggggtctcagatggagatgaggaacttgtagggaactggagcaaagatgactgttgttatgttttagcaaagagactggtggcattttgcccctaccacagagatttgtggaactttgatcttgagagagatgatttagggtatctggctgaagaaatttctaagcagcaaagcattcaagaggtgatttgggtgctgttaaaagcatttcattttaaaagggaaacagcataaaaatttggaaaatttgcagccagttgatgcagcagaagagagaaacctgttttttgaggagaaattcaagctggctgcagaaatttgcataagttacagggagctgaatgttaatctccaagacaatggggaaaatgtctccagggcatgtcacaggtcttcatggcagcccctcccatcacagaccctgaagactaggaggaaaaaatggttttgtgggccaggcccagggtccccatgctgtgtgcagcctagggacttggtgccctgcatcccagctgctccagccattgctaaaagggccgaggtacagctctgcccatggtttcagagggtgcaagccccaaaccttggcagcttccatgtggtgttgagcctgcaggtgcatggaagtcaagaattgaggtttgggaacctccatctagatttcagaagatgtatggaatcacctggatgctcaggcaaaagtttgctccaggggcagagccttcatggagaacctctgctagggcagtgtgaagggaaatgtggggttggagcccccacacagaatccctactggggcaccacctagtggagctgtgcgaagaaggccaccgtccttcagaccccagaatggtagatccaccgacagcttgtaccgtgcacctggaaaagccacagaccctaaacgccagcccgtgaaagcagccaggagtggggactataccctgtgaagccacaggggcagagctgcccaagactaagggaacctacctcttgcatcattgtgacctggatgtgagacatggagtcagaggagatcattttggaacgntataatttgactgcctcgctggattttggacttgcatggggcttgtaacgcctttgttgtgggcagtttctcccatttggaatggctgtatttacccattacctgtatccccattgtatgtaggaagtaactagcttgcttttgattttacaggatcatgggtagaagggacttgccttgtttcagatgagactttggactacggacttttggattaatgctgagatgagttaagactttgggggactgtttggaaggcatgattggttttgaaatgtgagaacatgagatttggaggggccaggggcagaatgatatggtttggctgtgcccccacccaaatctcaacttgaattgttatctcccagaattcccaggtgttgtgggagggacccagggggaggtaattgaatcatgggggccggtctttcccatgctatttttgtgatagtgaataagtctcaggagatctgatgggtttatcaggagtttctgcttttgtttctctctcattgtctcttgccgctgccatataagaagtaccttttgcctcccactgtgattctgaggcctccccagccatgtgcaactgtaagtccaagtaaacctctttttctcctcaaaaaaaaaaaaaaaaaaaaaaaaaaaaaaaaaaaaaaaaaaa

SEQ ID NO: 1942 - DNA, 448 bp, Homo sapiens
  misc_feature (384)..(384): n equals a,t,g, or c
  misc_feature (405)..(405): n equals a,t,g, or c
  misc_feature (412)..(412): n equals a,t,g, or c
  misc_feature (447)..(447): n equals a,t,g, or c
ggtaagaactaaatcactagggtgcatcagtttgttaggcgcctgctgtgaagcactttagatcctcatgcagcctccttttgttctaaccaccaccaccatgatcagcctattcttggcactgatcagcaccaagaaggtgcatctgacaatacctcagccctttacttcccactccagactttcttttgatgtttttaaaagaaaagcaagagcctgacagtagtaaagtggtgaaaacatatttttctattgcagcaggggaaaagagacctcattataaaactgggctcaattctgaatgcagcatggacaagtggggatttatagccaataagcagactgggggtcagggggtagaaagttactaagtgggaacatccnggaaatttctagctaaaccgntctaacnaatgctgctgaaggcagtgagggtattaggtatcnc

SEQ ID NO: 1943 - DNA, 2528 bp, Homo sapiens
ccacgcgtccggtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgtttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaagtaaattgggatgagaaaaatccttaaaaagtcacgttttccatttgattgggtcaaaatatcaggaaatttcacctgaagtatttgtaccgagatcctgtagttctaataaattcaccaaagttggggagaacttaggtttttgttttaagagcaggtaattgatgacctaaaagtatacctggttatacttgcggttttttccttctgttcagtccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatgacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagaggtaaaactagaaagaaggagaactcttccctcaagaatggctgtaccttcatatctagaggcacattaaaaaaaagaacgtctgtaccttaaaaatggaggtcatttcattgtgttcattttcaaggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtctattttgaggaattacgaaaggtgctagttaaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggggccaagaaatgaagcttcaggcctgtgaagttggagagcagcaagaatagtgcctcagagcgaaataacttcatgcactccttcaatatctcaggaagcttactctcctcagctttctcataaaacctgaaaaacagcaatgtcaagttgttcatcaaagccacagatgtaaaatgactcacagaataaaagctgatcgttaaaaaaaaaaaaaaaaaaaaaaaaaaaaaaa

SEQ ID NO: 1944 - DNA, 1189 bp, Homo sapiens
ggtagacatctggtagcctctcagaagcgtgtccttagagacagacgtgtccagacaggcatatggagtgaccaattgtattctcagcggccttgggctccagtgacttggcctgatcactggggggtgtgtgtgtgtgtgtatgtatgtatgtgtgtgtggggtgtgtgtgtgtgtgtggtggccagggtgtgtgtgtggctggggctagcagagctatttcggggaagggttagggactgtggaaaaataactcattttcccacgtatctcctttattggactttgaaaaataataataaacatcaagttaagttcctaaaccatgtattgtgtgtgtgtgtgtgtgtgtgtgtgtgtgtatgtatatgtaaatgtatatgtatatgtatgctactttatttccaggtcaacaattacattgaggattgtatcgcccaaaagcactcgttgatcaaggtgttaagactagtttgcctccaatccgtgtgtaatagtgggctcaaacaaaaagttttggattattacaaaagagagattctccaggtgagtatatttttaaattattaatttgccaagggggacagcatctttttaaaaaatacttcatgggccgggcacagtggcttacgcctgtaatcccagcactttgggaggccaaagcaggtggatcacttgaggttaggagtttgagaccagcctggccaacatggtgaaacccccatctctattaaaaatacaaaaattagccaggcatggtagcatgcacctgtagtcccagctatttgagaggatcaggcaggagaatcgcttgaacgcaggaggcggaggttacagtgtgtcaagatcatgcccctgcactccagcctgggcaacagagtgagactctgtctcaaaaaataataataaaaaatttaaaattaaaaaaaataaaaattacaaagctgccattttggtatcttgtaacgactgttgtataaattttttaacacctagaggaattggtcttggtagccatcactgtttattgtatttgtgtgataataatagctaacaggctgggcacagtkgctcacctctgttatctcaatattttgtggggctgaggcgggaggatcgctggaggccaagaccagcctggcaacatggcaagaccctgtctctacaaaaaaaaaaaaaaagggcggcc

SEQ ID NO: 1945 - DNA, 1461 bp, Homo sapiens
ccacgcgtccggagagttatggagaatgctgattttgattattatgatgccagatactgagaatatcttacatgtatcttctgagcagagcttctgttccacaaagttaaatccatgcttaatataatttttgccaagtaaattttagtcgattgcacctcagttgttgattagtaacccatcggcagtagaaagatggcagtgttttttccaggctgtttgttcctctaagtatctagacgaggccgagtcagccttatgggtctaaagctgccaattttcctgtggtttctttatttctttatccctttatccagctgctacttactgctattgccacatttgccctctggctcatgggatagcatgcttagcttcccctgaggctactgttaatgcttcctttttactctgctggctggaaatgtacttggcatccttagtcttaaacctctcctccctcttttttccacagacaccaggcacttaagtagcactttcagcctgcaccagttatcagtagtagctttcaacccctcatttctggtctggtaactcagcacactgtcccaagagagcttgactaagccaatttgccccctcttcccttcttcctctgtctgttcatctttcttttttctttttcctacccatccatttccttgactctccttttatttttctcttactctctttaatctcccaaatgatttttttctgcttttagtatagcagatgccccagaattaggcagatacttgtaatacaaaataaaacaatagtaaattttaaaattaaacatttgctcaagattggatcaactaaaaaacgagtttattttttatgactggtctattcgcccctttatggctataatgcagattttttgtattaaaagtgtataggtttgtgtttttgttttttttgtgcttttacataaagagttgtgaagatcgtttttatgcaggcctgctcattcaagatgatctgtgatgtgggaaaaaagtaaaatctttttctagctaatgttttacaaggaaaaggaaagctacttttatttttatttatttatttttttacatacaatgattcgaatacacagtttgagttatttttcaaactaactttctctgaatatgctataaatgttggctgttcatttttcaagtaatggtttgtaaacaacttttaggcattcttagctaactaatatttatgaccaatagtttaggacataaagattatacctatgaattgggggatcaagaacagtaacagtgctctgcaggcctcgatcattaactgccaacaaaatctacaggacaattccaaatgtctgcaaaagaaaaacatgaaaaattcatactgataattatagatcagaatcatttaaagcccttatctccttcctcctctcatttccctaatcttaattctttcctctggaaaaaaaaaaaaaaa

SEQ ID NO: 1946 - DNA, 1113 bp, Homo sapiens
  misc_feature (393)..(393): n equals a,t,g, or c
gatgctcctttagcttggaggagtttgttattacccaccttctgaagcctacttctgtcaattcatccaactcattctcagtccagttttgtttccttgctggtgaggagttgtgatcctttggaggagaagaggcattctggtttttggaatttttagccattttgctctggtttcttcccatctttgtggatttatctacctttcatcttcaatgttagtgacctatggatggggtctctgagtggatgtgctcttcctttctgtttgtwagttttctttctaacagttagcccctctgctgtaggtctgctggaktttgctggaggtccactccagaccctgtttgcctgggtatcaccagtggaggctgcagaacagcaaagattgctncctgttctttcctctggaagcttcgtctcagagggcacctgccagatgccagccagagctctcctgtatgaggtgtctgttggcccatactgggagattcctcccagtcaggatacaaggaggtcagggacctacttgaggaggcagtctgacccttagcagaggttgaacactgtgctaggaggtcctctgctcttttcagagctgtcaggcggggcgtataagtctgctgaatctgtgtccgcagccaccccttcccccaggtgctctgtcccagggagatgggggttttatttttaagtccccaactggggctgctgcctttttttcagagatgccctgcccagagaggagaaatctggcagtctggcctcagaggccttgctgagctgccgttggctccacccagttcaaacttcccaaggggctttgtttatactgtaaggggaaaaccgcctactcgagcctcatcaatggcagacacccctccccgcgccaagcttaagtgtcccaggttgatctcagactgctgctgtgctggcagtgagaatttcaagccagtggatcttagtttgctgtgctctgtgggggtgggacccattgaaccagactactcggctccctggcttcagccccctttccaggagagtgaagggttctgtctcattggcattccaggagtcactggtgtatggaaaaaaaaaaaaaaagggcggccgc

SEQ ID NO: 1947 - DNA, 1479 bp, Homo sapiens
ccacgcgtccgcagtgatatgcctgtttttgtgtgttccatcggactttgtttccttttttcgattttgttattgtttccaccttttcaattttcttacatttgttggctctctcaagcttctgtttattccccttctccctcccttagtaatttggaagttctactctgcttatcaattcttctgatgattatctttccattccttataagcataattcacattttctctattggtagattaagcacacacatgggcgcacacacacacacacacacacacacacacacacacacacacacacaggtgtgttactggcctttactcctaatttctcaggagaatgaaccatttagaatgtttttacctcttcattctgccctcacccaaaatttctgttcttagaaaagaacagatctttttttttctgagattttttttttttttaattagaagagacgctggaagcatgatgacagcagcgtagttttcactctcttgttatgccagcatacagacagagcaaccagatgacaaaatcaaaacccatgggtaatatttacggtgaggccagtagacacagtgtccccagtgtggcagattttctgcagatagggctgccagctgtatttccaaccctgtatgtgtttgccaccctcccatcaagacatggtgcctattttttcatcctttgtgtctgggctggccttgtgttccatttgaccaataaggtatggtagaaatggcattctgggacttctgagcccaaccttaaaagacattgaacttttgctttagtgagaggggaatcaagataccctgtaaagaggtctgtgctgtccttctgaagacagaggtcctggaagatgagacactttttaaaaataggtcatgcagcgctgtggcagccacccagctagctcagttggtagagcatgagactcttaaatataggccatgtacataactgaggccccagctggcagctagcactgaggtctcagtcgtatcatgaaattatcttgcatcctccagtaccattccagcttctccaggcatcatatagagaagaaacaagtctgggcgtggtggttcacacctgtaatcccagcactttggtaggccgaagcaggcagatcatctgaagcagtgaagcaaggagtttgagaccagcctgggtagcaaagcaagacctcatctctactaaaatatattagtcaggcacagtggcacatgctggtagtcccagctactcaggaggctgaggtgggaggattgctgtgcccaggattttgaggctgcagtgagctatgatcgcactactgtactccaatggtcaacagaacaagatcccacctcttaaaaaaaagaagaagaagaagaaacgagccatccccactgagccatgcccagattcgtgagcaataaaatagttattaatccactaaaaaaaaaaaaaaaaaaaaaaaaaaaaaaaaa

SEQ ID NO: 1948 - DNA, 2273 bp, Homo sapiens
gcgtccgatcggagcgcggcgtgcgggagggcccagagcaggactggaaatgtcctggccgcgccgcctcctgctcagatacctgttcccggccctcctgcttcacgggctgggagagggttctgccctccttcatccagacagcaggtctcatcctaggtccttagagaaaagtgcctggagggcttttaaggagtcacagtgccatcacatgctcaaacatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaaaaaaaaaaaaaaaaaaaaaa

SEQ ID NO: 1949 - DNA, 849 bp, Homo sapiens
  misc_feature (1)..(1): n equals a,t,g, or c
  misc_feature (849)..(849): n equals a,t,g, or c
ngaacgatcacaaggtcatgcacttagatttatgaccaatcatcaagctattaatttactcaaatggtgtattaatttgttaggacggtcataagaaaatactacagatttggtggcttaaacagcagaaatttgttttctcacaattccaaaagctgtgaaatccaaggtcaaggtgtcagcaggtctggcttctccttaggactctggttgtcttgcagatggccaccttctcactgtgttatctcatggcctttcctctgtgcgcaggcatcgctgggatctctgtatgtgtcaaaatttcctgcttttataaggacatcagtcagactggattaaggcccaccctaaaggcttatttaaattttaatctcctctttagtggtcctatctccaaatatagtctcattctgagatactggtatttagggcttcagcatacaaattttggggtagacacaattcagcccataacaaattgtgctcatgaaatgatttactaataatgattgtggagagagatagtaatccgactgtgaatcctgaataattagtggcttcatgttcatagaagtggactcaataatgggcatgaacctgcacgagggaggcattgcggagaagaatacgtcccattttctgtaccaaagaaaaacaagtacacattgcaaacaataaatctttatcaaattcaaccaccttattttgaactctataatcattcaaacgtggcctagactaacatttgcttttttatagcttttatcaagaggagtggaggtattaaaattattattgaggggtgtagtgattttcaactgacgcaattctaccctccacctctcatgn

SEQ ID NO: 1950 - DNA, 1088 bp, Homo sapiens
ctactatagggaamgctkktacgcctgcaggtmccggtccggaattcccgggtcgacccacgcgtccggaggtggggggcagagtccccaggcagttgggattccggggagggaccacagtgctgggaaccacagcactgacgccatacacaccaggggatgtttgctcttgcatggaaagtgattttcagtgtcatgctgcagaatcccatacgttatccttcagtccttggtataaagtcctccctgctcagtagtcttgtgttggtgatggtttggggaaatgaaaagagtgggccctgccccacaccaaagtccaggaagggaagaaggagctgtccagcacaggtggggaggggagaagaggggtcctattgggacccagaattcagactgagcaggaaatccaaccaggggttgaggagggattacctgagcttgtatcacttcaacctgcattttagagacacattctaatctcacagatgcagaatttggggatccctggacagctaacacttggggtgcaaatgtttcttgttgaatgagaggaactgggtgtagtaaatgaaattcttgcatggaagtctgaatacaactggtggccgcatcccgaccaacagacaagaggacaaactttcaaaaatgctgtgtcttcttctcatccttcttttagagtctgtctaccagaattccaccatctgaagtccccggggtgcaaatcctgtttgctgttaattcttccagctctcacgtatggtggcttgttgtgtcacgtgttttgcaattttgcattgcgcgttccatctttgtcagagctttatccgtgggaatcggtgtgtctaggctgggagtccgtctctccctggggggtgagcttatacttccacgaggcaccagaagacactccaaacccaagactgcttgaagtttagttcccatcttgcatgkagaataaattcagatccaaaatattcatgagaaaaaaaaaaaaaaaaaaaaaaaaaaaaaaagggcggccgctctagaggatccaagcttacgtacgcgtgcatgcgacgtcatagctcttctatagtgtcacctaa

SEQ ID NO: 1951 - DNA, 438 bp, Homo sapiens
  misc_feature (26)..(26): n equals a,t,g, or c
  misc_feature (371)..(371): n equals a,t,g, or c
  misc_feature (411)..(411): n equals a,t,g, or c
gttttctatgcacatattatgtcatnttcaaacagggaaaatttgacatccttgccctttatttctttctcttgcctgatttctctggccaagacttccagcactatgctgaataaaagtggtgaaggtgggcatatttrtwttgttccagttcttagaggaaaagctttcagtgtttccccattttgtatgatggtggctgtggatttttcatgcctatcctttattttgttaggtatacttgttctatatatttattttgttatgtatgcttgttctatacctactttgtttagtgttttttatcakgaagaaatgttgaatttatcaaagctttcctgcatttattgagagattatatggtttttgcnattcactcgttgctcttcaataaatatgatgtgagtcatntttttatttgaatagtcaaaacatcct

SEQ ID NO: 1952 - DNA, 827 bp, Homo sapiens
gggcacgagcttgggcctcaagtgattctcctgccctcagcctctcaggacaaccccagttctgtcatccacgtggtgaatcagaccaatgcccaaggccagcaagagattgtytamtatgtgctgtctgaagcggcacgagcctcccccagcccctgagccaccttcagggggcatcatggaaaagcttcaaggaatagctgaggagccagagatccagatggtttgaaggccgcagagccagaccatttcttccccaggtcctgaagtttgagccaggcaagtggcagtgcccctagtgggcagccgttgccaatggatgcctttaggagtggtgccgagagcagtgtggtccactctggcctgggtttgcatcattctgcagactctaaagacttcccttttctgccagactacattttgtggggagcctgaggactctggattctttgaggggatcctggatgtgtgtgttcttgttaaagaggctgttatcaggcttaaccataaccctcaagatctgcttgacagtgattaaatccttagctcacatccattcccatctttcgggctccttaggcccaaggatggcatgtgactggtccctgcaagggtcctttctttgtcaccagccaaggcattgataaccaagtagccattttcctcttaaggtttcctctacaaccccaaggactttcatgattatcctcagggacaggattggaggcattgagcgtgtttattaacaaattgtttttggtaataaaataaatgcttggaaaaaaaaaaaaaaaaaaaaaaaaaaaaaaaaaaaaaaaaaaaaaaaa

SEQ ID NO: 1953 - DNA, 1523 bp, Homo sapiens
  misc_feature (1)..(1): n equals a,t,g, or c
  misc_feature (8)..(8): n equals a,t,g, or c
  misc_feature (15)..(15): n equals a,t,g, or c
nggggggnccccccntttttttttttttttttttttttttttcagttctactattatttatttttttaaatatttttgaaaaaatataatttttttacaatattttcaacttaaacactattcacactgaacacgtatggcagcttaacctacccaaatatgaagtttaagaagccaaaactgttctagctttgttaaaagttgtgctgcagactctcgtgatggttaacaaagcaaggaaaagcaccactcaaatcataatgttacagtatctttgttcagctggattatgggttggtattggtcatatgttagactccatacaggcatagctatgatgcagtgaatcccttagaagttacaattctcaaattacatacttcctcagatgtaacattagaactcaatatttctaacaataacataccagaaaaggctggactggcactcatctgctgactaacttgtagcctcagtaatatgacatacttgcctttaacaaattatctcaaattaactaacagaccttcagaaaatggagattctttttgatggggacataatcaaatttaagtctgagaaatatgcttaacagttggaactcaaattaaatgtactgattttaaagtttagacattaacaagtgatagattagcctcaaaaaaagacaatttggtaaggtttaggtcttttaatttggtgcttgttcacaacttgactggtgcttctttccttgctgtcttcacatcaagccatggggccaattctattttcagtaaatgtttgacagctttttacttagtaacagtctcagcacttttattaagcatgcaagactaacaaaaactttggcaatgcataagtgtaacacagtgacaagagagcttttacaattaagtcttctaatactgccttcacagtgtggaaattgtgctacatccaccaaaagagggccccgtctactcaaatatttccgtacttcaccccaggaacaaactcctttgcatttggattcagattgctcttgaccacaagatcttccagagaagagccatcactgataacaaggtcattaaactggtcttggatttggtccatagtttgtgggagatctcgagctggaataaaccattcatgctcttcttcctcttccagcatttcttggaaacagcgttcaataaattcttcttcccataactcctcttctatttgtctgttgaattcttcttcattttccatccacatgtactctgcaaatggattgtcatcttcatgagaatgaccgttaataatcacatcttcattgatgatgcttgggctagtactgctgcgacttggatctttcatggctgatgttggttgtcgtttttaacccaatgcacagcagcggggacggcagccaacgaatcctgtcggcctccgcggatctccacaggcagcgccgctcccccgctcgacgtgcgcttcgcccgccgcctcccttctcccggacgcgtgggcggacgcgtgggcggacgcgtggg

SEQ ID NO: 1954 - DNA, 1251 bp, Homo sapiens
gccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactgagcatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaaaaaaaaaaccccggggggggcccggtccccaattggccctatgg

SEQ ID NO: 1955 - DNA, 702 bp, Homo sapiens
  misc_feature (515)..(515): n equals a,t,g, or c
  misc_feature (614)..(614): n equals a,t,g, or c
  misc_feature (673)..(673): n equals a,t,g, or c
  misc_feature (677)..(677): n equals a,t,g, or c
gggacaatgaactccttctggtctaagttattggtgctgcccctgctggctccgctgtccatggcccgagcctctgcctgtcagagatggtagagccaccaggacatggagtcattgctgacacagggaaacatgagatgtcttaggtttggtgtatgtgaaacatgcatgagaaatagaggccaaaagttccactgtggagcgcagacagaatggtctgaatgctcttgcagttactacgtcagtagtttgtcatctaatatatattatacatctataacctatgtatttaccttattgtgataatactgttttgttttgttttttttctaattttgctttgtgcaaagccaaatccctttcagcagcattgagctaaaaaaaaaaaaaagtgcatgtttagggctgggcacggtggctcatgcctataatctcagtacttcgggaggccgaggcaggcggatcacaaggtcaggagttcgagaccagcctggccaatatggtgaaatcacgtntctactaaaaatacaaaaattagctgggcatggtggtgggtgcctatagtcccagctatgcgggaggctgaggcaggaaaaaccgcttgaaccctggangcggaaattcccagttgagccaagatcgcgccactgcactcccagcctggttgacagancganactcttgtctccaacaaccagcaac

SEQ ID NO: 1956 - DNA, 2722 bp, Homo sapiens
ggcacgagaggacatccccaaagaagacacaaaccctgacaactgcaaggttcgggctctggccttcaacaacaagaacaaggaactgggagcagtgtctctggatggctactttcatctctggaaggctgaaaatacactatctaagctcctctccaccaaactgccatattgccgtgagaatgtgtgtctggcttatggtagtgaatggtcagtttatgcagtgggctcccaagctcatgtctccttcttggatccacggcagccatcatacaacgtcaagtctgtctgttccagggagcgaggcagtggaatccggtcagtgagtttctacgagcacatcatcactgtgggaacagggcagggctccctgctgttctatgacatccgagctcagagatttctggaagagaggctctcagcttgttatgggtccaagcccagactagcaggggagaatctgaaactaaccactggcaaaggctggctgaatcatgatgaaacctggaggaattacttttcagacattgacttcttccccaatgctgtttacacccactgctacgactcgtctggaatgaaactctttgtggcaggaggccccctcccttcagggctccatggaaactatgctgggctctggagttaatgacaactccccaaatgcagagatttacactaacttccattctcagtttccttgtttcttttgattttttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttctttaagtgacacacattctcctgtctctggcttcttcaggctgaaatgacatagtctttctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccatggctttgaggagaatcctctctgccattcttccaatctccccagtgggttttgctattattttctaaattgggttaagtctaagaaggtgggggtgagcagggggtttatctgtgtgtagtgagtgcttcatgtgtggaatattcattttcttactgcagtgggacttggggttgaagccacccctcctactctgttggcttagccctgagatggtgacaggctggcctgcagtcagcatcattgtgcatgtgacagcatcaatgtgattagtaatttgtctgttcctcccttgaactgtctgtttagtctgaggtttttaaacttgcaggcagctgactgtgatgtccacttgttccctgatttttacacatcatgtcaaagataacagctgttcccacccaccagttcctctaagcacatactctgcttttctgtcaacatcccattttggggaaaggaaaagtcatatttattcctgcaccccagttttttaacttgttctcccagttgtccccctcttctctgggtgtaagaagggaaattggaaaaaaaattatatatatattctccttttaatggtggggggctactggagaggagagacagcaagtccaccctaacttgttacacagcacataccacaggttctggaattctcatcttcgaacctagagaaataggtgctataaacagggaattaagcaaaatgctggatgctatagatcttttaattgtcttaattttttttctattattaaactacaggctgtagatttcttagttctcacagaacttctatcattttaaactgacttgtatatttaaaaaaaaaatcttcagtaggatgttttgtactattgctagaccctcttctgtaatgggtaatgcgtttgattgtttgagattttctgtttttaaaaatgtagcacttgactttttgccaaggaaaaaaataaaaattattccagtgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1957 - DNA, 779 bp, Homo sapiens
ctgtccccagtgtttccaggtaatgacttggcactccagagaaagtttcatrctgttgcgtgtggtggctccaagccaagcacctggcatgcaggtcagcccttcccagcgggcgtggcgtcgtcctcttcacagatgccacgttgcagccccaaggcctcaccattttgcgttttttagaaacccattttcttggtcatttataaagctgctttatagatatctttgatcctggcatgccttggtttcctctcccttccctctttccaatcctggtttcctaacctcctcttgtagtaattctcaactcaactcaaagtcccaagaatttggaatggtaggatgctgtgcggggagctcgaggctgaggcataatcactgcttcggttctgctcatcaggggacacgctcccttactcatggcagccatgtttgattgtcacagagccccccgaatactctgtctatagtgacacactgtaggtgtcataaattttaagaaacctgcttttaagtactatttataggtttttctgttatacttgcaacctagttttaaaatacatgaggattttatgaaagctttatacagacatttataggaaactcattctttgattttaggtgccatttaaattgataacacttactttataaaaagatgctttttgtctggatagagccttatagtttaaaatatcttcatatattgccatttgatcaaataaatttcttacttagaaaaaaaaaaaaaaaaaaaaaaaaaaaaaaaaactcga

SEQ ID NO: 1958 - DNA, 1932 bp, Homo sapiens
  misc_feature (1624)..(1624): n equals a,t,g, or c
ggcacgagccaggcccctgggccgggcgctgaggcgggcccctctgggcagggcccgggcggggctgggtgggccgcccctgctgctgccgtccatgctgatgtttgcggtgatcgtggcctccagcgggctgctgctcatgatcgagcggggcatcctggccgaratgaagcccctgcccctgcacccgcccggccgcgarggcacagcctggcgcgggaaagcccccaagcctgggggcctgtccctcagggctggggacgcggacttgcaagtgcggcaggacgtccggaacaggaccctgcgggcggtgtgcggacagccaggcatgccccgggacccctgggacttgccggtggggcagcggcgcaccctgctgcgccamatcctcgtaagtgaccgttaccgcttcctctactgctacgtccccaaggtggcctgctctaactggaagcgggtgatgaaggtgctggcaggcgtcctggacagcgtggacgtccgcctcaagatggaccaccgcagtgacctggtgttcctggccgacctgcggcctgaggagattcgctaccgcctgcagcactactttaagttcctgtttgtgcgggagcccttggaacgcctcctctctgcctaccgcaacaagtttggcgagatccgagagtaccagcaacgctatggggctgagatagtgaggcggtacagggctggagcggggcccagccctgcaggcgacgatgtcacattccccgagttcctgagatacctggtggatgaggaccctgagcgcatgaatgagcattggatgcccgtgtaccacctgtgccagccttgtgccgtgcactatgactttgtgggctcctatgagaggctggaggctgatgcaaatcaggtgctggagtgggtacgggcaccacctcacgtccgatttccagctcgccaggcctggtaccggccagccagccccgaaagcctgcattaccacttgtgcagtgccccccgggccctgctgcaggatgtgctgcctaagtatatcctggayttytccctctttgcctacccactgcctaatgtcaccaaggaggcgtgtcagcagtgaccatgggtgtggggccagcagctggtggggactggtttcaacgccagctttctgtgcttctgcctgtcattcggagaaactctggctctggggcttggggcttctcaggatcctggatggcagagactgccctcagaarttccttgtccagggtgggcacccacagtgactcagaggacagggctaggcaggagacctgctgctcctcattggggggatctcttggggggcagacaccagtttgccaatgaagcaacacatctgatctaaagactggctccagaccccgggctgccaggattatgcagtccacttggtctaccttaatttaacctgtggccaaactcagagatggtaccagccaggggcaagcatgaccagagccagggaccctgtggctctgatcccccatttatccaccccatgtgcctcaggactagagtgagcaatcataccttataaatgacttttgtgcctttctgctccagtctcaaaatttcctacacctgccagttctttacatttttnccaaggaaaggaaaacggaagcagggttcttgcctggtagctccaggacccagctctgcaggcacccaaagaccctctgtgcccagcctcttccttgagttctcggaacctcctccctaattctcccttccttccccacaaggcmtttgaggttgtgactgtggctggtatatctggctgccatttttctgatgcatttatttaaaatttgtactttttgatagaacccttgtaagggctttgttttcctaatagctgactttttaataaagcagttttatataaaaaaaaaaaaaaaaaaaaaaaaa

SEQ ID NO: 1959 - DNA, 860 bp, Homo sapiens
  misc_feature (15)..(15): n equals a,t,g, or c
  misc_feature (27)..(27): n equals a,t,g, or c
acaaaagctggagcnccaccgcggtgncgaccgctctagaactagtggatcccccgggctgcaggaattcggcacgaggacaaaggcttgggaaatgaggggaggtggaggcagggcaggggaagcgaagagtcagccttggagagagcaccctggggcctccgtgtcggggtacacccagcactttgcgacctgcggcccagcaggcgcggaggatggcggggaggaagccagcagcccctgtgtttactgtcgtcagaaaggtcttgtgttttggttttggggtttttgttttgtttgtgttttgtttggcttgtttgttttttaaggggaaaaaagtttgtaattatttcatccaaatctcccgttatatatctgtgaataataagagattttataatagcaagaaaatgatgtatattttagtttgttgacaaataagtcatcatgatcacgaaggacactgagaaaaaataatttagaaccctggtttttgtgaawttttttgttttgtgtttctttgttttgagatttgtgtttggtttggtttttgcactgcactaaggcaggagggttggagggctgggtgcagcctgggagtccgatggttttcagcaggagacggggtgtcccctgcagggggctaaactgcaggggcctgagattagctgtgaacatgtgggagcccgatgcatgtgggtcagggatctgggggcccccccagctggcgggaaccccaaatggacacaaactgtacatttgccaatgggtttttttcagaccatggtttttacttgcaaataaacctgagttcttttctgcaaaaaaaaaaaaaaaaaaactgcggtccgcaagggaat

SEQ ID NO: 1960 - DNA, 575 bp, Homo sapiens
ggcacgagtgcaggaattcgtgtgccggatttggttagctgagcccaccgagaggcgcctgcaggatgaaagctctctgtctcctcctcctccctgtcctggggctgttggtgtctagcaagaccctgtgctccatggaagaagccatcaatgagaggatccaggaggtcgccggctccctaatatttagggcaataagcagcattggcctggagtgccagagcgtcacctccaggggggacctggctacttgcccccgaggcttcgccgtcaccggctgcacttgtggctccgcctgtggctcgtgggatgtgcgcgccgagaccacatgtcactgccagtgcgcgggcatggactggaccggagcgcgctgctgtcgtgtgcagccctgaggtcgcgcgcagcgcgtgcacagcgcgggcggaggcggctccaggtccggaggggttgcgggggagctggaaataaacctggagatgatgatgatgatgatgatggaaaaaaaaaaaaaaaaaaaaaaaaaaaaaaaaaaaaaaaaaaaaaaaaaaaaaaaaaaaaaaaaaaaaaaaaaaaaa

SEQ ID NO: 1961 - DNA, 1859 bp, Homo sapiens
cccccgggctgcaggaattcggcacgagtctcaacccattgccccttgagataactgtacatgtcactctgatcatggtaacagcatccctattgcttctgccagctgtcatggcaatcgtgtttcccatcacctgggcggttcagagccagtcatgggctgctgaatttaatggagcatgtttccaggttcttcatggcaaactgtactcatgacttaggagtgagtgttacttccatgtgcctgtcagcttgtgagggggaatgtggaggaaggtgagaaatacagctcccacagttgtgctcttcctagaggaagctctcagaacgcagccctcacgggatttccttaggtcagaggagagcatcgcatctcacgtttttaggtttatcactgccatcccacttctgggatgggaggtagcaagggcttctgtatttcctggtgtccatcctagcaacccaaacatttccggatcaaaccctgctggtctccactcactggaaattctgccaaatgccgatttgaaagctgcctgtccctgctttcagcaggagcggggagaaaaactccaatggtctttaatggtttctgcagctggccacggccaattcatatgacattgtgagtttgctttcttatagagctgctctggggagaggtttgctattgagatgtaacagtggagctgttgggtcttcatgaccctttgcgtgtgttccatgggactctctttctgggttccccatgcttatagttgcctcgtgtcacaagacagatactaatgtcaggtttgtggcttcctgatggtttgggtggggccccagtgtcctggtaatttataggactgcctcatctgggagcattgccttcttccttagtcccacgtggagtgaccagtcttcctccttgtagctgaacagggaggaaacttgcaccattacctgactgtggaagggtggcccacaagatgagctgtgcaccataaacacagcccacctctgatttgtcatgtggtaccatggtagtattaccaactaagcaagattgtgatcccagaaattggcttagcatgtgagtgttgcctcgtgagagtacaagtaatataactcgccatcttgcaggaagtgccaccccaatatagagcctgaagttggaatctgttgagatccttgggtggctgatatacagcctgggatctttctttttttttgttccttttcaaccacccataattttaatattattttttagtgtgtgtgtgcctggctttgcgctagatattgtagaaaacaaaaaaggtaaaagacgtaatatgtggcctaagggagcttttaggtgactgctacacatcaagcagaaaatcaaggactatctaaagacgtttatagtagataagatcagggtagaccagatggtctgggaaagttctgtgcctctgaggctttgggttgtagtcaatggcaggacagacagtgagatgaaaaacacatgagcaaaagcaaggaagcagaaatctgcatggcatgtactgaacagtgcacagccctgttagagcaacatggttaaagaatcctttccagtgcggttttctagatggaagcttcccagccaccgtgcccggcctgatgtttttgaatgattatgaaaatgggtatacagcattaaaaccttagactgattttaaatatattaatttcttttaaactcaatataatgttaatattactgtagcacttactagcatttctgaaggttggtcttgagataagattgaaaatgacagttgttgattttctgaggtaatatacccaaataaaatatatgtatgtgtacatgaaaaaaaaaaaaaaaaaaaa

SEQ ID NO: 1962 - DNA, 1672 bp, Homo sapiens
ggcacgagctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaaggttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaaccagaagtggaattccctggatgaaggccgtcaccttaccttaaaccttttaagcaaggaaattgaactaagaaatggagagttacagagtgattatacagaagatgcaacagatactaaacctgatagggatatcgagttagagctttcagcacttgatactgatgaacctgatggacaaagtgaaccaattgaagagatcttggacatacagcttggtatcagttctcaaaatgatcagttgctaaatggaatggcagtggaaaatgggcatccagtacagcagcaccaaaaggagccaccaaagcagaagaaacagagtttaggtgaagaccatgtgattctggaggagcaaaaaacaattctgccggtaacttcttgctttagccagccactcccagtgtctattagcaatgcaagttgcctccccatcaccacatctgtcagtgctggcaacctcattctgaaaactcatgttatgtctgaagataaaaacgactttttaaaacctgttgcaaatgggaagatggttaacagctgaaaggaggttcatctttcaaatttgtgaccacaccatggaagcatttacactagctttttatatatataatatatattatataatgtatattttttttaaaaaaaagatattactgggggcatccatttcctgtggactctttgatacttcaagccctcttgcattagcattatgaaaaaaaaaaaaaaaaaa

SEQ ID NO: 1963 - DNA, 1699 bp, Homo sapiens
  misc_feature (871)..(871): n equals a,t,g, or c
ctcgtgccgaattcggcacgagcgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggnttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtyagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgaaaaaaaaaaaaaaaaaaaaaaaaaaaaaaaaaaaaaaaaaaaaaaaaaaag

SEQ ID NO: 1964 - DNA, 737 bp, Homo sapiens
  misc_feature (736)..(736): n equals a,t,g, or c
gctgcgagaagacgacagaagggggagctcaccagcgccaccgtccccggcgaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaataaaaaaaaaaaaaaaaanc

SEQ ID NO: 1965 - DNA, 2715 bp, Homo sapiens
gccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagcttgaggctacagtgagccttgattgtgtcactgcactccagcttgggatgaacagagacccctgtctcgacgaaattaaacccaaaaaaacagaaacaaaaaaaagagacgccggggggaccataaaagaaaaaaaactaagaaaaaactgggagcacacacgaccacgggggccaaagaacggtaaaacatagacgaacacaag

SEQ ID NO: 1966 - DNA, 688 bp, Homo sapiens
  misc_feature (607)..(607): n equals a,t,g, or c
cccacgcgtccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggctttaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccantttcttccttccccagctccactaaattccctcctgccttaaaaaaaaaaaaaaaaaaaaaaaaaaaaaaaaaaaaaaaaa

SEQ ID NO: 1967 - DNA, 832 bp, Homo sapiens
aacccgctggcccaatggcagcgtcctacagtgtagcctccgcctcccgattgactggcctgcttggcaaggcaagtagcggcggcgcttcaagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcamcatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcctgcagcccctgctgcccaataaaaccactccgaccccaaaaaaaaaaaaaaaaaaaaaaaaaaaaaaaaaaaaaaaaaaaaaaagggcggcc

SEQ ID NO: 1968 - DNA, 866 bp, Homo sapiens
ttttagttcattattctcttctattaagagaaattcactgttaaaaaattgtttcccatttccgtatctgaaataatgactgtagttgaggtgatcttgccctgggtctgaaatcatacttccaaaccaaaaaggactttgaatacaaaacttttaagaaatcttgtatgaatacaagctatatctgaaaaattgtgttttataatattgatgcctagttttgccccaggccatctgcagtgtggttactatgcaaagaatgctggtgttgctgtttttttttttttctttgttggctattaacccagcggagacaatatgtggctatggtagtacttggaagttctagcattacacagactagcttccatttctctcatagaggtcattttggcatttaaaacacatacttttagaaaacagatttggatgtatgtaaacacagggttaatccaccacactctggatgctagagctgttgacaaagtcatgctttgcagattttaaaataaactttttgttactcttacagcttggtattttcccctcctattttttttacctcctctaaataaacctctttgttaaataattgatgtttctggatcatagaaaatagtaagtttaaaatacagaatatttccaagctaactacaaatctgatgacagttttttgagtgtgcacttttccttttatttcttaggtcctttttggtcctttgcaaacatagtaagattccatatttgtgtcccaactgtggtaatattgctgacttcttactggaaaacagtcagctctaggtagcatttcttctgtgtggtatttaagttaaattattaccaaaaaaaaaaaaaaaagggcggcc

SEQ ID NO: 1969 - DNA, 437 bp, Homo sapiens
gcttccggacgccaacatccgggccgcgcggggaaggggagacgtggggtagagtgaccatgacgaaattagcgcagtggctttggggactagcgatcctgggctccacctgggtggccctgaccacgggagccttgggcctggagctgcccttgtcctgccaggaagtcctgtggccactgcccgcctacttgctggtgtccgccggctgctatgccctgggcactgtgggctatcgtgtggccacttttcatgactgcgaggacgccgcacgcgagctgcagagccagatacaggaggcccgagccgacttagcccgcaggggstgcgcttctgacagcctaaccccattcctgtgcggacagcccttcctcccatttcccattaaagagccagtttattttctaaaaaaaaaaaaaaaaaaaaaaaaaaaaaaa

SEQ ID NO: 1970 - DNA, 684 bp, Homo sapiens
ctctttggctgtgtctacctccttcatctgctgcgccgacataagcaccgccctgcccctaggctccagccgtcccgcaccagcccccaggcaccgagagcacgagcatgggcaccaagccaggcctcccaggctgctctycacgtcccttatgccactatcaacaccagctgcygcccagctactttggacacagctcacccccatggggggccgtcctggtgggcgtcactccccacccacgctgcacaccggccccagggccctgccgcctgggcctccacacccatccctgcacgtggcagctttgtctctgttgagaatggactctacgctcaggcaggggagargcctcctcacactggtcccggcctcactcttttccctgaccctcgggggcccagggccatggaaggacccttaggagttcgatgagagagaccatgaggccactgggctttccccctcccaggcctcctgggtgtcatccccttactttaattcttgggcctccaataagtgtcccataggtgtctggccaggcccacctgctgcggatgtggtctgtgtgcgtgtgtgggcacaggtgtgagtgtgtgagtgacagttaccccatttcagtcatttcctgctgcaactaagtcagcaacacagtttctctgaaaaaaaaaaaaaaaaaaaaac

SEQ ID NO: 1971 - DNA, 1169 bp, Homo sapiens
ggaattcggcacgagtcgtccagcccgcggcgagagcgggtatgtgggcgggaggccggagcagctgtcaggctgaagtcctgcgagcgacgcgcggcggggcggcgagaggaaacgcggcgccgggccgggccctggagatggtccccggcgccgcgggctggtgttgtctcgtgctctggctccccgcgtgcgtcgcggcccacggcttccgtatccatgattatttgtactttcaagtgctgagtcctggggacattcgatacatcttcacagccacacctgccaaggactttggtggtatctttcacacaaggtatgagcagattcaccttgtccccgctgaacctccagaggcctgcggggaactcagcaacggtttcttcatccaggaccagattgctctggtggagagggggggctgctccttcctctccaagactcgggtggtccaggagcacggcgggcgggcggtgatcatctctgacaacgcagttgacaatgacagcttctacgtggagatgatccaggacagtacccagcgcacagctgacatccccgccctcttcctgctcggccgagacggctacatgatccgccgctctctggaacagcatgggctgccatgggccatcatttccatcccagtcaatgtcaccagcatccccacctttgagctgctgcaaccgccctggaccttctgggagaagagcctgtcccacattccagccataagtgactctgagctgggaaggggaaacccaggaattttgctacttggaatttggagatagcatctggggacaagtggagccaggtagaggaaaagggtttgggcgttgctaggctgaaagggaagccacaccactggccttcccttccccagggcccccaagggtgtctcatgctacaagaagaggcaagagacaggccccagggcttctggctagaacccgaaacaaaaggagctgaaggcaggtggcctgagagccatctgtgacctgtcacactcacctggctccagcctcccctacccagggtctctgcacagtgaccttcacagcagttgttggagtggtttaaagagctggtgtttggggactcaataaaccctcactgactttttagcaataaagcttctcatcagggttaaaaaaaaaaaaaaaaaa

SEQ ID NO: 1972 - DNA, 1571 bp, Homo sapiens
cttcctagctccctctctttctctcctccctctgccttcccagtgcataaagtctctgtcgctcccggaacttgttggcaatgcctattttttggctttcccccgcgttctctaaactaactatttaaaggtctgcggtcgcaaatggtttgactaaacgtaggatgggacttaagttgaacggcagatatatttcactgatcctcgcggtgcaaatagcgtatctggtgcaggccgtgagagcagcgggcaagtgcgatgcggtcttcaagggcttttcggactgtttgctcaagctgggcgacagcatggccaactacccgcaggcctggacgacaagacgaacatcaagaccgtgtgcacatactgggaggatttccacagctgcacggtcacagcccttacggattgccaggaaggggcgaaagatatgtgggataaactgagaaaagaatccaaaaacctcaacatccaaggcagcttattcgaactctgcggcagcggcaacggggcggcggggtccctgctcccggcgttcccggtgctcctggtgtctctctcggcagctttagcgacctggctttccttctgagcgtggggccagctccccccgcgcgcccacccacactcactccatgctcccggaaatcgagaggaagatccattagttctttggggacgttgtgattctctgtgatgctgaaaacactcatataggattgtgggaaatcctgattctcttttttatttcgtttgatttcttgtgttttatttgccaaatgttaccaatcagtgagcaagcaagcacagccaaaatcggacctcagctttagtccgtcttcacacacaaataagaaaacggcaaacccaccccattttttaattttattattattaattttttttgttggcaaaagaatctcaggaacggccctgggccacctactatattaatcatgctagtaacatgaaaaatgatgggctcctcctaataggaaggcgaggagaggagaaggccaggggaatgaattcaagagagatgtccacggacgaaacatacggtgaataattcacgctcacgtcgttcttccacagtatcttgttttgatcatttccactgcacatttctcctcaagaaaagcgaaaggacagactgttggctttgtgtttggaggataggagggagagagggaaggggctgaggaaatctctggggtaagagtaaaggcttccagaagacatgctgctatggtcactgaggggttagctttatctgctgttgttgatgcatccgtccaagttcactgcctttattttccctcctccctcttgttttagctgttacacacacagtaatacctgaatatccaacggtatagatcacaagggggggatgttaaatgttaatctaaaatatagctaaaaaaagattttgacataaaagagccttgattttaaaaaaaaagagagagagatgtaatttaaaaagtttattataaattaaattcagcaaaaaaagatttgctacaaagtatagagaagtataaaataaaagttattgtttgaaaaaa

SEQ ID NO: 1973 - DNA, 704 bp, Homo sapiens
aagatggtggcgcccagagcttcgctctatgctgctcccctgagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttaaaaaaaaaaaaaaaaaaaaaaaaaaaaaaaaaaaa

SEQ ID NO: 1974 - DNA, 1774 bp, Homo sapiens
ggcacgagcaccggccggcatggaggagcgcggcgattccgagccgacccccggctgcagcggcctgggtccgggcggtgttcgcggctttggcgacggcggtggagctccttcgtgggcccctgaggacgcctggatgggcactcaccctaagtatctagaaatgatggaattagatataggagatgccacccaagtttatgtagcgttcttggtttacctggacctcatggaaagcaaaagctggcatgaagtaaactgtgtaggattaccagaactccagctcatctgccttgttggtactgagatagaaggggaggggttacagactgtggtgcctacccccatcactgcttccctcagccataacagaatatttctcttagaagatgacatccatgtttcctgatgcttgttttattcatacaagattggatttgagacccatcagactgcttcatcttttatctcagaaatagggttgacgtacatagtgagggttgacttccccattccataaggttttcattctgaagagtaaaacttccccaggtagaagactttctccttcttaaaaaatatagggtgatttctttaaaactttgttatctagagacagtttaattacagttatatacaggtttatgcctaggatgtattcagatgggtgggacctgtgtgctgcttttgtcatcccacactcaaagttgtctctttgtttcttgctgccactgccagctcattgttgagactgccatttctttctcttactcagctctccccagtgccttttggccactgcagctaccgtagaatggcattttatatgtaccttgtcacccacttctgtttactttttcctctccagtaaaaagtaaaagatttctttcaattggtcttcccattgcagttactgttatttctcttttttggttaactttaaatcaaaactcaaaatatgttcatccagagtgtgtcttaagtaacttacgtgtcttaagtaacagggaccagagacatgttacctacaagagttctgggctatccttttcattcttatcacatatcatagcttgaatattacaacagtgtgggagagaatcaaccgtaaaaatgtcttcattaattagacccagttattccacttttgttaatgtctctcaaattgtacaaagtataaaaaattatatgcacaaagatgttccaagtgacattacttttagtagcccaaattataaaccactttaaagtttggggtaaagattggcaaactttttctataaagggccagaaagtaactattttaggtttttaaacctactgtctctgtcataacttgtcaacactgctgtatgaagcacaaaagcagccatagacaatacataaacaatacgggcgtggctttgttccagtaaaactttgtttacaaatgtggtgccatagtttgtcatccctgggtctaggaaatagtcaataaacagatatatacaaatgatacataatgtacttattaaaaattagtaatgaatattattaaaaacatgaaaatattaccttaagtaaaaattgcaagacggaaaagtgtataagtgggtgtaatcatggctgaaataacagaccaagcatatgataaaaagataacaaagtaaatcaaattactaactggttatagtgggataggaggcagaaaatggatgactttgtcttttctcaatgtttttatttgtattttataataaaaatgttttaaaattaaaaaaaaaaaaaaaaaaaa

SEQ ID NO: 1975 - DNA, 568 bp, Homo sapiens
ggcacgagagtatattcaccatttagaagtgatccagcaaagattgggaggggtactaccagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaaaaaaaaaaaaaaaaaaaaaaaa

SEQ ID NO: 1976 - DNA, 1132 bp, Homo sapiens
  misc_feature (153)..(153): n equals a,t,g, or c
  misc_feature (260)..(260): n equals a,t,g, or c
ctgaagccggtgctgctgggccttcgagatgcgccggtgcacgcagccccacagggccgggtkcctggactgctagcaagctgggcggcattccggatgctctgcccaccgtggctgcgccaggcccgtgtgtcagcgctgcggcagccgctncgctctggtcgtgcaggtgtattgcccgctggaaggctccccgtttcaccgtctgctgcacgtgttcgcgtgcgcctgccccggctgtagcaccggcggtcgcgcantggaaggtgttccgctcccagtgcctgcaggtgccagagagagaggcgcaggacgctcagaaacagggaaacagccttgcagctgaggactggtgtgaaggtgctgatgactggggaagtgatactgaggaggggccttcaccacagtttaccttggattttgggaatratgccagcagtgccaaaracgtagactggactgctcggytccaagacctccgcctgcaggatgctgtcctgggtgctgcccatcctgtgcctcctgggctgccgctcttcctgccctactacatctgtgttgcagatgaggatgattacagggactttgtcaacctggatcatgcccacagccttctgagggactatcagcagagagaaggcattgccatggatcagttgctttcccaaagccttcctaatgatggtgatgaaaaatatgagaagaccataattaaaagtggagatcagacgttttacaaattcatgaagcgaattgctgcttgtcaggagcagattttgaggtattcctggagtggagagccactctttttgacctgccctacatcagaagtcaccgagctcccagcctgcagccagtgtggaggccaaaggatatttgagtttcagcttatgccagcactggtcagcatgctcaagagtgctaatttaggtctttctgtggaatttggaacaattctagtttacacatgtgagaagagttgctggcccccaaatcatcagactcccatggaagaattttgtattatacaagaagacccagatgaattattgtttaagtagagcatttccttttattaatataaattaaaacaaatgtttacatccaaaaaaaaaaaaaaaaaaaaactcga

SEQ ID NO: 1977 - DNA, 971 bp, Homo sapiens
ctagcccgggcggatcccccgggctgcaggcgccgaggctggaggccgagctctgcagagttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaakaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttgggaaatgccctgtactctgtggggatgacggyagtgggcctggccatcctgtggtatgttttccgtctggccgggatgactggaggcaccgccggcgatggacgtccaggtcccggctcctgtgctggaaagcgttgatggggagcgtcggcgctgaccacackcgggagctgcggaagcccagcggttcacacaggcctcccttcaacgtagtcatcccctggtggtggaagcaagacgacggcccctgacgtgcagccacacacagaaaaggctgctgtgaaacattttaatgcttcgactttttttttcttccagcctggagcaacaagagcaaaactcc

SEQ ID NO: 1978 - DNA, 749 bp, Homo sapiens
aaagatggctgcgccaggtaatttgagcaaaggccacagtgaactccggcgtggctgaggaaggaggaggcacccacaggctgctgggaggagagcataaggctcaaaatggaaaatcataaatccaataataaggaaaacataacaattgttgatatatccagaaaaattaaccagcttccagaagcagaaaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaacaraaaaaaaaaaa

SEQ ID NO: 1979 - DNA, 736 bp, Homo sapiens
  misc_feature (701)..(701): n equals a,t,g, or c
  misc_feature (728)..(728): n equals a,t,g, or c
  misc_feature (733)..(733): n equals a,t,g, or c
aagtgagttaaggacgtactcgtcttggtgagagcgtgactgctgagatttgggagtctgcgctaggcccgcttggagttctgagccgatggaagagttcactcatgtttgcacccgcggtgatgcgtgcttttcgcaagaacaagactctcggctatggagtccccatgttgttgctgattgttggaggttcttttggtcttcgtgagttttctcaaatccgatatgatgctgtgaagagtaaaatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaatactattaactggacttcctaatatatacttctatcaagtggaaaggaaattccaggcccatggaaacttggatatgggtaatttgatgacaaataatcttcactaaaggtcatgtacaggtttttatacttcccagctattccatctgtggatgaaagtaacaatgttggccacgtatattttacacctcgaaataaaaaatgtgaatactgctccaaaaaaaaaaaaagtnggcgagctttccctaggggggtaattngctgntgc

SEQ ID NO: 1980 - DNA, 1257 bp, Homo sapiens
cggctgtttggctgctgacaacatgaagacttcctgcgatgagaacagaggcacaggtgccggccctacagcccccagaacctggactggagggggccatggggcaccggaccctggtcctgccctgggtgctgctgaccttgtgtgtcactgcggggaccccggaggtgtgggttcaagttcggatggaggccaccgagctctcgtccttcaccatccgttgtgggttcctggggtctggctccatctccctggtgactgtgagctgggggggccccgacggtgctggggggaccacgctggctgtgttgcacccagaacgtggcatccggcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccagggctctctgccccgccgactcctgcccccattctgcgggcagacctggccgggatcttgggggtctcaggagtcctcctctttggctgtgtctacctccttcatctgctgcgccgacataagcaccgccctgcccctaggctccagccgtcccgcaccagcccccaggcaccgagagcacgagcatgggcaccaagccaggcctcccaggctgctcttcacgtcccttatgccactatcaacaccagctgccgcccagctactttggacacagctcacccccatggggggccgtcctggtgggcgtcactccccacccacgctgcacaccggccccagggccctgccgcctgggcctccacacccatccctgcacgtggcagctttgtctctgttgagaatggactctacgctcaggcaggggagaggcctcctcacactggtcccggcctcactcttttccctgaccctcgggggcccagggccatggaaggacccttaggagttcgatgagagagaccatgaggccactgggctttccccctcccaggcctcctgggtgtcatccccttactttaattcttgggcctccaataagtgtcccataggtgtctggccaggcccacctgctgcggatgtggtctgtgtgcgtgtgtgggcacaggtgtgagtgtgtgagtgacagttaccccatttcagtcatttcctgctgcaactaagtcagcaacacagtttctctgaaaaaaaaaag

SEQ ID NO: 1981 - DNA, 1660 bp, Homo sapiens
ccacgcgtccggcgcgaggagcagccgctgccgccgctcggggtcgcctggagccccagattcccgagcgctcggctcgcatggcagccgcttcggcgcccggccccgcggccagctaggggcggccccgcgctccctcacggcccctcggcggcgcccgtcggatccggcctctctctgcgccccggggcgcgccacctccccgccggaggtgtccacgcgtccggccgtccatccgtccgtccctcctggggccggcgctgaccatgcccagcggctgccgctgcctgcatctcgtgtgcctgttgtgcattctgggggctcccggtcagcctgtccgagccgatgactgcagctcccactgtgacctggcccacggctgctgtgcacctgacggctcctgcaggtgtgacccgggctgggaggggctgcactgtgagcgctgtgtgaggatgcctggctgccagcacggtacctgccaccagccatggcagtgcatctgccacagtggctgggcaggcaagttctgtgacaaagatgaacatatctgtaccacgcagtccccctgccagaatggaggccagtgcatgtatgacgggggcggtgagtaccattgtgtgtgcttaccaggcttccatgggcgtgactgcgagcgcaaggctggaccctgtgaacaggcaggctccccatgccgcaatggcgggcagtgccaggacgaccagggctttgctctcaacttcacgtgccgctgcttggtgggctttgtgggtgcccgctgtgaggtaaatgtggatgactgcctgatgcggccttgtgctaacggtgccacctgccttgacggcataaaccgcttctcctgcctctgtcctgagggctttgctggacgcttctgcaccatcaacctggatgactgtgccagccgcccatgccagagaggggcccgctgtcgggaccgtgtccacgacttcgactgcctctgccccagtggctatggtggcaagacctgtgagcttgtcttacctgtcccagaccccccaaccacagtggacacccctctagggcccacctcagctgtagtggtacctgccacggggccagccccccacagcgcaggggctggtctgctgcggatctcagtgaaggaggtggtgcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccccctgagcctggaaagaccacagcactgtgatggaggtgggggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgcaaaaaaaaaaaaaaaaaaaaaaaaaaaaaaaaaaaaaaaaaaaaaaaaaaaaaaaaa

SEQ ID NO: 1982 - DNA, 983 bp, Homo sapiens
ccgcccgcctgccggccccggtccggaattcccgggtcgacccacgcgtccggggcaagtgagcgagctccttcctcaccgggctgactagcctctcctttccctgtccccctccatcgctgctctgcaggaagccagcccccagggccagtcccggagsggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaaggtcccacatttgaccaaggagtgcctggtagcgttgagatgtgggagagaatgcactaatctgaaggcagccctgcgtcaggaattcagcaacctggaagagattcttgagtatcagaacaccaccttctttggtggaacctgtatatccatgattgattacctcctctggccctggtttgagcggctggatgtgtatgggatactggactgtgtgagccacackccagcctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacaggaaaaaaaaaaaaaaaaaaagggcggccgc

SEQ ID NO: 1983 - DNA, 1697 bp, Homo sapiens
  misc_feature (1404)..(1404): n equals a,t,g, or c
ggaattcccgggtcgacccacgcgtccgggcgacttgcatcgtcttcaacatgaagatagccacagtgtcagtgcttctgcccttggctctttgcctcatacaagatgctgccagtaagaatgaagatcaggaaatgtgccatgaatttcaggcatttatgaaaaatggaaaactgttctgtccccaggataagaaattttttcaaagtcttgatggaataatgttcatcaataaatgtgccacgtgcaaaatgatactggaaaaagaagcaaaatcacagaagagggccaggcatttagcaagagctcccaaggctactgccccaacagagctgaattgtgatgattttaaaaaaggagaaagagatggggattttatctgtcctgattattatgaagctgtttgtggcacagatgggaaaacatatgacaacagatgtgcactgtgtgctgagaatgcgaaaaccgggtcccaaattggtgtaaaaagtgaaggggaatgtaagagcagtaatccagagcaggatgtatgcagtgcttttcggccctttgttagagatggaagacttggatgcacaagggaaaatgatcctgttcttggtcctgatgggaagacgcatggcaataagtgtgcaatgtgtgctgagctgtttttaaaagaagctgaaaatgccaagcgagagggtgaaactagaattcgacgaaatgctgaaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcagcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatgaccctattcgtggtccagatgggaaaatgcatggcaacttgtgttccatgtgtcaagcctacttccaagcagaaaatgaagaaaagaaaaaggctgaagcacgagctagaaacaaaagagaatctggaaaagcaacctcatatgcagagctttgcagtgaatatcgaaagcttgtgaggaacggaaaacttgcttgcaccagagagaacaatcctatccagggcccagatgggaaagtgcatggcaacacctgctccatgtgtgaggtcttcttccaagcagaagaagaagaaaagaaaaagaaggaaggtaaatcaagaaacaaaagacaatctaagagtacagcttcctttgttgagttgtgtagtgaataccgcaaatccaggaaaaacggacggcttttttgcnccagagagaatgaccccatccagggcccagatggaaaaatgcatggcaacacctgctccatgtgtgaggccttctttcaacaagaagaaagagcaagagcaaaggctaaaagagaagctgcaaaggaaatctgcagtgaatttcgggaccaagtgaggaatggaacacttatatgcaccagggagcataatcctgtccgtggcccagatggcaaaatgcatggaaacaagtgtgccatgtgtgccagtgtgttcaaacttgaaaaaaaaaaaaaaaaaaaaaaaaaaaaaaaa

SEQ ID NO: 1984 - DNA, 2437 bp, Homo sapiens
aattcccgggtcgacccacgcgtccgcccacgcgtccgagtgggctgcttggacacgcgtgtgcatgtgcacgcatgctggtgtgcatgctgggctgcctggcaaatctggtggtggtgggattcctcaaggagaaaacattccctcttgcaatggcaagaactaggggcagttctctgtccctcctcccaacccctcctttcccctgcccttgtcctgatgcctcaaggcttagagagaaacattgtatccagaccgagggctctgctgcttctttccagaaagtgattggcaaggctttggagagaagagcagttctgcagctggccttgttccttcatcatcccccttccttgtgcattatgcacttgctgctgcctcctgggctctgatagaagggcagggctgttgagcctggatgggtggaggcttaggtagccggacctgcctgccaccctcctctcccactcaggcacaatggtgcctaaagtgtttccaatctctgggacctctgtacccaaactgaaactctaaattggggccctaactaattttccttttgaggttgtgggcataagtgctgatctagaatacagtctgggtcccacactgtgtctcagtgagactgttgatgccttgagatgaccatttcagatctgaatcccatgggtgtgagggtgatgggtactccaggactggcctatgctgtgttgtgggctttggttcggctttatcaggggccaggcatatgggttctagagtacctaccatgacctagaagcatttatgatttatttgaagccacactgtttgcatgggtgttacttgtctgtacctcagagtctgaggatgttaactttggaactcgcagtcctctagaacagcttcagattatggctttttcttttgaggaagaaattattcactccagatgcatgccctgagccagacctcactgctgcactttccaaggtgctaagattgctgctctccaatgctaactttctgacacagtgctctagaaccctgcctgtggtcctgagcactgatcagcttagctagaccatggttgactcttcttggagattttcacttggtcctagaatgtggcaacgtagttgtgctcgccagaacgtgggaccaaattggcctcaggtgttgagtccagacttctgcttttgagagagggctgcactttttcatggtatttctaggggaggtggtaggctgcatgtgccacttggtcttgttgtgagtatgctgacaccagaaactcagagccagcttgtggcaagcagttggggtggggggtctctgacttgctcaggacaaactaggccagtggttttcaaactgcttggcagagccctgaagtttcctaggggttgcctcaggagtccttggggagatgaagggggtggggagctgagcaggctgggcaatttgccctcaaacagaacagctccccttgtagctgtcttacatattggggttcagggtaagattttatttgcattaaggggtttgctgctgaaaaaaagttggaaaaccactgactagaccatcggctccaaattggagtctgtgcttccttccccaggtatggagcacactcttcaccctaccctctaccacaggacacatatccctgttagcattccccgggacctttagccaagaggagctgcagggaccatggccaggttaccaaaatgccctgctctgaagccttgacacctgggtggaaagagaggctgttttctgaaagggtaaagggcttggtctggattcccagaagcatagcttagatgggaccacagtgggcaattttgacctgtcctgcccttcttagcttgaagggaaaccccagagactcttctgtcagggaaaactagggactctcttctagagccatatagttccttgggattagctcttggccaagaaggctgagtatggttcccaatttttaaatccatttcattttttaaaaaataagggaaataaatgtaattgccatttttcaaagattaagtaggaggagaggggtttcttgctctccagagcccaaagggacaaatagggactttgtttaggccaaggaaggagcggaagtagggcaactcggtcctgcgattattaatcccactccccacttattctagggcacacaaacactattttacttttttaaaatcataaaacggcagaacagatttggttagtttagaagaaaagaaagctctataaatataaatctatattcctgtatttttatttaataatttataaataccaagttcatttgacttttatttttgtgtaatatgtaatgatcgtattaaaaacaataaataaagcccagaagtttaatgagaaggaaaaaaaaaaaaaaaaaaaaaaaaaaaaaaaaaaaaaaaaaaaaaaaaaaaaaaaa

SEQ ID NO: 1985 - DNA, 1921 bp, Homo sapiens
cgcccggcgccgggcgcccgaagccgggagccgccgccatgggggcctgcctgggagcctgctccctgctcagctgcgcgtcctgcctctgcggctctgccccctgcatcctgtgcagctgctgccccgccagccgcaamtccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggccycaccgtgggtgccttctacatccctgacggctccttcaccaacatctggttctacttcggcgtcgtgggctccttcctcttcatcctcatccagctggtgctgctcatygactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcggtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccscttcctggacttcgtgccttactgagtctctaagactttttctaataaacaagccagtgcgtgtacaaaaaaaaaaaaaaaaaaaaaaaaaaaaaaaaaaa

SEQ ID NO: 1986 - DNA, 2666 bp, Homo sapiens
ccacgcgtccgccaatgttgaaagacttttcaaatctattgttggtggtactctgtgactatgttcttggagaagctgaatatcttctcttgagagagccaggccatgtagcactaagcaacgacacagtgtatgtggatttccagtattttgatggtgctaatgggacactgaggaatgtatctgtcctgctgttggaggccaacaccaatcagactgtaactaccaagtacctcctgaccaaccagtcccagggaacactaaagtttgagtgcttctatttcaaggaggctggtgactactggttcacaatgactccagaagcaacagacaacagcactccattcccctggtgggagaaaagtgcctttctgaaggtggaatggcctgtctttcacgttgacttgaataggagtgccaaggcagcagaaggcaccttccaagtgggcctatttaccagtcaaccactgtgcccgtttcctgtggacaagcccaacattgtagtggatgtcatcttcaccaacagtcttcctgaggcaagaagaaattcaagacagccgctggaaataagaaccagcaaaaggacagaacttgctcaaggtcagtgggttgagtttggctgtgcacccttggggccagaagcctatgtcaccgtggtgctgaagctgcttgggcgagactcagtcattacctccacaggacccattgacctggcccagaaatttggatacaaactggtgatggtgccagaactcacatgtgagtccggggtagaggtgacagtgctgcctccaccatgcaccttcgtccaaggagtggtcactgtcttcaaggaggcccccagataccctgggaagaggaccattcacttggctgaaaacagcctgccctgggagagaggaggacaatttttaactgtactttgtttgacatggggaagaataagtactgctttgactttggcatttcaagcagaagccatttttctgcaaaggaggagtgcatgctaattcagagaaatacagctttccagccatccagcccatctcctcttcagccccagggtccagtgaagtccaacaacatcgtgactgtcactggtatatccttgtgcttgttcatcatcattgccactgtgctcatcacgctgtggaggaggttcggccggccagccaagtgcagcacacctgctcgacacaactccatccactcccccagcttccggaagaactcggacgaggagaatatctgcgagctgagcgagcagcgcgggagcttctcggatgggggagacgggcccacggggagtccaggggacacaggcatccctctgacctacaggcggagcgggccggtacctcccgaggatgatgcctctggcagcgagagcttccagtccaacgcccagaagataatcccacctctgttcagctaccgccttgcccagcagcagttaaaggagatgaaaaagaaaggtctgacggaaactaccaaagtgtatcacgtgtctcagagtcccctgacagacactgccattgatgcggcccccagcgctcccttagatttggaaagcccggaagaagctgcagcaaacaagttccggatcaaatccccatttccggagcagcccgcggtcagtgccggggaaaggcctccctccaggctggatctaaatgtgactcaggccagttgtgccataagccccagccagactctgatccgcaagtcacaggcaaggcacgtgggcagcagagggggcccgtccgaaaggagccatgccaggaacgcccatttcaggaggacagcgagtttccatgaagccaggcaggcccggccgttccgagagaggagcatgtccactctgactccacggcaggcccctgcctacagctctaggacgcggacctgcgagcaggcagaggacagatttaggcctcagagtcgaggtgcccacctgtttcctgaaaaactggagcatttccaagaggcaagtggaacccgtggtccattaaaccctctccctaaatcctacactttggggcagcccttgaggaaaccagaccttggggatcaccaggcaggattagtggccggaattgagagaacagagccccacagagctcgtcggggaccgtcccccagtcacaagagtgtctcaaggaagcagtcttctcccatatcccccaaagataactaccagagggtcagttctctgagcccttctcagtgtagaaaagacaagtgtcaaagcttccccactcaccctgagtttgccttctatgacaatacgtcgtttggcctcactgaggctgagcagaggatgctggacctcccaggatattttgggtcaaatgaagaggatgaaaccacaagtacacttagcgtggagaagctggtgatctagactgagaatcagcctgagctttacacagctggggtctgctactcgcgttttgtagacttttgtgtaactatttgtaccgtaggacagaatgtgaggaggaagtaacacacagaggaggatgtgtgtgtatgcatgtgtttgaattcacaaggaagaaattatttatcttgagctttttcctttgttattcaatttctattgatttattagtaataacaatgataataaaatgtaaatgagcaaaaaaaaaaaaaaaaaaagg

SEQ ID NO: 1987 - DNA, 1681 bp, Homo sapiens
tctctgggccaatatggcagcgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaaaaaaaaaaaaaaaaa

SEQ ID NO: 1988 - DNA, 916 bp, Homo sapiens
  misc_feature (499)..(499): n equals a,t,g, or c
gagcaaaaccacactgaaatgcatcccactccaggagaggaattcttagcgtaacactctaaataaatggaaggaatcatcaccttccttattttacccctgccttgttcaccaggctgcccagtgcttaccatgcagaaagcagtcagctgtactctggaagtttctgttcttctttcctggggcttaggatattctgggagctgtctgagccttgtgcctaaggcttatcaggtgatataatcttcctgttctgggctgcttgctggaggaataggaagtgacatttataagacacaggcggtgtgagcatccatgtgtggtcttggtctaaaccagctcttgaacaggttaaagcaaacagcaataacaaaacaaaaactactgatgctgagcgttttgatcctagtaatatttcaaatattgtccttctgcatatgtyctatccatattgattccaatatmcattataagcttcttgggtactawtttgctgggnctcttscgtgaargtggtacctgtctcatgatccttaaaagagagaggyttttttcatccaaagctgtagtgttgggaactggggtgggagaggcactttttggaattctgaaagaatcatatctgtgtatatacatactgagtggggaaggatgggggttggcaggggttgagggaggtgggaacaaacagtgagtatgggaacaggcagtcacctcgagtgtgggaggtcacctgggtccgtcgtcttccttctgtatggtgttgggtttatgtacacactataacacttcctgtgtgagttcatgtacctgtctgtgagtgctttggtgtattgagcctcagtacactccaagggcattaaagtcaagaactagaaaaaaaaaaaaaaaaaaaaaaaaaaaaaagggcggccgc

SEQ ID NO: 1989 - DNA, 1585 bp, Homo sapiens
  misc_feature (904)..(904): n equals a,t,g, or c
gggttgctgttggggtgtgtcgrgaggacgtcatgggaattactgatcgttcaaaaatgtccccagatgtgggcatctgggcgatttattggagtgctgctggctattggcccttgataggcttccctggaactccsacccagcaagagccagctctccaccgagtgggggtttacctggatcgtgggactgggaatgtctccttctacagcgctgtggacggagtgcacctgcacaccttttcttgttcttctgtctcacgcctccggccattttttttggttgagtccattagcatctttagtcattccaccagtgactgataggaaatgaggcttttcttcccctgaccaaaactccttccctgtagtccagctgagggacacacatccctgggccctcttctgcccttcatgtctctatcctggatggtccatcttctgggtctccctaacggtaccgtttggtatctgccctttgtgtgcttcacaagaggcagtcccatgggaggtgggtctggccaatggagatgggacaggaaattttccaagacgcttttgggaaatctttttgtagcttttaaagagatgtgcggggaagacatatggatgttagcagccatattggaactgagaacacaggaatggtggaaaggtagaagaaacagagtttttgttgccgttgtgaaattgttgaaatttccttcatgccaagcttcttgttatatgagataattacgcccttattgtataagacaattttagttgtatttggttacttgcagcctgaagtaccgtaactrcactaaagggacgtagtgtgaacatcccgcagtataggcttaagtcacttttgtgaaatttgacaaaggcatagatctttttctatccagtcaggcattgcntattctttccagtaactactgattcccccacttttctgtcttagaaaattgtgggaatcccccctcactctgcctatgttgcactctctctcctcccaaccataactctgccctcagctattaactgtgctgtgtatttatcaagttggtatgttgtatgtacagtgttattcatgtcatcatgagaatgttgaacgcttgttaaatatcttttgctagcctcttcatatgctgttgcatatgactctcatcacaactcagtgagatggaaagtcaaatcctatttgtacaaatgagaaaactgaactctttagagtaactagctcagtattggccagctggtaaatggcagtgttgggattaaaatccagttcttatctactctccctttattcagaagcatttattggatgttgatctttgtttcaggttttgattttgttacttttttatactgtgtatattttcctcagtctacccttctgctctagattgtctggactcaggagattgtggcagttactggatagttatttttaagataatgattgcttttctctgtttatataagtcatgtgtacttattgtagaaagtttgtaagatgcaaaaagtataaaaattaaagttatgcactactaaaaaaaaaaaaaaaaaaaaaaaaaaaaaaaaagggcggccgc

SEQ ID NO: 1990 - DNA, 2064 bp, Homo sapiens
  misc_feature (2001)..(2001): n equals a,t,g, or c
  misc_feature (2024)..(2024): n equals a,t,g, or c
  misc_feature (2049)..(2049): n equals a,t,g, or c
atgggcgaggctgcggggccccggcgcgcacgcccgcacctctccccagccctggcgtgggcccagcccggcccaggcagcaatggggttcctgcagctgctggtcgtarcggtgctggyatccgaacaccgggtggctggtgcagccgaggtcttcgggaattccagcgarggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatncaaaaaggggagccagccagacnggggggccaacccggatccccaacngggaccaggggggtc

SEQ ID NO: 1991 - DNA, 1136 bp, Homo sapiens
gtgaaaggcaggtctctactgtcctgcaccaagccctgagcaagagccagacattactggagcaacatcagcagtgtttgagagaggaacaacagaacagtgtcgtgctagaagacttgttggaaaacatggaggcagacacctttgcaaccctgtgcagccaggagctgagactggcatcgtacctggcgaggatggccatggtgcccggggccacgcttcgccggctcctgagtgtggtactgcccacagcctcacagcctcagctgctggccctgctggattcggccaccgagagacatgtggaccatgcagctgagagcgatggcggagcggagcaggccgacgtgggcaggcggaggaaacaccagagctggtggcaagccttagatggcaaactgcgaggagatctgataagcagaggattagaaaagatgctgtgggcccgcaagagaaagcagagcatattaaagaagacatgtctccctctcagagagaggatgatattctctggaaaaggaagttggccacacctgtcactggagcccattggcgaactgggccctgtacccattgtaggggcagaaaccattgatctattaaacacaggagagaagctctttatattcagaaatccaaaggagccagagatctcactgacgttcctccaggaaaaagaagacctttttgaatgcccaaaaggccatgagggccttgggcatggactagcccaagggaaagacctgcgggagcatatgaaaagagaagggatgattttctcctgcccgccggtgtaaatgtgtttataatgcacaactcgcaaatataaattgcacatgcagaaggcacagaccccgtagcgcatgccaacttgcagggactcggtttaatcttgtctcatgaatttccagatggcccactctcttccatatcacaaggacataaacactccttctttcagccccacctccccagggccctggaggagacccccaccctgcaatccacaccccatcctctgctgcagaagctatggtctgtgtggtgacagccagattctctactcttatgttttgtatttgttacatattctatttttataaagggaatttaaaaaaataaaaaaaaaaaaaaaa

SEQ ID NO: 1992 - DNA, 1368 bp, Homo sapiens
  misc_feature (637)..(637): n equals a,t,g, or c
  misc_feature (1140)..(1140): n equals a,t,g, or c
  misc_feature (1170)..(1170): n equals a,t,g, or c
  misc_feature (1286)..(1286): n equals a,t,g, or c
ttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggcycggggccgccgcgaccctcccggcgcctgcwagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggnccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcagcacaggggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaagnttacaaggcatcctcaccaggggccccgcntgctgctcccaggtggcctgcgcatggcttatgctcaaggacctggaaacccatgcttcgagacaacgtgactttaatgggaagggtgggtgggccgcagacaggctggcagggcnggtgctgcgtggggccctctccagcccgtcctaccctgggctcacatggggcctgtgcccacccctcttgagtgtcttgggg

SEQ ID NO: 1993 - DNA, 1353 bp, Homo sapiens
ccacgcgtccggggatctggggtcaggcagcccggggggcttggagagacttccagaggaggcgcggactcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagccccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcgggagctgctgcctgcccaggcccgcctctccggcctgcctcttcccgctgccctggagcccagccctgcgccgcagaggactcccgggactggcggaggccccgccctgcgaccgccggggctcggggccacctcccggggctgctgaccctcagcccgcactgggagtgggctcctcggggtcgggcatctgctgtcgctgcctcggccccgggcagagccgggccgccccgggggcccgtcttagtgttctgccggaggacccagccgcctccaatccctgacagctccttgggctgagttggggacgccaggtcggtgggaggctggtgaaggggagcggggaggggcagaggagttccccggaacccgtgcagattaaagtaactgtgaagttttcaaaaaaaaaaaaaaaaaaaaaaaaaaaaaaaaaaaaaaaaaaaaaaaaaa

SEQ ID NO: 1994 - DNA, 3556 bp, Homo sapiens
tcgacccacgcgtccggcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaactttctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtaccggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccactcgatcaccgagggtaccagtccctgtcagacagccccccgggggcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggagccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttagaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatatattttttaataagatgcactttatgtcattttttaataaagtctgaagaattactgtttaaaaaaaaaaaaaaaa

SEQ ID NO: 1995 - DNA, 828 bp, Homo sapiens
tcgacccacgcgtccgcagaatcttcgatattggactgtggttgtgccagttgacactcaggagtggagactagatctgcaatctgttgggactgtgatgaggggatcatcctgccctcgaaccagacccagccctgtagcccaggcactattgcctggagttcctgggctctcagcgccaggaaatcatgaggttcagtgtctcaggcatgaggaccgactaccccaggagtgtgctggctcctgcttatgtgtcagtctgtctcctcctcttgtgtccaagggaagtcatcgctcccgctggctcagaaccatggctgtgccagccggcacccaggtgtggagacaagatctacaaccccttggagcagtgctgttacaatgacgccatcgtgtccctgagcgagacccgccaatgtggtcccccctgcaccttctggccctgctttgagctctgctgtcttgattcctttggcctcacaaacgattttgttgtgaagctgaaggttcagggtgtgaattcccagtgccactcatctcccatctccagtaaatgtgaaagcagaagacgttttccctgagaagacatagaaagaaaatcaactttcactaaggcatctcagaaacataggctagggtaatatgtgtaccagtagagaagcctgaggaatttacaaaatgatgcagctccaagccattgtatggcccatgtgggagactgatgggacatggagaatgacagtagattatcaggaaataaataaagtggtttttccatgtaaaaaaaaaaaaaaaaaaaaaaaaaaaaaaaaaaaaaaaaaaaaaaaa

SEQ ID NO: 1996 - DNA, 1685 bp, Homo sapiens
ccacgcgtccgcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgaaaaaaaaaaaaaaaaaaaaaaaaaaaaaaaagg

SEQ ID NO: 1997 - DNA, 1799 bp, Homo sapiens
ccacgcgtccgggaaatgttcacgtttcagagaggctgcagcccggcgcagcatcctgagcgcgcctctgccgaggcgagcggacatgcaggctccccgcgcagccctagtcttcgccctggtgatcgcgctcgttcccgtcggccggggtaattatgaggaattagaaaactcaggagatacaactgtggaatctgaaagaccaaataaagtgactattccaagcacatttgctgcagtgaccatcaaagaaacattaaatgcaaatataaattctaccaactttgctccggatgaaaatcagttagagtttatactgatggtgttaatcccattgattttattggtcctcttacttttatccgtggtattccttgcaacatactataaaagaaaaagaactaaacaagaaccttctagccaaggatctcagagtgctttacagacatgtgagtattatcctaaaacctgcctacaggtgggggtgggattggagaaggagcagagatgttttaaaattaagcaacaaggactacatataatagtaagtgataaataatacatttcaatgaaattttccagaagtgaatatatgcatattcctttctttaaaaaaaaaaaaagtttaattgaatttcaaaatacaggcacgccttgtttggttgcactttgctttattgcactttacaggtattgctttttttttttttttaacaaattgaagttttatggcaaccattgcctcaaaccagtctattggtatcattttttcaacagcacatgtttactttgtgtctctgcattacattttgataattctcacaatatttcaaagttttcaatactactatgcctgttatggtgatctgtgatcagttatctttgatattactgttgtaattgttttggagtgcctgaaaccatgctcacagaagacagtgaacttaattgataaacattgtgtgtgttctgactgcttcaccaacaagccattccctgtctctctccctgtcttcaggcctctctattccctgatacagaacaatattgaaattaggccaattcataaccctacaatggcatgtaagtgttcaaatggaagaagagtcacatatctctcattttaagtgaaaagctagaaatgattaagccttgtgaggaaggcaagttgaaagctgagataggctgaaaaccaggcctcttgtgccaaacatttagccaagttgtaaatgcaaagaaaaagttcttgaaggaaactaaaagtgctactcagtgaacatacaatgataggaaagcaaagcagtattattgttgatatagagaaagtttcagtggtctgggtagaagatcaaaccagtcacagcattctcttaagcctaagcctaatccagagcaaggccttaattctccttaattctacaaaggctgagagaggtgaggaagctgcagaagaaaaattggaagctagcagagggtgtttcatgaggtttaagggaaaaagccatttctataacataacagtgcaagatgaagcagcaaggactgatgtaggagctgcagcaagttatctagaagacctagttcaaatcgttgatgaaggtggctacactcaaccatagattttccatgtagatgaaacagtcctctgttggaagaagatgccatctgactgggcatggtggcttacgcctgtaatctcagcactatgggaagctgaggcagatcatttgaggtcaggagtttgagaccagcctggctaacatggtgaaaccctgtccctacttaaaaaaaaaaaaaaa

SEQ ID NO: 1998 - DNA, 1483 bp, Homo sapiens
gaggacagggagtcggaaggaggaggacagaggagggcacagagacgcagagcaagggcggcaaggaggagaccctggtgggaggaagacactctggagagagagggggctgggcagagatgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgcagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcggtgggagcggtggtggcagcagaggtgacagcggcagtgagtcctcctggaatggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaaccaccggaggcccc

SEQ ID NO: 1999 - DNA, 679 bp, Homo sapiens
tcgacccacgcgtccgactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccaggaagttgtgaaaaaaaaaaaaaaaaaaaaaaaaaaaaaaaaaaaaaaaaaaaaa

SEQ ID NO: 2000 - DNA, 615 bp, Homo sapiens
ccacgcgtccggctgctctgaagctccatggtgcccagaatcttcgctcctgcttatgtgtcagtctgtctcctcctcttgtgtccaagggaagtcatcgctcccgctggctcagaaccatggctgtgccagccggcacccaggtgtggagacaagatctacaaccccttggagcagtgctgttacaatgacgccatcgtgtccctgagcgagacccgccaatgtggtcccccctgcaccttctggccctgctttgagctctgctgtcttgattcctttggcctcacaaacgattttgttgtgaagctgaaggttcagggtgtgaattcccagtgccactcatctcccatctccagtaaatgtgaaagcagaagacgttttccctgagaagacatagaaagaaaatcaactttcactaaggcatctcagaaacataggctagggtaatatgtgtaccagtagagaagcctgaggaatttacaaaatgatgcagctccaagccattgtatggcccatgtgggagactgatgggacatggagaatgacagtagattatcaggaaataaataaagtggtttttccaatgtaaaaaaaaaaaaaaaaaaaaaaaaaaaa

SEQ ID NO: 2001 - DNA, 1383 bp, Homo sapiens
  misc_feature (7)..(7): n equals a,t,g, or c
  misc_feature (10)..(10): n equals a,t,g, or c
  misc_feature (12)..(12): n equals a,t,g, or c
gattttnggnancggtccgcctgcaggtaccggtccggaattcccgggtcgacccatgcgttcgggccgattagcacatgaaaagattctcaacatcattagtcccacgagcagatttcatcttctcagctttctccccttttccttactcaaggcggtagtttgttgttcttggctaagtagtaatagtagtagtagtagaattataatttttaaaatgtatctgcctgtcttaattataggtgcttttcttggaggagttggtggttaggagtatagtcagagagcgcctgatagagaactggaaggatgtagaaagtatagatccctcctcttctgccaaacatcacttgcagccaggcaggagaagctaatgtcaggcgtaaaagcttccgtttccttccttctcttcttaacacctagcatagcgctatgctatagccagcaagctgtcattaattcaatgattgcagcagagactagagttggtgtagcatttggtggcttttggtagtaacagccatgtcttcataattaatattcacttgatgcttamctgtttcagagcaatggaaatgagaagatactctgctgttgtcacatatgctcctgatatcacaaatgaataaaagttattcacatggaagctgattttaaagtgcacttaaggaaatcgatgatcaaaagatcagtaataaatgtatgtctaaggctgggcmcagtggctcacgtctgtaatcctagcactttgggargctgaggtgggtgaattgcctgagctcaagagtycaagaccagcctgggctacatggtgaaactcccatccctactaaaatacaaaaaattagctaggtgtggcggcatgcccagctacttgggaggctgaggcaagagaattgcttgaacccagaggcagaggttgcagtgagctgagattgcactactgcattccagcctggtgacagagtgagactctgtctcaaaaataaataaaaatatgtctaaaattgaggcaaacacatctctcagatctttatgctgggaggagtaaggtaagaatggcatttataggccaggtgtagtggctcatatctgtaatcccaggactttgggaggtcaaggtgggtggatcgctggaagctaggaatgagaccagagcctgggcaacattgtgaaaacctgtctcttaaaacaaaacaaaacaagccaggtgttgtgacacgtgcttgttgtatgagctacttgggaggctgaggatggaggttggcttgaacccagaaattgaggctgcagtgagctatgatagcaccactatattccagcctgggtgactcttgaaaaaaaaaaaaaaaaaaaaaaaaaaaaaaaaaaaagggcggccgc

SEQ ID NO: 2002 - DNA, 4720 bp, Homo sapiens
ccacgcgtccggagagagggacagaggctggagaaggatgtatggcctgccctgggcttgtctgttccctcctgagcctgagccccttaccttcctgaccccatgaagcacacactggctctgctggctcccctgctgggcctgggcctggggctggccctgagtcagctggctgcaggggccacagactgcaagttccttggcccggcagagcacctgacattcaccccagcagccagggcccggtggctggcccctcgagttcgtgcgccaggactcctggactccctctatggcaccgtgcgccgcttcctctcggtggtgcagctcaatcctttcccttcagagttggtaaaggccctactgaatgagctggcctccgtgaaggtgaatgaggtggtgcggtacgaggcgggctacgtggtatgcgctgtgatcgcgggcctctacctgctgctggtgcccactgccgggctttgcttctgctgctgccgctgccaccggcgctgcgggggacgagtgaagacagagcacaaggcgctggcctgtgagcgcgcggccctcatggtcttcctgctgctgaccaccctcttgctgctgattggtgtggtctgtgcctttgtcaccaaccagcgcacgcatgaacagatgggccccagcatcgaggccatgcctgagaccctgctcagcctctggggcctggtctctgatgtcccccaagagctgcaggccgtggcacagcaattctccctgccccaggagcaagtctcagaggagctggatggtgttggtgtgagcattgggagcgcgatccacactcagctcaggagctccgtgtaccccttgctggcggccgtgggcagtttgggccaggtcctgcaggtctccgtgcaccacctgcaaaccttgaatgctacagtggtagagctgcaggccgggcagcaggacctggagccagccatccgggaacaccgggaccgcctccttgagctgctgcaggaggccaggtgccagggagattgtgcaggggccctgagctgggcccgcaccctggagctgggtgctgacttcagccaggtgccctctgtggaccatgtcctgcaccagctaaaaggtgtccccgaggccaacttctccagcatggtccaggaggagaacagcaccttcaacgcccttccagccctggctgccatgcagacatccagcgtggtgcaagagctgaagaaggcagtggcccagcagccggaaggggtgaggacactggctgaagggttcccgggcttggaggcagcttcccgctgggcccaggcactgcaggaggtggaggagagcagccgcccctacctgcaggaggtgcagagatacgagacctacaggtggatcgtgggctgcgtgctgtgctccgtggtcctattcgtggtgctctgcaacctgctgggcctcaatctgggcatctggggcctgtctgccagggacgaccccagccacccagaagccaagggcgaggctggagcccgcttcctcatggcaggtgtgggcctcagcttcctctttgctgcacccctcatcctcctggtgttcgccaccttcctggtgggtggcaacgtgcagacgctggtgtgccggagctgggagaacggcgagctctttgagtttgcagacaccccagggaacctgcccccgtccatgaacctgtcgcaacttcttggcctgaggaagaacatcagcatccaccaagcctatcagcagtgcaaggaaggggcagcgctctggacagtcctgcagctcaacgactcctacgacctggaggagcacctggatatcaaccagtataccaacaagctacggcaggagttgcagagcctgaaagtagacacacagagcctggacctgctgagctcagccgcccgccgggacctggaggccctgcagagcagtgggcttcagcgcatccactaccccgacttcctcgttcagatccagaggcccgtggtgaagaccagcatggagcagctggcccaggagctgcaaggactggcccaggcccaagacaattctgtgctggggcagcggctgcaggaggaggcccaaggactcagaaaccttcaccaggagaaggtcgtcccccagcagagccttgtggcaaagctcaacctcagcgtcagggccctggagtcctctgccccgaatctccagctggagacctcagatgtcctagccaatgtcacctacctgaaaggagagctgcctgcctgggcagccaggatcctgaggaatgtgagtgagtgtttcctggcccgggagatgggctacttctcccagtacgtggcctgggtgagagaggaggtgactcagcgcattgccacctgccagcccctctccggagccctggacaacagccgtgtgatcctgtgtgacatgatggctgacccctggaatgccttctggttctgcctggcatggtgcaccttcttcctgatccccagcatcatctttgccgtcaagacctccaaatacttccgtcctatccggaaacgcctcagctccaccagctctgaggagactcagctcttccacatcccccgggttacctccctgaagctgtagggccttgtggggtgaggtgaccctgaggctgcctgtcctcccctttgatttagcctgggccacaggacttcggtagctcttgccccagagcccaggctggcatccaggcctggactgtccccagttccggcttacctggccccaccttgcctgctcctttccacccctttctgctcacgacccccatcattcacgctcagaatcacatgggacttctgtgcagctgcagagccagcaagtccctccaggtgtcaccccttacccccatgctggtggcatcctcacaggaagagcctgttctccacctgctggagcctggaccctggggtgggacagaggcctcgtccaaccccactccccttcccgtgtgtcttccccctgccaagcctccccctgccaagcctccccctgcccctctctgagcccctcgccccccacaccgtcctcatctggcctcccccctggcccccacttccctcttatgcccttcctggccctttgcttcctcccttagtcccctcttcaccatatctccactgctaccttgctggccccagagaccaccctgcccaaccaaaccactcaggtaacgccactaatcaggcaggggccaccatggcctaggtctgggctggctgcaggccctgcctcatggcctctgagccctccactgccccagggccttgggccctctgcagatctcatccaggatttattggtgtccagtggggtgagggaggcctgtctgaaggccgagcctccctgcctgcacccaagttagaaatgggggtaccagcacttagcttctctctgagtgctggctcccaaggaagggacctgggacctgggccacagtgggggcttgcccttacctcttcagaaggaagcatcttccacagcccccacccaactttcttaggagtgatctggtggccagaacaggattttgcacggccccttttatcctgcgcatgtggcctagggtcatccccagcccatccctgtgtcagccctgagtgctggacactgcgttccagaaatgaggaagaggagagagaagagatggacagacctcagatccattaaagtgttctcacttccctgagacttggttctgggtccttaaaaccaggtttcctaggctgggaccctgtacatagttggtgtttaatgagtgtttatggagaggagagttctaaggtcacctctggctgcaggcatccagggattattccagcaatctgcaggtagggagtgggtcccagcctgggagcctgctgtcaggagcaggcagacctggactcacagcctggctgtgatgcttgttcgctcagcttctccatttatgagatggggagaatagtcacagcctcctcaaagggttgtgaaaatcaaatgtgataatttgtggaaagcccttagcagtggcctggcacaaaacaaatgctcagtggatggaagctgcctattattattgtcgttgttgttgtttgccatgactgctctgggccgggggtagagctagcatccgggcatgtacgagggaagagggaggcaggcctctattcaaaggcagaaattcctttaagattgtggtctgctgggtttcagggagtgtctgtgttgtttgtttttgtttgtttgtttgttttgagacagggtctcgctctgtcacccaggctggagtgtagtggtgcagtcttggctcactgcaacctccacctcctgggctcaagcgattctcatgcctcagcctcccgagtagctgggactacaggtgtgtgccactatgcctggctaatttttgtattttttgtagagacggggttttgccatgttgcccaggctggaagtgtctatgtttaactgcatcttataaaccagcaacaagttttctactgggaattagaatggtgcatacacaatgtattattatcactgtcagatgagcatgcttgaatgtagcatgactgcctctttttgcttttcctagaggttttttttttgcttgttactcatctgttgacctacctgggggaagtagcacccttgcatttcaaaaataaaattgatggcattacaaaaaaaaaaaaaaaaaaaaaaaaaaaaaagg

SEQ ID NO: 2003 - DNA, 900 bp, Homo sapiens
tccggaattcccgggtcgacccacgcgtccggaaatgtaggatcatttctctctagagagttgtcagtggagtcatcccatcttcttccatactagactgaaaaaaaaaaaacatgtattttaggaatagatcccagccacatgtctctcactgtctttcattttcttcttttagctctgttaccaatatcactgatgagtaccctacaatcaattttcagaaactcagatactctgattatagaagcagctgattttgttccagtacggtttctcaaccagtggtttatgatcccagttgacattagcagtctctccaaactaggggtcagcaaactctttctgttaagggccagacaatatcaggcttgggggacagccagctagtctcttttgcatctacttagctctgtcattgtagtacaaaaacagccacagacaatatttaaacaacatggctgtggtttaataaaagtttatttacaaaaataaacagtggactggatttagcctatagttcatactttgctaaaccctgctccagaccatagggggaattggtaaaaatcagtgaaaaatttttccaaaactaaaggcagaagtgtttcaaattaggtaagatatgtggtccatatgttctatgacttcattttttatttacatttagtttatggttttaatttttttttacctaaaactctataacaaactttcatttaatttgaatccaatttgtaaaaaataaattttgactggacacagtggctcatgcctgtaatcccaactctgggaggccgaggcaagcagatcgcttgagcccaggagtttgagacaacatgggcaacatggcaaaaccctatctctacagaaaatacaaaaaaaaaaaaaaaaaaaaaaaaa

SEQ ID NO: 2004 - DNA, 2015 bp, Homo sapiens
  misc_feature (1)..(1): n equals a,t,g, or c
  misc_feature (2015)..(2015): n equals a,t,g, or c
ngaacagacttacctcagcaaccctggcacctccaacccgacacatgctactgctgctgctactgctgccacccctgctctgtgggagagtgggggctaaggaacagaaggattacctgctgacaatgcagaagtccgtgacggtgcaggagggcctgtgtgtctctgtgctttgctccttctcctacccccaaaatggctggactgcctccgatccagttcatggctactggttccgggcaggggaccatgtaagccggaacattccagtggccacaaacaacccagctcgagcagtgcaggaggagactcgggaccgattccacctccttggggacccacagaacaaggattgtaccctgagcatcagagacaccagagagagtgatgcagggacatacgtcttttgtgtagagagaggaaatatgaaatggaattataaatatgaccagctctctgtgaatgtgacagcgtcccaggacctactgtcaagatacaggctggaggtgccagagtcggtgactgtgcaggagggtctgtgtgtctctgtgccctgcagtgtcctttacccccattacaactggactgcctctagccctgtttatggatcctggttcaaggaaggggccgatataccatgggatattccagtggccacaaacaccccaagtggaaaagtgcaagaggatacccagggtcgattcctcctccttggggacccacagaccaacaactgctccctgagcatcagagatgccaggaagggggattcagggaagtactacttccaggtggagagaggaagcaggaaatggaactacatatatgacaagctctctgtgcatgtgacagccctgactcacatgcccaccttctccatcccggggaccctggagtctggccaccccaggaacctgacctgctctgtgccctgggcctgtgaacaggggacgccccccacgatcacctggatgggggcctccgtgtcctccctggaccccactatcactcgctcctcgatgctcagcctcatcccacagccccaggaccatggcaccagcctcacctgtcaggtgaccttgcctggggccggcgtgaccatgaccagggctgtccgactcaacatatcctatcctcctcagaacttgaccatgactgtcttccaaggagatggcacagcatccacaaccttgaggaatggctcggccctttcagtcctggagggccagtccctgcaccttgtctgtgctgtcgacagcaatccccctgccaggctgagctggacctgggggagcctgaccctgagcccctcacagtcctcgaaccttggggtgctggagctgcctcgagtgcatgtgaaggatgaaggggaattcacctgccgagctcagaaccctctaggctcccagcacatttccctgagcctctccctgcaaaacgagtacacaggcaaaatgaggcctatatcaggagtgacgctaggggcattcgggggagctggagccacagccctggtcttcctgtccttctgcatcatcttcatcatagtgaggtcctgcaggaagaaatcggcaaggccagcagcgggcgtgggggatacaggcatggaagatgcaaaggccatcaggggctcggcctctcagggacccctgactgaatcctggaaagatggcaaccccctgaagaagcctcccccagctgttgccccctcgtcaggggaggaaggagagctccattatgcaaccctcagcttccataaagtgaagcctcaggacccgcagggacaggaggccactgacagtgaatactcggagatcaagatccacaagcgagaaactgcagagactcaggcctgtttgaggaatcacaacccctccagcaaagaagtcagaggctgattctcatagaacaagaaccctctagagccccatgctatgcagtaggtcaccagggctccctcctcctgtctaaccaaaacttggaccaatgtctcccctttccccggctaccagggn

SEQ ID NO: 2005 - DNA, 668 bp, Homo sapiens
tattgtcctgctcttttttttttggatgaaaactccagcctttcctgactcacctccatcttcggttcttcagttttctgagaagagttgggatatgtgggaaggggcatgggagctcggcagcctccgcctgccaggaaggcagtttcgcctctgcaggaaagagcagagcccgtgggaagccctgggtgagggtggcgcagcggcccagcacgcatggtattgccagccacggggggcctgcgtgtagtctctgctccctgcatttcaccttctttgttgactttccttctctgttttcccccatctgtttgccagaggggtgggactggcaacagaacagccgtggctgctttatctctcctctccacggtgtactcaggcctgagtggtgactcacgggagcctggccacctcgcagctgttcgccccctcaacctttgaactggaactgctggctcacacagggttttcgacaactgcagctgaatctcatggaaaagctggattcctctgccttacgcagaaacacccgggctccatctgccaggtgcttgccactggtcctggcagaaatggcggctgctgaaagtgaccttccaaatccttggtggcacttcagcgccacaggctctccaataaaaaccctttacacacaaaaaaaaaaa

SEQ ID NO: 2006 - DNA, 1534 bp, Homo sapiens
ccacgcgtccgcccacgcgtccggaaatactaaaaattaaatgaaaagttgtgatgcttgaagtgctgattagtattcggactaaagtatatgaatgaataacaattttttctctgcagagactgcagcatgaaatctcatgctacattgactggtggcagtggtttttatttcatagaactttcttttctgttgttgagatctgtgctgttggtgctggttctgctttggcagttcccaaagtcccttacaggacaagaatgatgagtggggatataaatctcaattccagcagctgctcactcacaggtgtctcggtggaagaattgggtcttgttgagcctgtagcttctctctatatactgctgggagatgctgcctgtgagtgccttgcttgatatccaggtgctagggctaaggacctctttgtggaatagccatctttgcttgaggtctgtgcaattgtgtatgcctgcagtgcagtgcctggtaaggctttcaaactgtgggcaagaatgtaacaatgcctgtcactcgtgaagagacacagtcggtgaggtgagtatggattatgccaaggaaagttttctgggtcagagactttatcctgctgcaggaattaactccattgatcaaaaacagccttaattgggatggggctcgggggcaaatttcatatgtgattggcaggagtctaaactgtatagcttttctggagggcattttggcagtggggattaaagtgtcaaatgtgcatactctgtgactggacattttcacttcacagaatttatcctaaggaaagcattgtacaagtatacacaaaagggtgttcctccgcaccataatgtttagtgttgccatcacctggggctttattaaaaaaggaaaagttacataaattccagtaaaaccatacagtggaatattataaagctgctgaagaagatgaagtcaacttctatgtactattatggaatgatggtaaagaaattatgtacaaaagtcacagatcagcatgaatagtgtgatcctattttcaatatatatgtgtgtattgagtgcatattatgtaaaggtttatatgcattaattttgggaggaagaatatcaaatgctaatagcgatcatcaaatgctaatagtgattatgtaaagaccctcattttctacttcctacttctctgtattgtttgaactgtttataaaggtaaaaccatagtaatttgggctgggtgcggtagctcatgcctgtaatcccagcactttgggaggccaagtggggtggatatcttgaggtcagttgtttaagatgagcctgaccaacatggtgaaaccctgtctctactaaaaatacaaaaattggttgggcttgatggtgtgcacctgtggtcctaactacttgggaggctgaggtgggagaattgcttgaacccaggaggtggaggtcgcagtgagctgagattgcaccactgcactccagcctggatgatagagcaagattctctctcaaaaaaaataaaaaaaaaaaaaaa

SEQ ID NO: 2007 - DNA, 1182 bp, Homo sapiens
agattagagtgataattcttgttctttgtgtattcatttatacagccctgctccatggactactcatgttataataaagggatagagaagggcatgatgacgatgtgcgttcccagtgtgctagctgtggctctacccctttttctctcacttaagaaaacttcccagaaacccgagaagtgagagcattttcccccagggaaaaccttgaattgtgtacatgtaaatccatgggaatcttcagcactttattattagcatcagattctttgttgaacttaatattattcttctttattttcgctttctcagtgaagctttcttcctcatcgtttccaagttgttgtgtttcggtaayckgattatctgtcattycagagtccckgtcctcccackgagccacatgcgcacacacatctctgtcaggcacccctgtcatgtaaggcacgttgggtctgccagagcggcaccccttgttccaactttcaggtttaatgcttgagaacatttgaaggctgttgtctggaaaagataagtgtttttatatttctttgaattttaggagttgtctaccacaacaaataaactagatcacactttttaagttcaatacttattatcctcattctgtggaaaaaatatattttctattaatcatgtacataatagtactaattatgggccactttggctgaacacagttttatgcttaggcttacataattaaggttgtaatgttatttctggatctttgaggcattagtagagatcactgatgaagtaaactgacaaacataactccttttctttggaaaagatggatgctgtctgctaaactaatcaagttatagagccttaggccgggtgtgtcggctcatgcctgtggtcccggcactttgggaggccaaggtgggcggatcatgaggtcaggagtttgagatcatcctggccaacatggtgaaaccccatctctactaaacacacacacacacacacacacacacacacacacacacacacgccgggcatggtggtgggcatctgtggtcccggctactcgggaggctgagacaggagtgtcacttcaacccaagaggcagaggttgcggtgagccaagatcatgccattgcactccagcctggaagcctgggcaatagagcaasactccatctcaaaaaaaa

SEQ ID NO: 2008 - DNA, 2050 bp, Homo sapiens
  misc_feature (515)..(515): n equals a,t,g, or c
aagaatggcataaattcatccagcttcttacagaattccaaatgcggaatgtagattttttatatagtaatcttgagtttattctaccattaccagttgataccattccagaaactaaaaacttttgtggcccatcagtaactgtggatgccagtgcagcaacaaaaagtatgaattgtcttgctaggaaacactctgaaagagaacagccattgaaaaagtcccagaaaaagaaacaaaagaaaacattggtaatattagatgatagtgatctatttgacactgacttggactttcctgatcaatctattagcctgtcctctgtatcatcttcctcaaatgcagaagaaagcaaaaccggagacgaagaaagcaaagccagagacaaaggaaacaatccagagacaaagaaatctattccttgtcctcctaaaacaactggcaggaaaaaaatgttctgccctgtttctcattgtttaaattctctctctgagttcatgggataacatgtcctncttagatgcacttttaactgatgtaagggracaaaacaaatacggtagaaatgactttagttggacaaatggaaaggttacaagtggactttgtgatgagtttagtcttgagagtaatgatggatggacttctcaaagctctggagaattaaaggcagctgcagaagctctcagctttactaaatgttcttctgctatttcaaaagcatkggaaaccttgaattcttgcaagaaattaggaagagatccaaccaacgatcttactttttatgtttcacaaaagcgcaataatgtatactttagtcagtcagcagctaatttagacaatgcttggaagaggatatcagtcattaaaagtgtattttcgagtcgatctcttctctatgtgggtaatagacaagctagtataattgaatacctgccaacccttcgaaacatctgtaagactgagaagctaaaagaacaaggaaaaagtaaaagaagattcctgcactattttgaaggaattcatcttgacattccaaaagagactgtgaatactttggcagctgacttcccttaatgttccatactaacaatgctttgtatagattatcatgtggtccttaagatacatttttatattatgtggatcttcatggaaaagtatatttctcgatgtacattttaaacaaacaatttgtatatttttttattggcgggtaaatatttaaaatatttgagttacaaattttatatatgattgtaattttttttctgaattttttgtattatctgatttagctttgttggagtattttttgtatgtgagtgaactgtttctggaaggtaragttcattaagatgaactccctatttcaagtgtttatattatatattagcttaatattcagatacattatcttggctgctaacattagtgtcactaaagttggtatacaatctcccactgctaaatttgactggctttacaaaaacaaaaacattatctggtgaattatatttttaacctaaaagttaaggatcctcatattgtacagttttttttgtgtgcttttttttttttttttgagacggaatcttgctctgtcacccaggctggagtgcagtggcctggtatcggctcagtgcaacttttgcctcccgggttcaagcgattatcctgcctcagcctcctgaatagckgggattacaggcatgtgccaccttgcccagctaatttttgtatttttagaagagacagggttttaccatgttggttaggctggtctcttaactcckgacctcaagtgatccatctgcctcggcctcccaaagtgctgggatcacaggcgtgagccacctcacctggcctatattgtacagttttgaacagtatagatgcatacctgtttacaaatgtgtatgaagatagatatttttacctcttatttgttcaatttactttktcttgtattaattagtatattgatctaattaaaggttaaagctaaaggctttatgaaatgtttaaaaaaaaaaaaaaaaaactcgag

SEQ ID NO: 2009 - DNA, 402 bp, Homo sapiens
  misc_feature (1)..(1): n equals a,t,g, or c
  misc_feature (335)..(335): n equals a,t,g, or c
  misc_feature (345)..(345): n equals a,t,g, or c
  misc_feature (371)..(371): n equals a,t,g, or c
  misc_feature (373)..(373): n equals a,t,g, or c
  misc_feature (382)..(382): n equals a,t,g, or c
ngataaactatttatcataaatttaaatgttgttattgtgcctttattgcacattttttctcatgccttttattataaaatatacttgttttcaccttgtttttggtcaaatcccagttactgtccatgtaaacatatggcaacataagaacgtcactttttttatcctgcactgtggcatacctgctcttacaagagattctgctgcacttacatattcaaatgatggcacagttatagagactttattattcttaattctttatttagacttaaacattatttgttggctaattaaaacagttccatatggatgaactttaataattaaaatngatatttttncagggccaggccatagtgggccccangnccggtaatnccccagcattcccagggagg

SEQ ID NO: 2010 - DNA, 746 bp, Homo sapiens
ggttaaacatttgccagcacaccactaaatgtgccccagaaaaggtaacttcccctagtcccactgcccaggatcagaagaagatggcacagagatggccaggcaagttggctcacacctgtaatcccagcactttgggaggccgaggcaggaagatcacttgaggtcaggagtttgaaaccaacgtgggcaacataagaaatcctcctctctggctataaataaataagaagatggtacagcaaccatgagtccatgtcccagaatccatcctgtgggccctctgtagccatggtggtggacagaacaggaggcagggcaatagtggagttctggcttggccaagcagcctagaactcaaagtccatggccccttctgggcctggagaaattggatggttatagcaccaggcagcccttgtgggtgggggacagcaaatgagggacctctcttttctctacactctcctttggctcccggagatctggcaggccctggctggaggcataagattagatgaggttgagctgttggagaatgaagctgtgttgggagaagaaatgaggttgtaccggaagatcaacgaggttgtgctgtcagggaatgaggtggtacttgggggcaaagtgagctgcattattagataaatgaggttgtactgtcaggggatgaagtgtacttgtagtagagatgacgtcctgctggatcagtcggcttttgctccatcagagaacacagccacacc

SEQ ID NO: 2011 - DNA, 1332 bp, Homo sapiens
ccacgcgtccgctgagagtagccatgggctctggaggagacagcctcctggggggcaggggttccctgcctctgctgctcctgctcatcatgggaggcatggctcaggactccccgccccagatcttagtccacccccaggaccagctgttccagggccctggccctgccaggatgagctgccgagcctcaggccagccacctcccaccatccgctggttgctgaatgggcagcccctgagcatggtgcccccagacccacaccacctcctgcctgatgggacccttctgctgctacagccccctgcccggggacatgcccacgatggccaggccctgtccacagacctgggtgtctacacatgtgaggccagcaaccggcttggcacggcagtcagcagaggcgctcggctgtctgtggctgtcctccgggaggatttccagatccagcctcgggacatggtggctgtggtgggtgagcagtttactctggaatgtgggccgccctggggccacccagagcccacagtctcatggtggaaagatgggaaacccctggccctccagcccggaaggcacacagtgtccggggggtccctgctgatggcaagagcagagaagagtgacgaagggacctacatgtgtgtggccaccaacagcgcaggacacagggagagccgcgcagcccgggtttccatccaggagccccaggactacacggagcctgtggagcttctggctgtgcgaattcagctggaaaatgtgacactgctgaacccggatcctgcagagggccccaagcctagaccgggggtgtggctcagctggaaggtcagtggccctgctgcgcctgcccaatcttacacggccttgttcaggacccagactgccccgggaggccagggagctccgtgggcagaggaggaacacaggataaaaatggaagttctcaataaaaagaagatgtattgggaaagaaaactacaaacttttaccaaggaatggcctgtttcctcatttaaccggccctttcccaattcgccctaagactttgggggtggctctcttgtaattaatctgtgttggcaaagaatgtctggaacatggacttggcggtcagtaacctgtaacagagctacaactaggaaaattagagtggtagtagtcacttatttaagaattcattcaggtaaacagctgcaccctctgtaccccttaagtggcaaagaagctgttatagtcttctgaaaattatcactatgagtgctataattctgaatataatgtctcttaattagaattcatacaagaaccaaaaaaaaaaaaaaaaaaa

SEQ ID NO: 2012 - DNA, 2609 bp, Homo sapiens
ggcacagggagggtttgtgtgtatggagtgtgtcggttgtgtgagggtgtgtgtgtgagggttatgtgcatgcaaagatgtgtttaggggtgtgtgtaagaagctatgttgagagtgtgcatgtgagggtgtgtgtgtgtgtatggatggatgcatagatgcatagatgtttggttggtaggatagatacatagatggatgggtggtttcatgcataaatggatggatggatggatgggtggatgcatgagtgggtggatggttggcatgcgtgcaagaatggatgcagggtggatggatggatgcakgaatagatgcagggtggttggatgatgtgtgtrtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttraaaaaaaaaaaaaaagggcgcccgctcgcgatctagaactagt

SEQ ID NO: 2013 - DNA, 1001 bp, Homo sapiens
agccaaccctacaaagttataaaacagaaactagaaggcaggccagaaacagaatacaggaaagctcaaacattttcaggccatgaagatgctctggatgacttcggaatatatgaatttgttgcttttccagatgtttctggtgtttccaggatcccaagcaggtctgttccagcctctgattgtgtatcggggcaagatttgcacagtacagtgtatgaagttattcagcacatccctgcccagcagcaagaccatccagagtgaactttcatgggctaaacagtacattcgagtgaaattctgaagaaacattttaaggaaaaacagtggaaaagtatattaatctggaatcagtgaagaaaccaagaccaacacctcttactcattattcctttacatgcagaatagaggcatttatgcaaattgaactgcaggtttttcagcatatacacaatgtctgtgcaacagaaaaacatgttggggaaatattcctcagtggagagtcgttctcatgctgacggggagaacgaaagtgacaggggtttcctcgtaagttttgtatgaaatatctctacaaacctcaattagttctactctacactttcactatcatcaacactgagactatcctgtctcacctacaaatgtggaaactttacattgttcgatttttcagcagactttgttttattaaatttttattagtgttaagaatgctaaatttatgtttcaattttatttccaaatttctatcttgttatttgtacaacaaagtaataaggatggttgtcacaaaaacaaaactatgccttctcttttttttcaatcaccagtagtatttttgagaagacttgtgaacacttaaggaaatgactattaaagtcttatttttatttttttcaaggaaagatggattcaaataaattattctgtttttgcttttaaaaaaaaaaaaaaaaaaaaaaaaaaaaaaaaaaaaaaaaaaaaaaagggcggcc

SEQ ID NO: 2014 - DNA, 1026 bp, Homo sapiens
  misc_feature (456)..(456): n equals a,t,g, or c
ggcaatcctcccacctccacttcccaaagtgctgggattacaggcatgagccaccatgcctggctgtgtcttttgttttttaactcttctgtttcattctttgtctgtgggacagtactgctgtcttatttgcgtctgttttgttttatacgtatatacacagatacatacacgcatacatatacatacacacaaacattttttttttccttggagacagggcattgctctgtcacccaggctggagtatagtagtgcgatcatgactcatcgactcattgcagccttggcctcccaggctcaggcgatcctcccacctcagccttctgagtagctagtatgtccggaattggtgggttcttggtctcactgacttcaagaatgaagccgcagaccctagcggtgagtgttacagttcttaaagatagcgtgtccagagtttcttccttctgatgntcggacatgttcagagtttmttccttctggtgggttygtggtctcgctgacttcaggagtgaagctgcrgaccttcgcggtgagtgttacagctyttaaggtggcacgtctggacttggtcattcctcccagtgggttcatcatctcgctggcttcaggagtaaagctgcagaccttcacagttagtgttacagctcttaaaggtggcacatcagaagttcttcattcctcctggtgggtttgtggtctcgctgactccaggagtgaagctgcagaccttcgtggtgagtgttacagctcatgaaggtagtgtggacccagccatttgttgtgctgtggcagaggacatggctgggcaccagctggcaccttgtatactggagttactgacatactggcagggtgggcacaaatgaagcgaacctgcaaaacctctacagctggactagggttcaggacacctggatgatttccaattcggaatgtgagaacttgttcccctaaatccaggcattggatccggtagatgtactggttctgttttctcttagatggcagccacacttgtgc

SEQ ID NO: 2015 - DNA, 1837 bp, Homo sapiens
ccgggtcgacccacgcgtccgcccacgcgtccgcagaatcaagagtaaaagcaacccagacaactctttaatagtctgatgctactgtgcatattaatatttaaagtccacttgttattattttgcagatccttttctgcattccttaatctgaaagagagatttttattcttaatacttgtatggatttttgtggctttttatgggtgtaaatattctcctctctcgtttgacagtttcaaaagcctaggttcataagctctccatgaataaatatgttcttagtcatgtgatgtaaaaagatcgcttacaaagcttgtgaaacctgagccttccttttgaaccttttactacccatgagctcaggaaccatacatgcaaaattttattcttgcgtcatgacttcagcttatgagggaaatgagctatgaatttaaatgactcttctactctataccaagtttctatgaaaataaaattgtattttttcctttttcctaaaaggaaagtttcatctgactagtgtttctgccggtatttgttcccattgttaaaagatttgtttcttaagattagcattaaaatagacatcctgtttttgaaggcatctttttttgtttatactgtaatcccaaaaatgtccaactggctgaatggccaagaaactcccttgtaatttcctaatagagctaaagttaacaagtcaccttaaagtctactaattccaattaagttcaccttggagaaattttcattagtctagtcctttggcacttacccaatacacccttaattaaagttcttatgcatgggaccagttgtatctattataaagattatcataattctaagttttctctcccacccccatttttttttcagggtgtgtttccatataaagatcgaaaaagtccattttcttttcatgtatcttcaagatggaagatcttttccttcccttccttcctcccttcttccctccctcactccctccttccctccctcactccctgcctccctcccttccttcctttcttcttccttccttccttttcagttttatactactcagaagtttgaggaggagagagaatacattaaaatgtattcagccccagttcaggcactatatagtgctagctatgtgttacttatttggattctcatgtgaacctggtgagatggactggatcccactttacaaacgaggaacgagaagcttagataagttaaaccttttccaaattttcacatctttaaatgatagagtcaagttttgaactaagatctgacttcagagttcttgctcactagattgcctttcaggtagtatttggaggcctctgcacctctcctaccaggatacttcccccatcgcattgtgtagcttttctccatttcatttctatagcactttgacatctagcaaatgttattttctcatcttcctcctcttcctacctcttgctgcttgtataaatatcttgttcaggctgaactgagagaagtagtgtattcagaaaacttactatctcttttcggctgggtgtggtccctcacacctgtaatcccagcactttgggaggcctaggtgggcggatcacttgaggtcaggagttcggggccagcctggccaacgggatgaaactttgtctctactaaaagtgcaaaaattaggtggatgtggtggctgcacctgttgtcccagctactcaggaagctgaggtggggagactcacttgaacctgggaggcggaggttgcagtgggccgggattgcgccactgtactccagcctgggtgagggagcaagactctgtctcaaaaaaaaaaaaaaa

SEQ ID NO: 2016 - DNA, 736 bp, Homo sapiens
  misc_feature (606)..(606): n equals a,t,g, or c
  misc_feature (646)..(647): n equals a,t,g, or c
  misc_feature (657)..(657): n equals a,t,g, or c
  misc_feature (687)..(687): n equals a,t,g, or c
  misc_feature (733)..(733): n equals a,t,g, or c
gggcattatttatctgtccattctgtgtttattaaatacctctttggtgctggttaccgtctgggtgctggagatacaaagatgaatgaggcatggtccctgccccaaaagatcatctagggagacaggcactcaaacaggcagtcatgttacaatgtgacaagtaggtacaagaatctaatgagagtacaggagctcctactgttcctggtgggtggtggggttactgaaggctgcacggaggaggtgacacccctgtgcttgttcttggcaaataacgaggtcctcagaacgttaacctgcagacagagtttagcacagtgagaggttatgggaaactatggtgagttgaaggaatgttgagttgtttggttgtcgatgaggctgcaaatatcagaatgcaagagaatggggcaaaagattccctgacatacaagtttctgcctcaggagtttggattttattctgaaaacatagggaatcatttaagggttttaaagaagaatgaaatttgcatttaagaacactttggaagttgtgaggaaatgaattgccaggcatggtggcatgtgcctgtagtctcagctgctggggatgctgaggcangaggatcataagcccaggaagtttgaggctgccagcgagnnatgattgcanctgtgaaataagtccattgtactccaagcntggggaaaagatggtccagacccccaacctcttgtaaaaaaaaaanaaa

SEQ ID NO: 2017 - DNA, 2639 bp, Homo sapiens
  misc_feature (1)..(1): n equals a,t,g, or c
  misc_feature (7)..(7): n equals a,t,g, or c
  misc_feature (15)..(15): n equals a,t,g, or c
  misc_feature (21)..(21): n equals a,t,g, or c
  misc_feature (24)..(24): n equals a,t,g, or c
  misc_feature (1887)..(1887): n equals a,t,g, or c
  misc_feature (1983)..(1983): n equals a,t,g, or c
  misc_feature (1989)..(1989): n equals a,t,g, or c
nctatanatcatacnggaaanggnagactgcagtacggtcggaatcccgggtcgacccacgcgtccggtgggaatgaatgaagttaggagttgaacttaacatccttttgatatgggctttggagtcttacctgttgccctgcaatgaagtagaaactgatgctgccatgcactgactccagcagatacatagcgttgtgtgctgggaggagaggctggaatggattatcccaaggtcccttcaacctaagatggccctaaggaataatggtgctgccactggcctccacctgccacatgcatgggtgccatcgcctatttcaaactctcctcccagtactgaagtcttcctggctctctgtgccaggcttagctgtgcccttggttatggcagttttcttaatttcttcaagttattttcttctgtgtgtctttaccattagatccctgagggcatgggtcttgccgtttacctctgtccctagagctcaaggcggttcttgctgtcggtctcagtggttatataagaccctccctccttgkttggtctgtaaacctgtgtaggacagacgtctgcatctaatggtggcattgggttcacaggagacaggcccatctgagggatgtggatggcataggctgtactttgtggcccaaggttgtccccaaccaagtcaaccaaggtggmttctctggtgcagatttgcgggcagtggtttgtcatttctttcctgtctctgtgactcactccttgttttgtagagctgttctttaaaatcccttgagtgtattaatactttccatttcattgttcatttggcgaaaatcattcttaataagtacattctcaagtgcagtgcccagtgtttgkttttcttgcacattcttagagcctaattttgcagcttacaaaattgtataaatctgtctgtataatacacgtggaacattcctctggatttattggcaaggaaggttgaagcccaggtttggaatccgcaaactaaattttaaccctagctttggctttttattttcttttaagcagacttttttcccttagaaaagtaattcatgattattatagaagcataaagaataaggtagaagaagatctatccagaataaaccacttttaacatttttgtattcttttctatgcagatttttaaaaactattatcttaaaatagytaagataattattattgtctgtagctttgccataagattataactaaattttctataaaaattaaatggggagctttggtttcagtggttacataacawttcatcawttaactgkgccmtaatttaaaccattctcctgcagttggacattaagawtgkttccaactttttactttcataaataagtctgkgatgaacaattttgktcctcttacctgkgtacctggtaagtctttgttatagatgtcaaaaaatagaatgaaagggtattgatatggtttgtctgtgtccctacccaaatctcatcttgaattgtaacttctacaattsccacatgtcatgggaggaaccctatgggaggtggttgaattatgggggtgggattttgctgtgctggtctcgtgatagtaagtctcacgagatctgatggttttaaaaatgggagtttccctgcacaagctcccttctcttgtctgctgccatgtgagacctgcctttcaccttctgccatgattgtgaggcctccctagccacatggaactgtragtccartaaacctctttcttttgtaaattgcccagtcttaggtatgtctttatcaagcagcgtgaaaacgaactaatacagggatcaactgtgtaaagctcctatgtgtgctgacagattgctttccagaaagttggtaacaatttgntcacatgtcatggctgagaatgctactttcattctcctctgtgcggcaaaaattgtttgcaaaatcttagtcagtgtgataggtgagcagttgtgnyttggntttcttactagggaaaggtgagcattttccttcattttttgtagaaggctgaaaaacacaaaaaaaactatccatccaaaatgctaccactgaaaagaagytctggaaatgtagaggtaaatgtctaacctagttctgcttccacacttcagaggcagacacagtgaacaggatcctgcttccccagccatttcctagtgcttatgcatcataaacacatttgtgttttctaaaaccaaaatggaaagaggagacacaaggtagtctataattcaccttttctaaaaacattattttatgatggaatattttagacgagctcttcgtggtttttttttttttttgcttttgcatttgtttcatgaatttatatttcatgtcctttgcccatttttcttttgaatgttttattctctgtaagagcactttctgygttaaagatatcaactctatcaaatattgkgtatcagagatttttcttagtttgctaagaaactaagcaaacttagttattgcttatttgattttacttatacacagygagtggctttaagaatgacttttgcagtaagtttgtgatttctcttctttgatttcttcctttgcttttagtaaagcttaggaaatgtttctccacactgccatctgtg

SEQ ID NO: 2018 - DNA, 737 bp, Homo sapiens
  misc_feature (1)..(1): n equals a,t,g, or c
  misc_feature (722)..(722): n equals a,t,g, or c
nattttataaaaagtacagtttaacattccatttaccttgttactttttgactacaagtctttgcttcccttgccagtccctcttcccagttcttgaccaaatacacctaaaaaaggaatgtcacatttatggaactgtgtgatctttctttgaatctggtttaacattaaactatgggttttttgttgttgttctttgtgataagttccacctgctatacactgttagcgcaaagtatttttttggaacacttttgtattagttatggaaataaattttacacattgattaaaatgtagagaaacattcattgagattactcagcaagtcctgctggactagaagctgttactttctgtaaaatgactctaaatatctttgctttaaaccactatctactgtttcatagtttaactccaagagcagtttttgtttgttttccctaagctcttagataaatcctcagggatatctcagtgcttgacatattgtattataattgcttgtttgtctatttctcccactaaaaactatgggatgatggtgagaatttcacagcaggaaagattgggaagtttaaggatctgaacaggagttaggtaggaaagtattacatgctatgatgtagctgtatataccaccaaaaattctaccttagaatggtttaggtcactgaatttcataattttacaattatttcatatccctttacataagaatntgtatgttgcaaggc

SEQ ID NO: 2019 - DNA, 699 bp, Homo sapiens
  misc_feature (661)..(661): n equals a,t,g, or c
  misc_feature (694)..(694): n equals a,t,g, or c
  misc_feature (696)..(696): n equals a,t,g, or c
tcgacccacgcgtccggaagcccccaacagccacgctcaccactgctcggacgaggccgaccacagacatgagtgcaggtaagtggctcctgctggtgatcttcagggatttgggatgcggagtttccaggacgtctccgcacttgaggagtggagaggagggaaggatctggagcctactcacagcctgctcctgctgttgcctcttcgtgatcttctagtggttcttggcgaaatcaggaaaaggcagatggagggttgtgtatggaaagggtggggatggaatccggagaaatggtttgcggtcttggctctgcctgtaacaacccgagtgaccttgggcaagtccctgtccctctctgggsctcagtttctccacctgtatttggaragggttggaatgggcactgaagtcctgtccagctctgaccttctgtgaagtgcactgttgagcagctctggaagcttctgttccagccatagccacacagaggagcagcaggcaggcatcaggcccaaactgctgctctctgatgggcttggaccccatgaaagtggggcctgctggatgcatttcctgggattctgtggaagctgatcaggttgctggggcaagtggaggcaggatagaagtgaagggctgtgggatggagaacctcanaagactccatctggggtccgggaaaggacagananggt

SEQ ID NO: 2020 - DNA, 1841 bp, Homo sapiens
cgacccacgcgtccgcacctgtcccctctgtgagctctgtactgttctccgtccctgcaaatagacatgatgtcaccatctggaatcattgtgtacgtctctgctactcctcacatcctgctttgtattttaatcactttcatgcttgccatcccttctattcataatggcagagtttgtgttttattcattttttagcatttggtagcatttagcactaatctgtccaaataatgaatgctcaataaacatttgtctaattaaactaaaacaggaggtcaggtcatttcacctttttccccatcacggactgcccttaagtctttccctgaacagaaattagcaaattgaagtaaggaaccgaggtgttagtagcaccacggactcttccactttttcaccttggcaatgggaaacatcctgggggcagagatggcagagggagcacatgggaaccgggcaaatgtgactaagagacagcgagtggtgacaaacctccacagggtcacagatgttggacatgataaattttgcttcatgaaaaattttgcttcatgaaaatgcattatgcattacttttacatgaatagctaaattgaacggtagaatacattgtcccacttggttaaatgtgataaaaggagattagtggacttgaatttgtaatcatggatgcacaccacaagggaaaagcacttgttccttctgcctcgtcactagtatcagtttgtggttgttacttccaatagaaatgcttcgaaagatgacccaagggctccaacaatgaccttctgaactccgttttactgactgtttaaaataatcctgcagcttcagatgtattgacttggatagaagccaacataaatcagacagtgtccctgaacaaaactgaatacttcacactcagtgcctggtagcctgtgtgttggagggattggcggcagcttctctgctcctggtttgtgctgttttcatgcagagatagcaacagtaacacgactaagtgaccatggctagggaaacagcctcacattggcaagtgtgaaaggagccaaaatatggccaggcatggtggctcacgcctgtaatcccagcactttgggaggatgaggtgggtggatcatttgaggtcaggagttcgagaccagcctggccaacatggtgaaaccccatctctactaaaactgcaaaaattggctgggcgtggtggtgggtgcctgtagtctcagctactcaggaggctgagacaggagaatcacttgaacccgggagatggaggttgcagtgagccaagattgcaccactgtactccagcctgggtaacagagtaagactctgtctcaaaaaaaaaaaaaaaaaaaaaagggggagccaaactgtgttctatagatgtgcacctgagtgtaggaagaaatttaatatttagggagaaaaatgttagatatatatttttacattccttgtgaacactggcattaatggatagggaaccttggttttcggggctctctgggttttggcattgaaaatctcttggctgggtgcgatgctcacgcctgtaatcccagcactttgggaggccgaggtgggcagatcatgagttcaggagttcaagaccagcctgaccaacatggtgaaaccccatctctactaaaaataaaaaaaaaattagccaggcatggtggcgggcgcctgtaatcccagctactcaggaggctgaggcaggagaatcacttgaacccgggaggcggaggttgcagtgagctgagattgcagcattgcatcccagcctgggtgacagagcgagactccatctcaaaaaaaaaaaaaaaaaaaaa

SEQ ID NO: 2021 - DNA, 1514 bp, Homo sapiens
ccacgcgtccggctgggcctgcctcggacgccgccggtgtcgcggattctctttccgcccgctccatggcggtggatgcctgactggaagcccgagtgggatgcggctgacgcggaagcggctctgctcgtttcttatcgccctgtactgcctattctccctctacgctgcctaccacgtcttcttcgggcgccgccgccaggcgccggccgggtccccgcggggcctcaggaagggggcggcccccgcgcgggagagacgcggccgagaacagtccactttggaaagtgaagaatggaatccttgggaaggagatgaaaaaaatgagcaacaacacagatttaaaactagccttcaaatattagataaatccacgaaaggaaaaacagatctcagtgtacaaatctggggcaaagctgccattggcttgtatctctgggagcatatttttgaaggcttacttgatcccagcgatgtgactgctcaatggagagaaggaaagtcaatcgtaggaagaacacagtacagcttcatcactggtccagctgtaataccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttcagtggcctttaggagtagcaacatacaggaattttcctgtggtggaggcaagttggtcaatgctgcatgatgagaggccatatttatgtaatttcttaggaacgatttatgaaaattcatccagacaggcactaatgaacattttgaaaaaagatgggaacgataagctttgttgggtttcagcaagagaacactggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcaccacggtgctcctctgcagttactcaagtccatgggtgctccctttatctttatcaagaactggaaggaactccctgctgttttagaaaaagagaaaactataattttacaagaaaaaattgaaagaagaaaaatgttacttcagtggtatcagcacttcaagacagagcttaaaatgaaatttactaatattttagaaagctcatttttaatgaataataaaagttaattatctttttgagctaaaaaaaaaaaaaaaaaaaaaaaaaaaaaaaaaaaaaaaaaaaaaaaaacaaaaaaaaaaaaaaaaa

SEQ ID NO: 2022 - DNA, 3632 bp, Homo sapiens
ccacgcgtccgattgtccctcttcctccactaccttcccatgcccagcaagttctaatggagtaggagccatggcagctgccaggagatggaaaagcaatgaaagtgggtgggccctctgcaagggagccagccagctgcaggtgcaggggagttcagaggacatgtgagcaggaggcagcccgcctcccacgcctcgatggcccagacatgttctccaaggttgggactcagacacccaccacagcaatgccctacggcccagaccccatcctctcaaacgtcctcctagccggatacattgtcctccaaactctcagctgtcccaggtgatcatgagtgaagcccagttgtgctcacttctaactgcagcatccattctaaggaaaatctccactcccctcctctaaacctcatggggccaacatcgcacagtctgaacaacaagtgagccatcttgaaaaggagggcggctgtgcgtgtgaatgagcagggagaaaatgaaacaggagccccaccttacccccagtcacctcactgaatagcaccaagccaagtggggtgacatcacttcccagcaatcgggactcatagatggtcacggtgggcctagttatctgttttagtgaatggtgctgtgcaggtggcctcagtgcagaacagactgtgtcagacaaacatattgatgcactgatgaaggagaaggaagctgggaaaagctccggtcattatgacccgcgacaccaagggcaggctctggaggagccatccgtgcacagctgcatctattatctgctaactgaacaaacacagaaggtatccaccagaacaagtctactcagatacaggtggccctgcgaggaggttggttggtgttggggcttagacttgacaggttgtccggtggtgattcagcatgaaggtgtggctggctctgagattattatctcagattatcccctcacaaatgaaaatataaaaggaatcccagaaatctgtttatttcatatttgaaatgttatgtagactatagatgaattttttttcttgaattatctggtgattaaaattgttattcttgttttgcttattatgtttttaagggatgataacgtttcaccctagtgtttcagggctgatagagacttagaagtcatctaactgccctcatcttacagacttaaaaagtggcatccaaattgatgaagggactccctgagtcacgcagcaaggtggcaatgaagtccctcagctcttacccctaccccatgcttgtgtcttcctgggcagcggtccccatcctttctggcaccagggaccggtttcatggaagacagcttttccatggtttgggggtggataggatgtaattcaagtgcattatattttttgtgcactttatttttattactacagtgtaatatatgatgaaataagtttacaactcaccataatgtagaatcagtgggagcttgtttttctgcaactagatggtcccatctgggtgtgatgggagacagtgacagatcatcaggcattagattctcataaggagcacacaacctacatccctcacatacacagttctcagttctcagtagggttcaagctcccatgagaatctgatgtggctgctgatctgacaggaggcagagctcaggtggtcatgcgagcaatagggagcagctgtaaataccgaagaagcttcgctcgcttgcctgccggcccctcctgctgtgtggcccagttcctaacaggccacaaaccacaacctatcaagaaaaactggcttcctaagaaacataaaattgtttctcttccctttcgctagtgcaattggtctaaatcgttttagaagtattgatagaagaaacaaacaggacaatcattagtttccaaaactttaaggagcgacatgtttgttggataattggatacctgaataaaaataaaaaatagcaaaagtttcttgttattatcactattacacagcagttcctatcattcatggagtacctagcaggtgccagattcagtactaacctctttacatatatatatatttttttattttatccttaatgcagccatgtgagattagcatttttctgactttacagctgatgatgttaatgtataaggttgaacatctgtccaaagtcagttgaccaacaagacctgccatgggcaatgcaagctcctcctggtccacacacactgtgtcctgctctcacgctctctcccagcaccttctcacccagggtctgactgtaccaaggagctccctcacggcccttggtcctcctggcctctctcatctgtctcatgatctgggcaccctcctcagctcactttctcatcccagtccccacctgaacatggcgctggctgtcttctgctccccgcatctctagcctgcacctcctctcttctgtcctccgcttcgcacctatccaacatgcattttaattgcattattgagtgcttgaaagaactcgtatcactccctgtttcctgggtcaaaatccagagtcccatcattcatccacgaggttgattggaccccgccggactctccactctgacctccacctcctggcccagccccactctatgctccagcctttggggtttgcttttgttttagttttctgagcccctggtgttcttacatatgttcatgtctttcgcagattgttttaattgggatgtattgaaatgctttgttccttccagacatcctttacatatctgtgaaagctcatcagcagcctcacctcttcctgaaagccttgctagcacccgtgcatgcctgccctctgtgtacaggacatagagccctctgcacgtttttattatgggatttatcacacttcatcctttcattccgcaaatgcctattgagtgtctatgacatgccaggtgtttggtgcatggtgtacacaggagtgagaggttctaaaatggtatttgtgacttgtctaaatcccttgttagagcataaagccttggtgtgaagatctgtgccactcatctctgaactccagcatagcccatgacccaaaatagaggagttgcccaaatagtacacactggtcagggtcatgactgaatgatcattcactaccccagatccaaagcccaagctagtcaaggtgtgcaggagcccccctgcagaataatgggccagtgagagaggccacacctctcaccctgcagaataatgggccagtgagagaggccacacatctcaccctgcagaataatgggccaatgagagaggccacacatctcgttctgcataaatggagtatttgcctgcggtagtttgccactatgtctcccctaacccacctatttttttgtagtatatatattatttctacaacaaaagtgaatttgtaatgtagctttgaaaatcattctttctcaatgagaacacttggaaacaggatggggaaaatcacacactggggcctgtcgtggggtcggggaagcggggagggatagcattaggagatatatctaatgtaatataccaacatggcacacatatacatatgtaacaaacctgcatgttgtgcacatgtaccctggaacttaaagtataataataataaaaaaaaaaaaaaa

SEQ ID NO: 2023 - DNA, 2114 bp, Homo sapiens
  misc_feature (2108)..(2108): n equals a,t,g, or c
ggctaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggaaaaaaaaaaaaaaaaaaaaaaaaaaaaaaaaaaaaaaaaaaaaaaaaaaaaanaaaggg

SEQ ID NO: 2024 - DNA, 508 bp, Homo sapiens
  misc_feature (436)..(436): n equals a,t,g, or c
  misc_feature (475)..(475): n equals a,t,g, or c
  misc_feature (478)..(478): n equals a,t,g, or c
  misc_feature (493)..(493): n equals a,t,g, or c
gagtttagtagcttttaaccttagatgctttatttaactgatgttttctttatatcatctgtaaaatgagtcaataattgacctaccttgttggattgtwataaacctagttgatataagtaaattggaacaatggctgccacagagtaagcaggcacttcatgttagctattaaagtattaatagtagtatttctgttgcaattatcctggtgttttcttttagtattactctttcacagtttaataaaggggacaatgatagacataccagcaccttataaggaaatataatctaaaataaatggaaattgaattatctctgaaaataaaaattcataggacggtactcagcaagtgaggcagaaacatttctaacattttaaaakawtttgctttackattaaaatrttaatattgtttactacttgatagtnctacaggattagcccaatctctaccctacaaaaacagtnaanctctggagggaaggnctctaacatatagta

SEQ ID NO: 2025 - DNA, 1003 bp, Homo sapiens
  misc_feature (422)..(422): n equals a,t,g, or c
  misc_feature (700)..(700): n equals a,t,g, or c
  misc_feature (758)..(758): n equals a,t,g, or c
ggtcgacccacgcgtccggaggcccgcagcccgggcggcgcagggtagagcgccgcggacccggccacgcagcccggggactcccgggccctcccggagccccgcggggtccccgccgtgcatccggcgggctcagggagcgagtgggagcgccctccccccgctgccccctcccccgagcatcgagacaagatgctgcccgggctcaggcgcctgctgcaagctcccgcctcggcctgcctcctgctgatgctcctggccctgcccctggcggcccccagctgycccatgctctgcacctgctactcatccccgcccaccgtgaagctgccaggccaacaacttctcctctgtgccgctgtccctgccacccagcactcagcgactcttcctgcagaacaacctcatccgcacgctgcggncaggcacctttgggtccaacctgctcaccctgtggctcttctccaacaacctctccaccatctacccgggcactttccgccacttgcaagccctggaggatctggacctcggtgacaaccggtacctgcgctcgctggagcccgacaccttccarggcctggagcggctgcagtcgctgcatttgtaccgtgccagctcagcarcstgcccggcaacatcttccgaggcctggtcagcctgcagtacgtctacctccaggagaacagcctgctccacntacaggatgacttgttcgcggacttggccaacctgagccacctcttcctccacggganagcctgcggctgctcacagagcacgtgtttcgcggcctgggcagcctggaccggctgctgctgcacgggaaccggctgcagggcgtgcaccgcgcggccttccgcggcctcagccgcctcaccatcctctacctgttcaacaacagcctggcctcgytgcccggcgaggcgstcgccgacctgccctcgctcgagttrctgcggctcaacgctaacccctgggcgtgcgactgccgcgcgcggcc

SEQ ID NO: 2026 - DNA, 1197 bp, Homo sapiens
cccacgcgtccgattgggaaaaggctgtcgttaatcacttttagcagcagaaattttttattttgtgtgatgtcactgttccatgttgaagagtcatggagatgtacaaaatgtattgaccttatttgttactgtgcttagtgatgtgtcatatttgcagcaaatacaaaaaaagttaagaatgcatgtccattgttttgctatacatgttttatttcatttctgctccacaatttcagcagatgctctttcattctgtatattttgctatggaccacagaccctcattgacatgtattggaactcctaagaccagtgcagtgctccaagtatctatgaatcaaatggcagtgttcacatgcttttctcccataacttataaagcagaaggtagttttctttcccatcacaatagccattcttttccttatttttcatagttattttcttattaagttatctgtaaaaataatgcatctctgtcatctgctagcaggccattgttcgaggttaaaatacaaattaagaagaagcaagcaaataaatcagatctggaaacgaagttagagatttttgcacaaacataatacttacaacagtttcataaaagccaatttattatggctactcttaacaattcctttaaagttaaaaactactataggcgatttgtctattattcactctttgtttttataattttgttaggtttcttttattcaagttactttatgtaaattacttggagttttatttactgaaaatcagatttcatcatttctcccccagttttctaactggctttgatttttgtttcttagcttgattgcttgctagtttttaaatgaggtaaaatatagattcggtgagatgcacagatcttgagtgtgcagttcaattgattttgataaatacacccatgtaactgccagctgaatcaagataaagaccattctcattactccagaccttcctgtgtttcagtagctttgttcacatgttcggcagcatgtgagacgaagttacctaagccgtaggcaattttatgtgattctgcatagtagtcaatatggtgataatgttactttcatcagaaggctcaaagtaatggacctgaaaagcaggaaaaagaaggggttatccagaacttcaagagaactctctcaaagaaagaaaagaaggaaaaaaaaaaaaaaa

SEQ ID NO: 2027 - DNA, 3289 bp, Homo sapiens
cccgggtcgacccacgcgtccggcgaggaccgcgtccggcgcagtcttcaatgagcagcgcggaaactgcaccccagacccgagcctgctgcgcgccccctcccagagctcacctggtgccaggtaacaggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctggggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgaaggcttccctgggagcggccggccaccgcccgaacaagcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggcatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctgctgccctgagccaacgccttcacggacctccctagcctcctaagcaaaggtagagctgcctttttaaacctaggtcttaccagggtttttactgtttggtttgaggcaccccagtcaactcctagatttcaaaaacctttttctaattgggagtaatggcgggcactttcaccaagatgttctagaaacttctgagccaggagtgaatggcccttccttagtagcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctcttacccctaaaaaaaaaaaaaaaaaaaaaaaaaaaagggcggccgctctaga

SEQ ID NO: 2028 - DNA, 2343 bp, Homo sapiens
acgcgtccggtttttcaaaggtttaactgtccagggcagatacttaagactatctgatcatccattaaaaacttttcacatagtcttgcttaaatggatccattatgtttacccattatattgttctcagctgtagttttaagaaatttatttcatttgttaatacttactttccattaccttccccttttctgtgacaatccgttgatacttgaagacctctcttgtattcatcttagggttaatatttttaaggccaaacagcctaaattctatggtaatcaactccagccttgtgtaatgaaatcttctgcataaagataggtttaaatcaaatcagattgcagattttattgaagaaattgtgtttttaagagttgacaaatatatgttgtatggctaaaacaaagaaaatacttctgttgcttctgcatttagtagaagaaaaactatatatgtttgtgaccaaagtataaaatatgattctttccagggaggtaaaggttatgcacaagattttcactagcagctctaaaaggctaccctcaattaattgccatgaacatttcatagccctagaaggatgtaggctcatttcagtgtcatcctggtttattctttattgtattattcagcagtcattttaacactatgctagacactttagagattcagaagagtaacagggtttctgttctcatgaagcttatcaggagacagaaaacatatgaattagatctaattggaggcaaactgaaatatatagtggagttagtgtggttatcagcacataaatgagtgatccatcaacaaaaggagaaattgggagggttttatgggccaaaaacagcatgattaaatgtgatagagtatatgtcatgttttaggtgtgatgaacattcagttatgtgtgacgaataggataattgaaaaaatatgaaaggctatgatgccagaaagtattatgggacaagatcttaaaaccagtgttacctagggagtatgaatttaatatgggaattcttaaactcctttatgactggaagatgagcatcagagtgtctgcgaccattttgatgatatgatgtaccagtttttaaatgtttggctttttccaggtgatgaaagcgggggatgagttaagaaccactgctgtgaaggattcacaactatttttaggcagttgggtaaaaatgaccaatttagttttaagaaactgactgtggctccagagtatgttggagaagtgaaaatggagactaggaataacaggtgggagactattagtctaattaagatgtaattataaatctaagctaggaacgtaaaatgagaatgcaaagtaagaaacaaatatggggaaaattatatgtaaaagtaataggacttggcatcttactgatgtgattgattatgagaaaaatgaagcatgtggaggagtccactggacagtaggaaattcagcctaagacttgggtaagagttctgtggagttgtgaattcagaggccagagatgtgatatttaaaattttggttcaagatttcccaggtataagaaagcaagaggattaaagcattgtaattaaactttaagcagtgcatatttatgttatagataagataaacaagaaatctagggatcaaataggattaaaattagtagtgatcattcagtacagtagttacgtactgttattcacaagagtatataaatcaaattacaaggaattaaggatataaacgtgataagaaagtatgcactgtactctttgaggaagtttgccatagaaaggaagaagaaataggatggtagatcagaagtaaagcaggacccagtggggggagtgtttgcagtgaggcagtatgtataatcatttaaaacatgggtttggagtcctctcaggttccatgtttgtaatggacataatgataataatccctttcatttaaggctgttgtgaggattaaatgtgttaatgtgcaaataactttacacagtgcctggtatataataaatgcttgctacctattaactagtatttgtttctaaggctaatttaagtcctagaattgattgcaaggattagatcaggagtatagtggacatgttgggatttaaatatttaaatatagagatgctttttaggaccattgttagaaccagaagagattttttaccaagttcacacagaaatgtaggtgcattggctgggcatggtggctcacacctgcagtcccagcacttgggaaggctgaggcagaagaactgcttgaggccaacattttgagaccagcctgggcaacatattaagaccccgtctccaccaaaaaaaaaaaaaaaa

SEQ ID NO: 2029 - DNA, 1470 bp, Homo sapiens
ggaattcccgggtcgacccacgcgtccgcggacgcgtgggcggacgcgtgggtggacgcccaccatgccgccccgagggccagcctctgagctgctgctgctgcggctgctcctgctgggggcggccaccgctgctcccttggcaccgagaccctccaaggaggagctgacccgctgtctggcagaggtggtcacagaggtgctgaccgtgggccaggtccagagaggaccctgcactgctcttctccacaaggagttgtgcgggacagagccccacggctgtgcgtccaccgaggagaaaggcctgctgcttggggatttcaagaagcaggaggctgggaagatgaggtccagccaggaggtgagggatgaggaagaggaggaggtagcagagaggacccacaagtctgaggtccaggaacaagccatccgcatgcaagggcatcgccagctccaccaggaggaggacgaggaggaggagaaggaggagaggaagagggggcccatggagacctttgaggacctgtggcagcggcatctagagaatggaggggacctccagaagcgggtggcagagaaggccagtgacaaagagacggcccagttccaggcagaggagaagggggtgcgggtgctgggcggggaccgcagcctgtggcagggggccgagagaggcggaggagagaggcgcgaggacttgccccaccaccaccaccaccaccaccagccagaggctgagcccaggcaggagaaggaggaggcttcggagagggaggtgagtagggggatgaaggaggaacaccaacacagtttggaggcagggttgatgatggtcagtggagtcacaactcacagccaccggtgttggccctgcaccaccagatccatcactagtggatcacagtggccaagactgacaccacgactggctaacaacttccgtgcaaggcctttaccttatacttccacactactgtatggactacagcaaccaagatggcaccattgcacagaagcaagccaccatcactagcaagttggccactgtgaaaagtggctgctgtgcctacttcactaggtgacagacagacaccattgctgggtcatggaaaacaagatgtcaccatgattggtggcaccaaaagtgccgtaacagggtgggcatggtggctcacacctataatcctagggagggttaatcctttcagaggccaaggtgggagaatcccttgaggccaggagtttgagaccagcgtgggcaacatagtgaaaccgtgactctacaaataatttaaaaaattagccagcaatggtggcgcacgcctgtggtcccagctctcaggaggctgaggtggtgggattgcttgaacccgggagtttgaggctgcattgagtcatgattgtgccacagcagtcccgcctgggccacagagcaaaaccatcttaaaaaaaaaaaaaaaaaaaaaaaaa

SEQ ID NO: 2030 - DNA, 1053 bp, Homo sapiens
attacggaatacagtagacaccatgtaaccccagtcttaatatttaaagaatgttaatgttgtcacatttctatcttttgtttttacatgagaagtcaaacattacattataagtagagctaaaatccaacctctccatcccctttccagagctaatgaggagcttgattgtaaatttgttgtatatcagctctgtgcatttwaaaatatattcatcccttatctgtattggtaacaatgcttattaatgtttatctgtttattatttttgttttcattcagcttttgcattcctcatttctgagattaggtcatgttgatacatacagtaattaaattgctagatagtatttcgtcaaattcctttactacttgtgtgtacttaatcttgtttagtatttttttattgtttcattcaacaatatgttctgagattgagtcatgttgatacatatagacaattttatttttattactatagaaagatctgttaaatgaatatagtctatttaccaacttcaacagaattataatataattagtttttagctgttagagactctactccagtgaacctgtttcctcattcagargaatgtatagtttatgttctcagaaacagaatttcatggctgggcataatggctcatgtctttgggargccaaaggtcaggartttgagggcaacctggacaccacagcaagamcccatctctacaaaattttttattaaaaattaaccagggccgggtgcagtggctcatgcctgcactttgggaggctgaggtgggcggatcacctgaggtcaggagtttgagaccagcctgaccaacatggagagaccccgtctctactaaaaatacaaaattagccgcgtgtggtggtgcatgcctgtaatcccagctgctcaggaggctgaggcaggagaattgcttgaacccaggagacggaggttgcaaagagccgagattgtgccattgcactccagcctgggcaagaagagcgaaactcggtctcaaaaaaaaaaaaaaaaaaaaaaaaaaaagggcggcc

SEQ ID NO: 2031 - DNA, 1014 bp, Homo sapiens
ggtcgacccacgcgtccgaaacttaaaaaaatgtggccaggcatagtagctcatgcctgtaatcctagcaatttgggaggccgaggccggaggatcccttgaatccaggagttcgagaccagcctgggcaacaaactgagaccctcatctccatatattaaaaaaataaaaaataaataattgtttttttaaaccacacaaaaaatgtataaacatgtatcccctgtactgcaaaatcttgctctcattcctattccttctgctctcttccaaccatacctatgtagctaaccacatttattcattctggctcattctttatatgtttcttcttgcaaatataagcaaactgtatatatttaatattcttacttacagaaaatgtagtatatatactcctttgcaccttgtatttttgtttgtttacttaagaatatattccagaaatcattctacattagttcataggcatctttttgactattattatggccagtttcttaaatggctgcatagtactctgttgtatggttggatcttgctttagtcgaccttctgtaaatgggaattattatggagatgtagctttagagtaaattcctagaagaatgattgctggtcaaagagtaaatgcatatgtagttttattagatgttgtcaaatttccttccatatgagcagcacacaatcacttttaaaaggcacttttttggccgggcgtggtgctcacgcctgtaatcccagcactttgggaggccagggcaggaggatcatgaggtcaggagatggagactattctggctaacagggtgaaaccctgtctctactaaaaaatacaaaaaattagccgggcgtgttggcgcatgcctgtagtcccagctactcaggaggctgaggcaggagaattgcttgaacctgggaggcagaggttgcagtgagctgagatcgcaccactacgcgccagcctgggcaatagagcgagattcgtctcaaaaaaaaaaaaaaagggcggcc

SEQ ID NO: 2032 - DNA, 2026 bp, Homo sapiens
gaattcggcacgagcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggggaaaaaaaaaaaaaaaaaaaaaaaaaaaaaaaaaaaaaaaaaaaaactcga

SEQ ID NO: 2033 - DNA, 1498 bp, Homo sapiens
cggcacgaggcgtcgcgtccgggttgtcactctctcgggttgttactctgtagcttcccggctcgcgaaagggaggacctgtctgggtcatggattttgagaatcttttctcaaaaccccccaacccggccctcggcaaaacggccacggactctgacgaaagaatcgatgatgaaatagatacagaagttgaagaaacacaagaagagaaaattaaactggagtgcgagcaaattcccaaaaaatttagacactctgcaatatcaccaaaaagttcgctgcatagaaaatcaagaagtaaggactatgatgtatatagtgataatgatatctgcagtcaggaatcagaagataattttgccaaagagcttcaacagtacatacaagccagagaaatggcaaatgctgctcaacctgaagaatctacaaagaaagaaggagtaaaagataccccacaggctgctaaacaaaaaaataaaaatcttaaagctggtcacaagaatggcaaacagaagaaaatgaagcgaaaatggcctggccctggaaacaaaggatcaaatgctttgctgaggaacagcggctcacaggaagaggatggtaaacctaaagagaagcagcagcatttgagtcaggcattcatcaaccaacatacagtggaacgcaagggaaaacaaatttgtaaatattttcttgaaaggaaatgtattaagggagaccagtgtaaatttgatcatgatgcagagatagaaaagaaaaaggaaatgtgtaagttttatgtacaaggatattgtaccagaggtgaaaactgtctgtatttgcataatgaatatccttgtaagttttaccatacaggaacaaaatgttatcagggagaatactgcaagttttctcatgctccactgactcctgaaacacaagaattgttggctaaagttttggatactgaaaagaagtcatgtaaataaaatagacataaaaaggtagcaatgtacagataaagagtactttaacgcccatgcgtgttcaagactgttcaagactggtgatttggagtagtttacaagattcctcattcagagtgccctcttgtgtgactggggtgatgtgcagcttccataatggatgggacagagagctgggatctaatgtacaagtgaagggcttggtcttccctgagacattccagccattggaataggagaggagcatatatggcagaggtgatggctggtgggtaaatgtgatagtaaattgtagaaacctcttctgattgattggatttccttaataaaatcggaagcaaggttaggctgagtgagggtgagtaaagaggtagaggaggtttgaggagagagaactgctcggaagacattggtagatggaccataaaaacagagttagttctctttatgacattaaatagttttacaacatatttttaatggttcacaatttcattttagggcttaaaataaattatggttctatgattttttta

SEQ ID NO: 2034 - DNA, 699 bp, Homo sapiens
  misc_feature (2)..(2): n equals a,t,g, or c
  misc_feature (28)..(28): n equals a,t,g, or c
  misc_feature (44)..(44): n equals a,t,g, or c
gngttttttccagccaggaagtgaccgntactgcagcacgaganagattggttgggttggttgraaatgacyctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataawkccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaaaaaaaaaaaaaaaaaaaaaaaaaaa

SEQ ID NO: 2035 - DNA, 1095 bp, Homo sapiens
  misc_feature (107)..(107): n equals a,t,g, or c
  misc_feature (202)..(202): n equals a,t,g, or c
  misc_feature (556)..(556): n equals a,t,g, or c
cccgggcaggagggtcagggccagatggaggggccaccaaggacatggggaagatgctggggggtgacgaggagaaggttttgcttcttacgaacgccacggccgtnttcacttctaaactaaaggaaacaaagcaataggtttgggggacgcccagcccccacccccgtcaccccgctcttcccaagtcctcgccccccgnccggcctcctagcctctccgcccacgcggctgctgcttctccctggggaggacccctgccctcggccattgaacactgcaccctccacaggagccgcagaggcccgaggcaccggacgctggagaccctgcgcccctgcccagcacctcctccgtgggcagctcctcgggtggggcctgcggggttccctgcgcgcactggcgcgtgtgtggcctaatccacctggtggccctgcggggcggcatccgagcccctgtttctcctccattcatgtttaatttgcatcacaatttgttgaatctcaggtaaatgaggtctttgcatttaatgagttttatcttgacaggcgccgcntcgcccccgggccctttcgtccacakcaaaaatgcatcaagtctccacgtgtttcgggccagggcgtggcttggcattgaccttcatgaccttacatagctttagagaagccataacgttagactgcaatactaacgaccgacgcccctccgggcagagaccaccgcgcccctctgcgccccagcgacgcggcccgcggggacgtcgctgtccgtcctgctcgccctgtgccctctcactgacttctcccgggtcgtgtcttttaaaaactcctgttttcacaccttacaaagccagctctgagcagacagggcgtcctctcgtagaacctgcgcaccccgttcccagcgcatggcgccccgggccgcgagcttagcttagaccgtggtgtcctctgtccgtctgtcctgcgcctgcgcctcctcctgcatgtcggggcccctgcgtgtgttctctccggatggaatcacagccaataaacaccagtgatttcaaaaaaaaaaaaaaaaaaaaaaaaaaaaaaaaaaaaaaaaaaaaaa

SEQ ID NO: 2036 - DNA, 928 bp, Homo sapiens
ggcacttcatctaaagtagtaactcagaaagtgcacttatcttctgttgaatttcctttcatgtcagcctctctaaaaaaccacctgacccactgctttttgctattgctgcttaaagagcttgtttcccccaccatgattagctttgtgcctacactaaggcactcctacagattcttcaacctcttctcatgtgatgcagaaagtacaaaggagagccctggccgaactgtccagtttagtaaaacacccagaggagtaactatgtttatttagggtgtttcagagcttgctgctctgcctagtctattgtaagagctctgaaattattagagcttttcctaaaaatatccacacttggatgtgactcagtcatagaaaaacaactgacccaagaaacagagagtctgagttttggttcttggtttgttttgttcttattgtgttttcattttgttgcatgaaacatgaaacctccggtcttgggatagatttgagtcctgactcagccagtgataagttgtttgaccttgggtgagttactaaacttctctggggctaaatttcttcatctaagaagtggattagatacagcaacatattatagttcgaagcttctggctggacgttgtggctcacgactgtaatcccagcattttgggaggctgaggtgggaggatctcttgaacccagaagttcaagactagcctgggcaacatggcaaaaccctgtctctactaaacatacaaaaattagtcaggcatgatggagcatgcctgtaatcccagctactcaggaagctgaggtgggaggatcgattgagcccaggagtttgagattgcagtgaaccatgattgaaccactatactccaacctgggcaacagagcaagaccctgtctcaaaaaaaaaaaaaaaaaaaaaaaaaaa

SEQ ID NO: 2037 - DNA, 1036 bp, Homo sapiens
  misc_feature (1020)..(1020): n equals a,t,g, or c
  misc_feature (1024)..(1024): n equals a,t,g, or c
  misc_feature (1032)..(1032): n equals a,t,g, or c
tggaggcagatgcacaggagaaaggttcccgtccgcaccctctcagacctgaggctgagcttgcagtgagggcttctcctcggcccctcgcccgcccccagagctgccatccctgctgttacaagccagaggagcccggatgtgaggccccagatcacctccagggacttggggttcccatctgaaatcctttatttttgtaccatggggtgggccccgggctgagaaggaagaagcaccctctccccggcctcctctgtctgcacccgtggggctgtgacttactcctgcctccaggggcggggcggggccccctgggacctcttaaggcccaaggtgggccccaggacctytgggcagagtggaytgctcatggcagatgtgtggcaatgtctggctgwgtctttccggcamctgcgtyccctytcccgggytcccctgctgcatggtggatgtgctccttcctggcccggtcacattgcctccttgagccttagtccagggggtcactyctcccaccccacctacctcacagggttgttgtgagggtgcacagaggagcaaagtccctgaaggccctcaggcagtatataggggccgcccaccttcagctgccctgggatgggaaggacccagcccgacccctgggcataacactgtgtttgcaaatggagattcaggtattggggatgcaggttgtggggagctggcctggcagagtaggggtagttggcttggccttctctttggtgatcccacccccagccatttgcattgctggcccagcgcctggcctggggggcggggagaggcagcagaaggggctgggcaggggcggtggaggactcaggaactgcccggggagagtgggtatggcggctgagccaggggccctcctgtgtttgacttcccgggatgggtccttgcttctcagctgtgtccgaccccaccatgtaataaaacccaaaggaacagcaaaaaaaaaaaaaaaaaaaaaaaaaaaaaaaaaaaaaaaaaaancccngggggggncccg

SEQ ID NO: 2038 - DNA, 1014 bp, Homo sapiens
aattcggcagagattaactgaagttcagccacctgccactcctgactgcatggaagccaggtgcaaggagaaaggattttraggaggggactccatggcttccgagttgctgactgaccctccacctcagaggtagttctgacactgtctcagttttgcagatgaagatgagattcttcagttctccatgtggaaaagcagctgtggacccagccgaccgctgtaaggaggtacagcagatccgcgaccagcaccccagcaaaatcccggtgatcatcgagcgctacaagggtgagaagcagctgcccgtcctggacaagaccaagtttttggtcccggaccatgtcaacatgagcgagttggtcaagatcatccggcgccgcctgcagctgaaccccacgcaggccttcttcctgctggtgaaccagcacagcatggtgagtgtgtccacgcccatcgcggacatctacgagcaggagaaagacgaggacggcttcctctatatggtctacgcctcccaggaaaccttcggcttctgagccagcagtaggggggctcggcctgggagtcggggggccccggtcaggccctgcccagagagctcctggttcctgaactgagctgcctctaccgtggtgggctgggcaggcatgtgcccccctagtcagagggcaccaacccacctaytctgcccctgggtggatcctgggccggtcgtgttagggttgtccctctgggtgctggctggtgggatgggggagggtggggagcagctcccagcacccctgctgtgtggttcatcttttttttaggcccctgcctgtctgcccatctgcccctcacccacccgaggctctgcccaccgcctggacctgcccacccctgaaagactggcccctggctccccgcccctcggtctccacgtggtgtatggatctgtggtcattgtccctctgcagaataaagattgctcaggcctgcctggaaaaaaaaaaaaaaaaaaaaaaaaaactc

SEQ ID NO: 2039 - DNA, 685 bp, Homo sapiens
  misc_feature (491)..(491): n equals a,t,g, or c
  misc_feature (661)..(661): n equals a,t,g, or c
tcgctctctttctttctcttcttctctctgtttttaagtcaagtattggtcaaaaaaatgcaatcttctgttttttgttcagcagacaatcattttcttcgtaagcacctttttctctccactctgtcactgcctgtgtgggtactggttataaatgtggaaaaagaatagttatgactgtaacagatttttatttttatttcaaaattttatatgaattatgtatatcttaatgatcggtcattttcccagtttgtaatatatgtgtagaaattgcctgtatatgatattgctttttctcctctccctttctctttctctcctctccctctctctgtctttctccccgctcaactgtctcttttctttttggggttctcctcccactcggtgctcctggtgtcgacttggcagtcaaggagaggcatggtggcctgggttaggaagagggaccctgtcgctagcaaaagcggagagtgagattgtagtantcttatgcaaaagctatttccagtatttcttagcagcttcagaggtatctctcactccctgtagggcgcttttactgttatcttaaactgcgtgtttatctatatgtaaaaactttctaaagcaaatacagtattctccattttcttatcaaaaaaaaaaaaaaaaaacncgagggggggccgtaccattcgcc

SEQ ID NO: 2040 - DNA, 1959 bp, Homo sapiens
ggcacgagcgtgatcatcgggatgctcgtgctcctgctggactttcttggcttggtgcacctgggccagctgctcatcttccacatctacctgaaggccaagaagatgaccacctttgagtatctcattaataaccgcaaagaagagagttcaaaacatcaagcagtgaggaaagatccatacgtgcaaatggacaaaggagttctccagcaaggagctggcgccctgggctcatctgcacagggagtcaaagccaagagctccctgctgattcacaagcacttatgtcacttctgcacttcagtaaaccaggatggggattcgacggcacgggtgcatttgtgagtcccctcagtgtctctgcagcttctatgtgtggatgaatagtgaagccacatgaggcctggtctgaagcagagaagatccgctcagcatcatgttgaatcccaagcccgcgtctccgtgggctccaggacaatcctatgaaagtgacaccgtcgttcattgttcacatcggggaggagaattccatctgaaaatgcacgtgacttcactgacacccgcgtccgtggcacagccctgtgctgagctccacagacctacagtccatcgcctccccttggagtgggcccacagctgcagacagtgttgtccaaagaagatgctctgagtagatgaatggaacaaactggaaactccagaaacaagcccttctttacatttctaatgtttggcttaaatggaaggtgccaagagccaaggccaggaactcccggctgatttgcaggcgcctgtgtcagttctccactcgtgtacacccagacgggggctcgatggcacaggaagcagatgatgccccgagtatatctacacttgggctgcaacaagaaacaacagagcccatgaaaactgacagtgctgaaagtgaagactgagattcaggagctcaggtgcccctgtgatccaggtcttctaccctgaaaccccaccctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccaggaagatgggctgccagcaactgcagaggatgcagccacctgcttaactgtgctgtccagccagccagccagctgcagggcctcttgctgcttaagagctgatgggccgggcatgttggctcacacctgtgagcacagtactgggaaatgggagcacagtactaggaaatgggagcacagtactgggaaatgggagcacagtactgggaaatgggggctcacagcactgcaaaatgggagcacagtattgggaaatgggagcacagtactgggaagtgggagcacagtactgagaagtgggagcacagtactgagaaatgggagtacactactgagaaatgggagcacagtactgggaaatgggcatacagtactgggaaatgggcatacagtactgagaaatgggagcacagtactgggaaatgggagcacagtactgggaaatgggagcccacagtactgggaaaggggagttcacagtactcggaaatgggagcatagtactgggaaatgggagcacagtactgggaaatgggagcatagtactgggaaaccccagacctggattctgagtttttcagcctagcccagacttcttatcttagtagacaaaaagagtcaataccagagaaccagaggcatcctctgtattttaatgaactctgcattttaatctgtttagtagtcattttttaaaagataatcagttttccaaatatatctataagttactacgtgcaaaaaaaaaaaaaaaaaaaaaaa

SEQ ID NO: 2041 - DNA, 1543 bp, Homo sapiens
  misc_feature (69)..(69): n equals a,t,g, or c
  misc_feature (717)..(717): n equals a,t,g, or c
  misc_feature (899)..(899): n equals a,t,g, or c
gagcgggataacaatttcacacagggaacaagctatgaccatggattacgccaagcttggaattaaccntcactaaagggaacaaaagctgggagctcccaccgcggtggcggccgttctagaactagtggatcccccgggctgcaggaattcggcacgagccgaacagtaggacatgtcatggcatttttgctcacccttgttccactcctccccagccgttgtcttggtttggaggagatggcagttcctaattccacctgtattagtccattctcatgctgctatggataaatatctaagactgggtaatttataaaggaaagaggtttagttgactcacagttctgcatagctgaggagacctcaggaaccttataatcatggcaaaaggcaaaggagaagcagacaggacagagtgaatgccagcaggagaaatgccagacgcttataaaaccatcaaatcttgtgagaactcttcactatcataagaacggcatggggaaaactgcccccatgattcagttacctccacctggtcccacccttgacatgtgggaattattacaattcaaggtgagatttgggtggggacacacagccaaatcatatcaccatcccttgaaccaaaacgaacaaggctgaccttatttgcaacattctaacttgtctaaaggctgcctgaagaattgatccctgattcacctaactcagatntctgctaggagacaagcatggccttaatctcagatgaggagaagcagtagtcatggctcagaaagctgcagagagaccctacagattcctggggcaaaagattataggtggagacatatgacagaccatcaagaccccacaaagatctcttgggaaatttaagacaattaaaagcagccatntatacagagattcaaaaaaccacaaacaggtccaggcaaggatgcatgctcagtaaagacctgagaagacctttagctttctctttgatgtgatctcaaaattcagaagcaaggccaagataattaggaaaggacttccatggcaaagagccagtctacagagaatgggagaagtagctgtttttctttttgttttcaaatccccaacataactattgtgaatttaaaatcccaaaatcacaatgcataaaaagaaacggaaacatggaccattcaataataataataaattggcagaaactatccctgaaaaaatacaggtatcagacttactagaaaaagattttcaaacaatgttttaaatatgttcaaacagtaaagaacaacatggacagagacctaaaggaaatcaggtaaattatatgaacaaaggggaatttcaacagagatagacattattaaaagaaccaaccagaaattctggaaatgaaaaatataatgggcacactggggatagtcaaacttaaaaattcactagagggattcaatagcagacttggacagaagaaagaataaacaagcttaaagataacttatttgaaattatctagtatgaggtacaaaaaaaaaaaaaaaaaaaaaaa

SEQ ID NO: 2042 - DNA, 696 bp, Homo sapiens
  misc_feature (9)..(9): n equals a,t,g, or c
  misc_feature (21)..(21): n equals a,t,g, or c
gagttcccnacgcggtggcgnccgttttagaaattagtggatccccccgggctggcagggaattcggcacgagcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagamaaaaaaaaaaaaaaaaaaattactgcggtccg

SEQ ID NO: 2043 - DNA, 1625 bp, Homo sapiens
  misc_feature (44)..(44): n equals a,t,g, or c
  misc_feature (1066)..(1066): n equals a,t,g, or c
caaaagatctataatcaggacattgtttatgtaagttggacaanaaaaattcttcccctttatgtccacccttcctatgattgcaagacaaaatttccctcctttacctcatccctataacatgggaggctgagaaaaatgaggggagatggaaccagatacaaggagatccaataagagaagcttatttaaatattgtgaaataaaggaagamccaaagcatttttttaagtggggaatccttttgaacagttattatttatccatattattaayaacatcttttctgacaaaatccatcagatgaagtgtaaatggataatcttttaatggatctaaacctagaaagtttcacttactgttcatgtccgtgttccagaattgtgaaatggtgtgtggttttgctttccaagttcttctctgcctcctcttaattctctaattccatgtcttacagaagaatgagaaatttctttcttacttgagtatcatgctctaaaaaacttggcttcagtcacagaaacgctggctctcctgtgcttatattgaagccaactgcctttaattcttgggccctcttatatttttaaggtgcaaaatttgaagtctcagtcaccagacacaggttctatacaattaatgatgagctggagaagtaatatgtagctaatttttcaaaagcattgaatatactttccggaaagaaaacagaaattaaatattgccacatcttgccagaatcccatctgacaccttaactttgtcaggtttcctacaacttgctaatcaagttttatacattctaaatctccccagtttctttggggctggaagatgcaacttccatttaatagaaactttgaaatcttggggtaagggagcagtggggggactagggagaaggataagaaatagaattattgaaaagcccccaccagggaccttcctggccagaatatgcagagtaattcctgctggcttcacctttgaaagtccctcgaaactatgcagatgaaactgagtctgtttttgatattgtcagatgtattctaccttggaagtcccnacacctaaactggaattcttgtatttacatctcctccactgtcccccacaccacccctcaattcctgctgcccctgctaatgttaagcatttttctcttgttatcatcaggttcacattaaaamcagrtacttacaaactgacttgaagcacagatacttttacgaatgtgataaaatattttcttaagaaaaggaaagaggatgtgggtcaaataaaacaccgcatggatgttgattggtgaatactggtgtaagaaaagggagctcaggaatttttattactgtatttgtaaatgagtttgaaggaatttgtaaatgccactggtacatttttaaggtgacacatttgctccttataaagttattaaaaattacagggtaagcttaaatgacgtttgccagtagttttactttatataatcaatattgatattgttgctgaactatgtaactttatgatgcatttttcagtcccttttcagagcaaatgcttttgcaatggtagtaatgtttagtttaaattgacttaataaattmttacctgagcaaaaaaaaaaa

SEQ ID NO: 2044 - DNA, 658 bp, Homo sapiens
gaattcggcacgagaaaaatgaccctatgattgtgtcttttaaaaaggccaagcccaatcctcttcaaccccggctcaccctctggtgggcccacgttgggcacaacttccccaactgatgggcccttggcttcagctatcctccttgccgcaatttcctgggcaaagatgcttctctwaccagatgttgctgattwcccctgtggggyaaaaagaaaacccakgttactgatgctcatcatcccactttcctctcaacctctttatatcaaggcctctggaacaaagagataaaaggggattgctcaatttccagggatcacaaccctagttctcagaaaaaggagargtctataagagtaaaggtcttagactctgacagacttgggttgaagttctggctcttctacctattagatgtgtggtgttggacaagttatttawcwctttggggtctcagtttcctcatatgaaaaatgggaataaggactcctcatccccaaggtatcatcatgatacctgccttatatgtttgttatgaagattaaaagaagtaatgggtatgaagtgcttagtatgatcctgctttgtaaattaaattgcttatcatcattaaaactacctgcctggagaaaaaaaaaaaaaaaaaaaactcgag

SEQ ID NO: 2045 - DNA, 626 bp, Homo sapiens
ggcacgagaaacattttcctttgggttttttttttctttcttttttctcccctttactctttgggtggtgttgcttttcctttccttttccctttgagatttttttgttgttgtttcctttttgtattttactgatatcaccaggatagtttactctccttctagctttctgcttaccgcacactggataacacacacatacacacccacaaaaatgctcatgaacccaatccggagaaggttccagcaggtcccccaccctcccctcctcctcctacttctcctcttgacagcgaggacaggagggggacaaggggacacctgggcagacccgccggctctccccccaccccaccccgcccctcacatcatactccaatcataaccttgtatattacgcagtcattttggttttcgcggacgcgcctacctaagtaccatttacagaaagtgactctggctggtcattattttgtttatttgttccctatgcaaaaaaaaaatgaaaatgaaaaaagggggattccataaaagattcaataaaagacaaaaaaaaagaaaaaagaaaaaaatgtataaaaattaaacaagctatgcttcgactcttaaaaaaaaaaaaaaaaaaa

SEQ ID NO: 2046 - DNA, 1148 bp, Homo sapiens
acccacgcgtccgcaaattatacttcctcattcatattatgttgatacaaaagaccttggcagccatttctcccagcagttttaaaggatgaacattggatttcatgccatcccatagaaaacctgttttaaaattttagggatctttacttggtcatacatgaaaagtacactgcttagaaattatagactattatgatctgtccacagtgcccattgtcacttctttgtctcatttcttccctttgttccttagtcatccaaataagcctgaaaaccataagagatattactttattgaatatggttggcattaaatttagcatttcattatctaacaaaattaatataaattccaggacatggtaaaatgtgttttaataacccccagacccaaatgaaaatttcaaagtcaataccagcagattcatgaaagtaaatttagtcctataattttcagcttaattataaacaaaggaacaaataagtggaagggcagctattaccattcgcttagtcaaaacattcggttactgccctttaatacactcctatcatcagcacttccaccatgtattacaagtcttgacccatccctgtcgtaactccagtaaaagttactgttactagaaaatttttatcaattaactgacaaatagtttctttttaaagtagtttcttccatctttattctgactagcttccaaaatgtgttccctttttgaatcgaggtttttttgttttgttttgttttctgaaaaaatcatacaactttgtgcttctattgcttttttgtgttttgttaagcatgtcccttggcccaaatggaagaggaaatgtttaattaatgctttttagtttaaataaattgaatcatttataataatcagtgttaacaatttagtgacccttggtaggttaaaggttgcattatttatacttgagatttttttcccctaactattctgttttttgtactttaaaactatgggggaaatatcactggtctgtcaagaaacagcagtaattattactgagttaaattgaaaagtccagtggaccaggcatttcttatataaataaaattggtggtactaatgtgaaaaaaaaaaaaaaaaaaaactcgaggggggcccggtaccctatta

SEQ ID NO: 2047 - DNA, 813 bp, Homo sapiens
  misc_feature (639)..(639): n equals a,t,g, or c
  misc_feature (766)..(766): n equals a,t,g, or c
tctaggaattagtggatccccccgggctgcaggaattcggcacgagtatggttcttgttcttaccactctaagcctgctcccattgctaatttccccctgtaattatgaaatcaatttctccctatagcagttatattggcatttcaaagcaggaaataaaaagtatgacgagaactatgaaaggaaaaggtttttattgatcttttttagaaatgaaatttgaaatacacaagggacgcatgaattttatctttcatgaacatttgatgrgtmagtgtgggtgccccagtaaagattctggcttcctgcaaaggataaggtcagaagtactgtcctgatttatccttgatgtgttcatcacaggttctcttgtctaatggcccataactaagtgaggctttgattatggtatctaatgatgaataatcaaagtttattgcaagatgttttaaccagacttctcctgatttggaaattttttwcctgttattacaatgcagtaatccccttataatagaatatcaagccaggtgtagtggctaacgcctgcaatcccattactttgggaggcccagctgggaggattgcttgggcctgggagtttgagaacagcctgggcagtatagtgagaccttgtntgtacaaaaaaacaaaaaattagccaagtgcagtggcatgcgtgggattgtcgggggtgggggagcctggaatcacttgcgcccgggaggtggaggttgcagtgagccagattgtgccgctgcgctntagtcctgagtgacagagtgagaccctttttcaaaaaaaaaaaaaaa

SEQ ID NO: 2048 - DNA, 718 bp, Homo sapiens
  misc_feature (703)..(704): n equals a,t,g, or c
  misc_feature (706)..(706): n equals a,t,g, or c
gaattcggcacgagcccctcctggttctcaccaggaaaacatccaaagctttggaggaaacaggccctgcccctggctccttaaatgccccgtctctttgtaaactgatattcagccagcaatgcctaagactttgttaagatcatttctactgcttttctttctgcttcaaacacacagttcgtctctgaggaaagtaaaataaatggaataagagtaaattgggtaaggagatatccaaagctacccagtcccttgacccagcacagttggccgacccgtgtcactccctggctgtcgctgcttctctgtgctcactgaagggtgagccaggccagtgcttccccagcccctgggcctggtcactacacagtggaaaacagacaagcggccccttccccaaatcccaagagtgtcttgctgcttggtgggtgctcatcgcaatgttctgaaggctccagggccactttgtttgtaagtatgatctgggcctcaaaataccatagtagctgcttgataaaattctaaaaatatctggttctctattatgtaaacactattacagtcaccagtgtgtgaagactcttgagtctggttctcatatcagagtcatcatttttcttcctgtggaataaaatgccttgtggacttcccaaaaaaaaaaaaaaaaaaaactcgagggggggcccgtacccaatcgccnntnatgatcgtatta

SEQ ID NO: 2049 - DNA, 1358 bp, Homo sapiens
ggcacgagtgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttggttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaaaaaaaaaaaaaaaaa

SEQ ID NO: 2050 - DNA, 750 bp, Homo sapiens
  misc_feature (734)..(734): n equals a,t,g, or c
gaattcggcacgagcgggaaggctggggtccgtggggatgggcagggtctgtggggacacgcagggtgtcccacatgatgcagcctgtcctcatatggggactctgagctctgagactccctgtgtgagatgtttgggtgcagagctgtgaagacacagaaggaaacgttgccgtctgcaccaggctccccaccgttggtggccctgttttccgtggccctgtggcctgtggccctgtctaacgaggccacaccacattcatgtggacaagcaccaggagctccgggtcagatgagaacactgtttcctccgacctgactgcctctttgcctggcggtttctaagccagcatccagccggcctcggtgaggatgacaccagcatccccttgaccctccaaggtctcctgtgacattgccccagaggctcttgctgtggggccgtccagtttatgtggagtgacctgcaccctgagcacagcccaacakttggccacaccttgggggcccgaggggctgagttctacccagagcggctggaggctcacaagggattttcccaccttggagggagccaagttcccctggggggcaggtgggctgctcagctctgaaagacctcagtgccgtggagtgcgctctggaggaagggtactgagccgattccctgacagtgactgtaataaagatggctaaatagagaaaaaaaaaaaaaaaaaaaaaaaaaaaaatagnagggggtcccgtaccg

SEQ ID NO: 2051 - DNA, 437 bp, Homo sapiens
ggcacgagctgaattctacacatctctctagtccctctgaagccccacctctggagcgctgcctctgatcaccccagcccacagtgatctgagttcacagagcacatcctgtttgaatgccccatttgaatcacagcctattcctctttttgagtgttggttgtgccttaagtgcacagatggcttttcaccagctggacctcgagcagcctgaggatgccaccctgccttctgagccattcttccatcacactgtagtgccacagcgctcatttagtaggattttggtaaacatgggtcaactaagtgagacactggcagagcaaggttatatttagtgctagaaaggacctacaacatggtgacttcctcctagtctagagaatgtaggccctgacgctttgatattcccaataagcaaaaaaaaaaaaaaaaaa

SEQ ID NO: 2052 - DNA, 867 bp, Homo sapiens
  misc_feature (831)..(831): n equals a,t,g, or c
tcgagttttttttttttttttttttaagtagagatggggtttcaccgtgttagccaggatggtctcgaactcctgacctcgtgatccgcccgcctcggcctcccaaagtgctgggattacaggcatgagccactgcgcccagccggtctttttaaacattccccaggactgtacagccaacccatactcacctgacatttgggaactcccccccacggccataactgatctgcagaggtaagaccaagagcaagaatgggggattcacatctaaggtctggtgatggctgatgaaggaagaagaatcagcgaacaaaagcctctaggtctttcttaccacaaacacctctctgcccacctgctttgaaaggggcagaagtatagtgggcgagctgcccacctgctacagtgaagggatctggagaaatactcacactttgaggtgctcgccctcttcatcagccagctctaacttaagccaatgaccccacgggagcttacacaagtycaaacaggcccaaatgcattcatgagcagggggaggccaaaggactccggaggagagaggcccaataaggctggtgctatttccgatccatagagagagcagaggtgggcaggcccttttgattaatgtatcattcttgaatgcaagcttcaaaatccgggtatgccgggtgagaatgagcaggactaacacctgggtgtcatggcaagcctccagggccgactggccagagacagatccgcaagaggctctgcagccagctctggtgccaagccactcggatttgaaccccggctcctcaaggtcagctgtgtagccttgantgaaycacctgctatgaccaatctcgtgccgaattc

SEQ ID NO: 2053 - DNA, 908 bp, Homo sapiens
  misc_feature (805)..(805): n equals a,t,g, or c
ttaaacaaatggaatcatgcaatatgtgaccttttgcgtctggcttattttatttagcataatgtttttgaggttcatccaagctgtagcatgtatcagcacctcatttctttttctggctgaatattattccattatatggatttaccacaattcatttacctattcatcttttgtttctgctgtctggctattgtgaataatgcttcgataaacattcatatacaagtttctatgtggctttatgttttcatttctcttggctatctacatgggagtagaattctaggtcataatataattttatgtttaacttctcaaagaattgccaaaaggtttttcatagtggctgcatcatttacattcccaccggcaatgtacaaggatttctatttttccatatccttgcacttaccaacacttctttttkgtwatwattttgttttttcattattgccaccctagtggatgtgaaatggcatcttattgttttgatttgcatttctctaatgacaaatgatatcatactttttttatgtgcttacggatcaaaggtatttccttggagaaatgtcccttcaagtcctttgccatttcaaaatttggttatttgtcttttattattcagttttaagaaattctggccaggcgcagtggctcacctgtaatcmtagcactttgggaggccaaggcgggcagatcacttgagktcaggacttcgagaccagcctggccaacatggtgaaaccccatcttactaaaaatacaaaaattagctgggcgtggtggcaggtgcatgtaatcntatctactcaggaggctgaggcaggagaatcgcttgaacccaggaggcggaggctgcagtgagccaagatcacgccattgcactctagcctgggtgacacaga

SEQ ID NO: 2054 - DNA, 459 bp, Homo sapiens
gggtgagagagggaggtaccagagtaaatacagtgccacttggatggtgacaccccattaccttcagacacaaagatgtaagctgagggaaatgaattcttggattcagggaaatgaattcttggattctgaacatgagggtcagatttacattcctgtctcaattgttgacgcttatcccaaggactagtcattctgcaacatctgtgggaaattcccagattgaacttcccagggagaaacatcatatgacatattgggaaaatggctgacaatggttttccttagtaagttcattgagaagaaaagtgggcggatgattttcccagtcttcactctttcagaagcccctaaaacaatctgacatgctctagttggagcctgctttctatcccatcagtttgatttctgaatgccttatgatcattagcattcttcattaaaaaaaaaaaaaaaaaa

SEQ ID NO: 2055 - DNA, 642 bp, Homo sapiens
  misc_feature (593)..(593): n equals a,t,g, or c
aattcggcacgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctganaaaaaaaaaaaaaaaaaaaaaaaaaaaaaagcggccgccgaattaagcc

SEQ ID NO: 2056 - DNA, 785 bp, Homo sapiens
aattcggcacgagtctggagttcagttcatcccaacacacattaattgaatgcctcatctgtgccaagcatgctggacagtgggaatagagaaattaacatcgtgggtgtagctcctcctttcagacagggactgatatctctgagaacctgtgggaagaaggacaaccagttgatctcttgaggactgagagtcagcccacatgatatgagaggctgttgcatcccaatgccattgtctcatggaggggacctttactgtgtggagtgggggcctagcagtgtatgtgtgggcagtgtggtgcagtgtccatgggtggtgttttctgtgtggctgtttgcagtcagcgcttttgaagcttttcatgtgaagtaccattagtggcagagagtgaattcacacttcacaaggggcatggggttttagatcactgcacacagaaactttcttcgaagccccatgttttgtcttaaaagtatgtttagctgcgcatggtgctcacgcctgtaatcccagcactttgggaggccaaggcaggtggatcacgaggtcaggagattgagaccatcctggctaacacggtgaaaccccgtctctactaaaaatacaaaaaattagctgggtgtggtggcgggcgcctgtagtcccagctagtcgggaggctgaggcaggagaatggcgtgaacccgggaggcggagcttgcagtgagccgacattgcgccattgcactctaacctgggcaacacagcaagatccgtctcaaaaaaaaaaaaaaaaaactcga

SEQ ID NO: 2057 - DNA, 665 bp, Homo sapiens
ggaattcggcacgaggcaggaaccgctaaacgagacagacactggcgactcagagccccggatgtgtgggttcctttctctgcagatcatggggcccttgattgtgcttgtgggattgtgtttcttcgtggttgcccatgttaagaagagaaacacgctgaatgctggccaggatgcctctgagagagaagagggacagatccagattatggagcctgtccaggtcactgtaggtgactcggtaataatatttccaccccctccaccaccttactttcctgaatcttcagcttctgcggtcgctgagagtcctggaactaacagtctgcttccgaatgaaaaccccccttcatattacagtattttcaactatgggaccccaacttcagagggtgcagcctctgaaagagactgtgaatctatatataccatttctgggacgaattcatcttctgaggcctcacacactccacatcttccatctgaattgcctcctagatatgaagaaaaagaaaatgctgcagctacattcttgcctctatcttctgagccttccccaccgtaaactatggactctagttcagttttatatgcaatggatcactattttatttaattttttttaaataaaaaatacaatagcaaaaaaaaaaaaaaaaaaaaaa

SEQ ID NO: 2058 - DNA, 1603 bp, Homo sapiens
tcgacccacgcgtccgctctgccaggaatctggtctttctgtagacccaagtcagaaagaaccatttgtggagttaaatcgaatattagargcattaaargtcagagttctgagacctgctctggaatgggcagtttcaaaccgagagatgcttatagcccaaaacagctccttggaatttaaactacacagactgtattttattagcttrttaatgggtggaacacaaatcagcgagargcattacaatatgctaaaaattttcagccatttgccctaaatcatcaaaaagacattcaggttttgatgggaagccttgtgtacctgagacaagggattgagaactcaccatatgttcacctacttgatgcaaaccagtgggctgatatctgtgacatctttacacgggatgcttgtgccctcctggggctctccgtggagtcccctctcagtgtcagtttctcagcaggttgtgtggcgctgccagctttaattaacatcaaagccgtgattgaacagaggcagtgtactggagtttggaaccagaaagatgaattacctattgaagtggaccttggtaaaaagtgctggtatcactctatatttgcctgccccattcttcgtcagcaaacaacagataacaatccacccatgaaattggtctgtggtcatattatatcaagagatgccctgaataaaatgtttaatggtagcaaattaaaatgtccctactgtccaatggaacaaagtccaggagatgccaaacagatatttttctgaagagataactttagtttgcaatttgtaagtgaaactgaatcgtgggtgcatttcagaagagaacgttccatataatgcagctaaccaaggactcctgtgtttctataagctaatgctccagaaactttgccaacctgttagtgtacacacactgaggggagtgctcccggtgaatattatcatagggctttattatattcttggtcttcatttctgatcaagtaaatacaccagcagttgtcattcaatgcaggtttttgtacttaattatatggtgatttttttactttttaagagcagaaacggaaattgacctccccgccatgtgtttaatattcctcctgcttttacttttgtcattttcttgataatcgtaagccttgagagtgtttgtgaaaaagttttatttcctgttatgtatacataattaaatgaaaattcttcagaaaaagtttgataaattgaattgtggttatgaaactaatttgcatttttatttgcttaagaaagaaagctgtgatagattccagatatgctttttgatgttttcctctgctccagctccaagaagtcagcacacctgcattttagctctgcatgcagccccagcaggctgcgtgtttaagaatttcattgtttaactggctggtgtgagaagtcttccgttagcatagagtggaaggagtactattgtttggttgggtttttgtttgtttgttttttgtttttgcttttattgccaagaggtgcttgttttaaaagtatgtttaataaaatgaaattctaaagttaaraagtgttcttaaagttgatatttaactct

SEQ ID NO: 2059 - DNA, 1219 bp, Homo sapiens
  misc_feature (25)..(26): n equals a,t,g, or c
aattcccgggtcgacccacgcgtcnnctaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccakctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaattgttttggaatctgttgtttctgccaaaggtaaattaactaaagatttattcaggaatccccatttgaatttgtatgattcaataaaagaaaacaccaagtaagttatataaaataaaaaaaaaaaaaaaaactcga

SEQ ID NO: 2060 - DNA, 624 bp, Homo sapiens
  misc_feature (616)..(617): n equals a,t,g, or c
ggaaaaatagacatggccactcaatttatagctagcaaaaccctggccccaaaaccaggtaaggagagcaagggaagagaaagctataattcaatctcctgtaaaaagaaatgcaaatagcaaaatgaaaccatgacagaatgaaaagaacaatatacacatgatcaggtagcttttatactaggagttttaaaaaggaaactatcaatatagttttatatttaaacagattaaagaccagaccatgtaattaccttaatgtaacccacgctgataaaattaaatcaatgatgcaagtaaatgctttgtatgcaaacagtgatgccccagcacacatacctgcagcaccttgtctttggtttctgtctgcttattttatgcatcaatttatctgtgttagcacacagatatacactgtgttatttttcaatgacgggagaatattccattataaatggrcagttgttggtttatttaagcaatctctctgcccaatggaaatataggtatttccagactttgctgktactcaaaaaaaaaaaaaaaaaaaaaaaaaaaaaaaaaaaaaaaaaaaaaaaaaaaaaaaaaaaaaaaaaaaaaaaaaaaaaaaaaaaannaaaaaaa

SEQ ID NO: 2061 - DNA, 935 bp, Homo sapiens
cccacgcgtccggtcatctctcacctgtcttacttcttccagtcttgtctctcccattcagtctgttgttctccacccaggagccagagtaatcctttaaaaatgtaaatcagattagattatttatgtatgttagtcatttctactactttcattaattactggttcatatttatcatcccatttgataaaaaatctccagcatttccttttgcacgtgtataaaatccaagttagctgttaccatgtcgtgtatgatgtttctttcccttgctcctttttcaggcttcatcccatgccacttgccccatcacctgtaatgctaattctagttattttgttgttattttgtccttcctttcagttccttcccatcagcttttactccttcaatgtctatgcatttgccttttctggaatttctcctcctagctgtttgcatggctggcttcatttcatccaaagtagtttcttcctgttatattctgataacatcctgttttctccttcattgtatttataacaggctttaattatttgtttacattttactttttgactcccctagtttaatgttagctctgtgagaacagggacagatattcagcctagcctagaatattgcctagtatactgtagacattcatactcaggtagattaaagcaaatatagaaggaatgaaagttcaatgtcagaagtttaggctgtatagaaattagaaacttctgcatgtcagactctatagtatatttccataaatcgagggaaaaaaataaaatgatgatacagagtatcattctaaaaattctgttcatacacctatcccccattctcctcctatccctcaaccccgacatcattaccgggttttcctcttaaaaaaaaaaaaaaaaaaaaaaaaaaaaaaaaaaaaaaaaaaaaaaaaaaaaaaaaa

SEQ ID NO: 2062 - DNA, 925 bp, Homo sapiens
  misc_feature (914)..(914): n equals a,t,g, or c
  misc_feature (916)..(917): n equals a,t,g, or c
tcgacccacgcgtccgcttgatttgtgctattatgttctgttagttttggcatgaatatactaaagctttttttttttttctagcatgtgttttctcctctttggttctctttgtatttactacttttctctttttcttgtgtttttttttttcctgtttttgttttgtttggtgttttgttcctgtcttcattgtttcaggtatttctttacccctctggattccccacgggctggatcgagatggtccagttatgcccagctccttcctcctcctcctcctcctctggtagagcactcttgcgatgctgacactgccaacctccagtatcctcaccctcgcagacgatatctctctcggcctcttaatcccttacctgagaatgaagggatttaaaacactgatttaacattgaaaggccttattcaagtgcttgtaaatgctttcatttctggctgctttttgtttttcattttctttcagaagatttttctaacttagggtctgtcttgcatgtattacaaccagaatacagtgtttggaacctaaatctgtttgtgcgtctgcatcaaaggaacatttgcttcactgggtgataacctttgatgaaatgagatatgtccaagtaacgttaactgtgaagttacacacagtagctgacttcaaagtgcctgttctgtaaattttattttaaactgttaccatagtcttaagttgtttatgctttatcagactggctaatgtgaaagcataatattatgaagtttattctgccttatgagaccttaaaaaatggatttcattttacaggctaatgttgtaactgactagtatgtaaaataaatcattcctgtgtataaagcagcaaaaaaaaaaaaaaaaaaaaaaaaaaaaaaaaaaaaaaaaaaaaaangnnaaaagggc

SEQ ID NO: 2063 - DNA, 959 bp, Homo sapiens
cccacgcgtccgttgagttccttcttgtacttgaaagtagttcagtagtgaaatctaaatgagtgtgtatggttgtaattaaaactggcaatgtggcagagctgtcttttgaaactgaataccagaatgaaaagtgttgttttggttaagaactcttataatatattatttcttttgatgtaccctgagttgttacacagcccactcactgctgcttactactttatacttctgagtcagctcctttcatgctctatcccagaatatttaccaacagaggagaactgctcccttttctgtttctcacagtttggttatggctttataaacttttatttggtgaaagccccagatacccaaatgtcattggcaaaacttatttttttttctggacagatcagatttctagagagagcagatttctagagagattagcattcatagtaagtgaaaattgtctaatttttttaatccatgctattactgggcagtaggtctaattttttttgacaaaaaatagatctattttccttatatattgatttagaatcttaagttagaattttatagaagaaatgcctgagcagttctatgtatggaggagcaattcagcttttcagcagcaactttatcttttgccactagagggagatctgtggttgctttctcctttggagaatagctgctttgcttttatttttaatttctaaggttggaatagaacttattctcaaaattcctttagtgttattaaatattttcatttattagtcaaaggtaagttaattaatcttgtttaatgatgccaatcttatgcttttctgtaatcttcaatttttaataaatgtgagttagatactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2064 - DNA, 1539 bp, Homo sapiens
gattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccatgactgttggcccacccattgcagggttacttcgtgacaaactgggctcctatgatgtggcattctacctcgctggagtccctccccttattggaggtgctgtgctttgttttatcccgtggatccatagtaagaagcaaagagagatcagtaaaaccactggaaaagaaaagatggagaaaatgttggaaaaccagaactctctgctgtcaagttcatctggaatgttcaagaaagaatctgactctattatttaatatcttacatacctccaccagactggacttgctttttgaattttaagcaagtttcctttccttttatacaaattgcaaatttcatatttttttaatcacatcctaggaatagcacaataattgggaaatagaacccttatcactagaagaaccattttctgccactaaatatctctgatgtttccatgagtctgagggcagagactctggtatatgaaaacatgtctgaaagtcacatattgtgaaaatttgaagctatctcagtaaaaagcagctttggaaactgtgaatgatctttagcttgtacaaatgtttaaaaatacctcaggctatactgaaagggttgcagtttggttaggagtggaaatattttgtttgttaatgatgtcttcagttctggtacctctgttttactttcttatgctctttggaaactttttgcaaaatttaagcctgggttctagataataccagatctacctaaacctcaagtctatgttaaagttgmtttcctgctgttaaataagctatgatattaagatattctgacttgctccagtgtcaagggaccttctgggagcaggtgctaacatagtgttcagaatcaatatgtgagatgaaaaggatcccctccaggaggatcctgagctgttcagaaatcatttaagtttacagcgttgttccctttgcgtttgcagtgcgttttactcaagtagccagaaacaccccacgtttctgaatttgtttaaactgtaacaataaagtaaaatagaatgcatgaaagatattctggcgattgtaacttagaatttttctgacttctggatttgttggcactagaacctgatatttaaacaaagtcttactgagcagctatcaagtggcagttacaggcacaaattggtggaggctggaggatsgggaggggagcaaaccctttatatttgtgaagaaaatatctgtagctgatagaaataattgcttaaattggtttatgaaattaatgagtctgaaaaggttaaaagcacttataaaaagaaccaagtcctacatttccagaactttctggcaaaatttgactcatattatttatccyatgacatcccattgttttt

SEQ ID NO: 2065 - DNA, 1275 bp, Homo sapiens
ggcacgagccagctcctcttccaagatgtcctccttaaactttgccagtgaaatggagaagtactgtttggggaataatatgctttcaaggttttgcttatttttgataatgctcctgcacatccttctttttttggttatcttcattcaacgtcacactgttgtctctctctccaagcaccacccctttgttccaactaatggatcaaagagttatagcagcttttaaggcctgattactacctgaggaggacctttgcctaggctattgctgcaaataagaaagatcctttttaaacacactggtgcaattctggaaggattacaacatctatggcagcatcaacaaccttggttaagttgggggtgaagtcaccaaggagtgtgtaaatgctatctgggaagagatattgaagacatttgtccatgacttcaaaacattgctaaggatgaggatgttgcaaaaaaaaaatattcacaaggctttagttgaaatggcaaacaactttaagctggatgtggaggaggatgatattgaggaggtcacagatgtggtcactgaggaattgactaatgacgagttactggaaccagaacagaaatgcatagcaagaggaaaggaaactacaggagaaaaaaagaaaagcccccaaggatattcacagtgatgggtttaggcagaagcttttgcagacctcaacaaactccttaaaacgtttgaaaatgttgactccaacatgaaatgattttcattagtagagaggaatgttcatcgtgcattatctatttacaagcaaatctatgatgaataaaagaaacaaaccaaacaaaccaccatgaacacatttctgaaaagagtgacatctcaagaagagcctcaggcaggtccttcaggaggtatcccagaagaagaaggcattgttatcacaggacatgacagctccctgggtgttattgcccttaaaggccttccagtaggataaggtgtggagatggaaggtgccgatttttatgatcctgaccctacataggtctaggctaatgggtaatggtgtgtttgtgtcttagtttttaaagaaaaatgtaaaaagtaaaaaataaaaataacattaatataggtaaaagtttatagaataaggatataaggagagaaaaaaattatcttcctctgtatttgtgtttcaagctgtgttactacaaaagaataaaaaagttaagagaaattgtttttaaagtaaaatagttacaataatctaaaaaaaaaaaaaaaaaaaa

SEQ ID NO: 2066 - DNA, 1478 bp, Homo sapiens
ggcacgaggagggcggaagtgggagctgcgaccgcgctccctgtgaggtgggcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcattgtaaagatggtgaatttaggcgctatcagggtccaaggactaagaaggacttcataaactttataagtgataaagagtggaagagtattgagcccgtttcatcatggtttggtccaggttctgttctgatgagtagtatgtcagcactctttcagctatctatgtggatcaggacttgccataactactttattgaagaccttggattgccagtgtggggatcatatactgtttttgctttagcaactctgttttccggactgttattaggactctgtatgatatttgtggcagattgcctttgtccttcaaaaaggcgcagaccacagccgtacccatacccttcaaaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaaagcactaggtatacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaaaaaaaaaaaaaaaaaaaa

SEQ ID NO: 2067 - DNA, 1316 bp, Homo sapiens
ggcacgaggcctggcgcgctgcggcgtcgctcacccgctcccgaggaagggcagtgggccccgccgccgcctcccaatggcgaggctgcgggattgcctgccccgcctgatgctcacgctccggtccctgctcttctggtccctggtctactgctactgcgggctctgcgcctccatccacctgctcaaacttttgtggagcctcggcaaggggccggcgcagaccttccggcggcccgcccgggagcaccctcccgcgtgcctgagcgacccctccttgggcacccactgctacgtgcggatcaaggattcagggttaagatttcactatgttgctgctggagaaagaggcaaaccacttatgctgctgcttcatggatttccagaattctggtattcttggcgttaccaactgagagaatttaaaagtgaatatcgagttgtagcactggatttgagaggttatggagaaacagatgctcccattcatcgacagaattataaattggattgtctaattacagatataaaggatattttagattctttagggtatagcaaatgtgttcttattggccatgactgggggggcatgattgcttggctaattgccatctgttatcctgaaatggtgatgaagcttattgttattaacttccctcatccaaatgtatttacagaatatattttacgacaccctgctcagctgttgaaatccagttattattacttcttccaaataccatggttcccagaatttatgttctcaataaatgatttcaaggttttgaaacatctgtttaccagtcacagcactggcattggaagaaaaggatgccaattaacaacagaggatcttgaagcttatatttatgtcttttctcagcctggagcattaagtggcccaattaaccattaccgaaatatcttcagctgcctgcctctcaaacatcacatggtgaccactccaacactactactgtggggagagaatgacgcattcatggaggttgagatggctgaagtcacaaagatttatgttaaaaactatttcaggctaactattttgtcagaagccagtcattggcttcagcaagaccaacctgacatagtgaacaaattgatatggacatttctaaaagaagaaacaagaaaaaaagattgacttttctttatcttctatgaagggtctgtaatgaaatctctaaataatttttaaaaattgttcatcaacttctttatgttttattagaaaaaaactgttttaatgtgctttatcataaataaatatcctgacaaatggtattgaaaaaaaa

SEQ ID NO: 2068 - DNA, 714 bp, Homo sapiens
gaattcggcacgaggaggagttattcaggcctccgccagcttcaaggccctggggatggtctttcacctccctctttctgatctctttttcatgctcctccttgctccaaagaaaagccggatggcaaaagagcccagaacctattggaactgacaaaatcaagtcacggcgcctacaaagatgaggggcagattctggctgccttttaatttcgtccttcacctgatatctgtgccagagaatgtggcatggttcagtcttccaggagttctgctacagagaagagagtaacccccatccatcatggccaaagcacccagtcaggctccgctctggatccagcccgacaaatgcaacccttgaatagggtttgtgcaagcaaactggatgacgaccgaagaaaccctgtcgcttctgagaagacacccaatccaagaatgaaagcatcaggttcaatacctaggaactcctgtagagggtgttgtggaatcttctttaaaagaacaaaacaaggtaaaacaaagtttaatagggtagagcagccaggtgtggtgggtcatgcctgtaatctcagcaatttgggaggccaaggcaggatctcagcaatttgggaggcgaaggcaggcagatcacttgagcctaggagttcaagaccagcttgggcaacatagcaagaccctgcctataccaaaaaaaaaaaaaaaaaactcgta

SEQ ID NO: 2069 - DNA, 1171 bp, Homo sapiens
  misc_feature (291)..(291): n equals a,t,g, or c
gaattcggcacgagcctctccagtgcttatgtaaagaaatgaaagtattcagggaaagctgtgctttgttggaggaccgcgttgtggatttggccaccttgtcacttgaagtcgtgttaggggtgcttcagcaggatgtggccggatgcctttcatgatgatgctgcacagmaaactgttgctctttstggaagctttgtggtactacggtgggggggctttcctttgctgtgccggctctgtacctactgactgttattttggggggctggaccaaagaagacttgtcantgataaatgtactgagaagagcacaggactcctttaagtctcaaggtgctctgggcttagttcttctgagcagggaaaccagaggctggcgtyctgttttctttktgtaaaatggaaaaatacctgccattgccacttaactaagtcactgaagagatcatgtgcatggaagatgtaaaacagtatgcctctttataagtaaggtggcattattacttgagctggtggaaggcagcacgtttcccacaattggtctcaaaagcccgggatgcctgctgagttgccatttagtttattaccttagcaaagcagagttgggggtgcgattgtcgatagtaggctttgggagaaatgatkgttatattycgtaataaatgatgtccttgagaaactcataagttgcaatgtaatcctgtcttaattgtgttgggcacractcccactgcaataccttaaataactgaaaacatttgcctttgaaagccccaatcgacttggacaataaaaacagttgcatgttttgctctagagatattttctgccgtttccatcattccactgcctggttattcctagggagaataacagataggatactggggcttcaccactatttgatcaggtatcagtttgaaatagagaatctctgccttatgaagatagtaattcctgtagttagcatgaaaacaaattgccagtttgattttctaggacagctcaagcagaatttgtaccactaggctgtaagttttaagtatctaattttctgatttgaaagtgtatgatttaaaaattggaaaaagtttttgttataagcttcaaaaggatttactataattacaatacgtaaaattacaaaaaaaaaaaaaaaaaactcgag

SEQ ID NO: 2070 - DNA, 1010 bp, Homo sapiens
tcgagttttttttttttttttttttttaagcatgtaataatgatttaatgtacattgtgcacaaatacaatatttaaaaaataaaaatagaaaatcaaaattcaaatacaaaagtaaactacattcatcactccaaaatatcttttaaggagaattgttaaaactgaccaaaagagtcaactaaagcctgaataaaattttgatgctactgttacattaataattgaacagcatttacaagaaaactatatactccacaaaatgtatgtgttcagtcttagtcacttatctgctcttaagacgtaaataaatgttcttaggggggaaaaccaattatccagtcctccccgcttccttatttgtctggttcccaccactatcctctccccgacctatacatacatacacacacacacacacacacacacacacacattctagcatgatattgtctatgtggtagagccttaaaaaatgttatttctttcagatatggtctacaaatagaaaaaataatattaatgagcattgtcaaaagttttacaatattttgagaaaatcacgcataaactattaagctgtatgttccattggaccacaactttatggttgagcattgttaaaacaaaacataactatagacatcattttctggatgactctcattcagaattgctggtattcctggctcttctttgggtttttctttcatttcttgaggaaaagtataagcatctttagcatcttcctggtgtgctttaggatcctggccttggggcccacctgtttcttggtgtggttctggaaagcattctttaggcacatccttatttttatatgtctcagtagagaggtcttcaggccccggtgtttcttggtatatttcaggtgaatattcttcaagctgggatgtttcttggtatatttcaggtgaatattcttcaagcccaggtatttcttgatacgtttcagttcggcacgagaattcggcacgagctcgtgccgaattc

SEQ ID NO: 2071 - DNA, 1707 bp, Homo sapiens
tcgacccacgcgtccgccggagtgagcgcgaccatcatgtccatgctcgtggtctttctcttgctgtggggtgtcacctggggcccagtgacagaagcagccatattttatgagacgcagcccagcctgtgggcagagtccgaatcactgctgaaacccttggccaatgtgacgctgacgtgccaggcccgcctggagactccagacttccagctgttcaagaatggggtggcccaggagcctgtgcaccttgactcacctgccatcaagcaccagttcctgctgacgggtgacacccagggccgctaccgctgccgctcgggcttgtccacaggatggacccagctgagcaagctcctggagctgacagggccaaagtccttgcctgctccctggctctcgatggcgccagtgtcctggatcacccccggcctgaaaacaacagcagtgtgccgaggtgtgctgcggggtgtgacttttctgctgaggcgggagggcgaccatgagtttctggaggtgcctgaggcccaggaggatgtggaggccacctttccagtccatcagcctggcaactacagctgcagctaccggaccgatggggaaggcgccctctctgagcccagcgctactgtgaccattgaggagctcgctgcaccaccaccgcctgtgctgatgcaccatggagagtcctcccaggtcctgcaccctggcaacaaggtgaccctcacctgcgtggctcccctgagtggagtggacttccagctacggcgcggggagaaagagctgctggtacccaggagcagcaccagcccagatcgcatcttctttcacctgaacgcggtggccctgggggatggaggtcactacacctgccgctaccggctgcatgacaaccaaaacggctggtccggggacagcgcgccggtcgagctgattctgagcgatgagacgctgcccgcgccggagttctccccggagccggagtccggcagggccttgcggctgcggtgcctggcgcccctggagggcgcgcgcttcgccctggtgcgcgaggacaggggcgggcgccgcgtgcaccgtttccagagccccgctgggaccgaggcgctcttcgagctgcacaacatttccgtggctgactccgccaactacagctgcgtctacgtggacctgaagccgcctttcgggggctccgcgcccagcgagcgcttggagctgcacgtggacggaccccctcccaggcctcagctccgggcgacgtggagtggggcggtcctggcgggccgagatgccgtcctgcgctgcgagggacccatccccgacgtcaccttcgagctgctgcgcgagggcgagacgaaggccgtgaagacggtccgcacccccggggccgcggcgaacctcgagctgatcttcgtggggccccagcacgccggcaactacaggtgccgctaccgctcctgggtgccccacaccttcgaatcggagctcagcgaccctgtggagctcctggtggcagaaagctgatgcagccgcgggcccagggtgctgttggtgtcctcagaagtgccggggattctggactggctccctcccctcctgttgcagcacaaggccggggtctctggggggctggagaagcctccctcattcctcccaggaattaataaatgtgaagagagctctggttaaaaaaaaaaaaaaaagggc

SEQ ID NO: 2072 - DNA, 1177 bp, Homo sapiens
  misc_feature (484)..(484): n equals a,t,g, or c
ccacgcgtccgctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggangggaaatcagcaagtccacccagaatctcaatcggtggtatggaggaaggtgccacctgactgggagagagcatccttccaaacaggggartcaaggccagcccygrwttaaagccaagtccacaaaatggrgccacgktcccgtcctctggaggatatggccagggrtcactgatagccgatgaggagtcccaggagtttgatgatttaatatttgcattaaaaactggtgctggtctcagtgtcagtgataatgaatctggtcaaggcagccaggaggggggcacccttgactgactccccagatcgtggagctccaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatctaaaaaaaaaaaaaaaaaaaaaaaaaaa

SEQ ID NO: 2073 - DNA, 1248 bp, Homo sapiens
ccacgcgtccggtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtaaatgctgccttggctgaggcttcagtggaggccgttggcccaaaaagcctatcctggggacctagcccacctacacacccagctcccacccatggaaagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagcccttcttcccacagcaatagtccccaatacgtagatttttgctcttctgtatgtgacaacatttttgtacattatgttattggaattttctttcatacattatattcctctaaaactctcaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2074 - DNA, 2776 bp, Homo sapiens
tcgacccacgcgtccgggcgggcagtgatggcggctggtgatggggacgtgaagctaggcaccctggggagtggcagcgagagcagcaacgacggcggcagcgagagtccaggcgacgcgggagcggcagcgraagggggaggctgggcggcggcggcgttggcgcttctgacggggggcggggaaatgctgctgaacgtggcgctggtggctctggtgctgctgggggcctaccggctgtgggtgcgctgggggcggcggggtctgggggccggggccggggcgggcgaggagagccccgccacctctctgcctcgcatgaagaagcgggacttcagcttggagcagctgcgccagtacgacggctcccgcaacccgcgcatcctgctcgcggtcaatgggaaagtcttcgacgtgaccaaaggcagcaagttctacggcccggcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaataagcttgagttggactttatatacagaactgtaagccagtgcattatgatacagttgtaagattgtgcatttgattcaagataaggaaaaatcttggaaatgaaaagcaggcackggttaaccaagttgtacacattgtaccacattcagcataactttaggaagaaattccactttgtgaacattctccagaaatccaagattattcaggtaagaattggtatattaaatgtacatctttttactttctattttgatgccaactgattatactagacaattagcactccaggtggttattgaacacaaaacagtaaaagaatattgcactgatagatactaaattattattttattaggttgaaaaagcccttactaaaagcccctcatatatcaattactttatttcattatgactacttaggttccgggctggggacaagttcacttaaaaaggcaatgttatttaacaggtcaccagttaagacttctgctttgtagatacatgcagaagccatcaaacaagggggrgcttttaactgcaacaataagctaaagtatgtaaaatactacattctattcagtcttggagtgttttgtagaaagttatcttcagccaaatctttgctgaagactggttgtggagtgttggtaaatgctttgtgtttttatgtaaaatattttctaaacaaaaaatgttaaaagtacatgtcctctgtagtaaactgatatctatatatatgaatcattcaagcctaaagtctagtaataaactgtacttgtgaatagagaaaccctaaatattcatgcagwaaaaattatgcggtctgttaagaaaaatgagtaatttgtgttttggacttgaaataaacagtgttctgtagataattcctcaacttc

SEQ ID NO: 2075 - DNA, 1487 bp, Homo sapiens
  misc_feature (78)..(78): n equals a,t,g, or c
  misc_feature (948)..(948): n equals a,t,g, or c
ccgctgctgataactatggcatcccccgggcctgcaggaattcggcacggagctacggcgccgcctggctcctgctgncacctgcaggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggasgagccaggcgagcacacccccctgttggcccctgccacggcccagcccctgctgctctggaagcactggctccgggagcsggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagckttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgatgagacctgcacgcantggctcacagcagcacgatttgtgacagcccgaggcggagaacaccgaacacccagtgaaggtgaggggatcagcacggcgcggccacccacgcacccacgcgctggaatgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtattttaccacaataaacaaaacaaaacaaaaccaaaaaaaaaaaaaaaaaaaaaaaaaaaaggaattcgatatcaagcttatcgataccgtcgacctcga

SEQ ID NO: 2076 - DNA, 2530 bp, Homo sapiens
acgcgtccgcctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgtgtttcttcatatagctttaaaattatgctattgacattatgggaaagatttatcaatgagagaaatgtgtctctttttcagccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtgatgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaaaaaaaaaaaaaaa

SEQ ID NO: 2077 - DNA, 475 bp, Homo sapiens
  misc_feature (469)..(469): n equals a,t,g, or c
ggttgacaacttattagaaagttacggcttgcaagttaccggttccggatttcccgggtcgacccacgcgtccgcggacggaccctgcctccccagcttatcccaggccagaggctgcatgccactgtccccggcagcgccaacccctgcttggctgttatggtgctggtaataagcctcgcagcccaggtccagagcccccggcgagccggtcccataaccggccccctgcccctgcccctgctcctgctcctccccttcgggccccctcctcctgcaaaacccgctcccgaagcggcgctgccgtctgcagccacgcgggggcgcgcgggagctctgcgggcgctggaacctgcagacccggcctcggtcagctgggaggggcccgccccggcacaaagcacccatgggaataaaggccaagccgcgacagtcaaaaaaaarraaaaaaaaaaaagggcggccgctntaaaag

SEQ ID NO: 2078 - DNA, 1419 bp, Homo sapiens
  misc_feature (1)..(1): n equals a,t,g, or c
naaggcgcaagatggcgctgctttttgcacgttctttgcgcttgtgccgctggggagccaaacgattgggagttgcctccacagaggcccagagaggcgtcagtttcaaactggaagaaaaaaccgcccacagcagcctggcactcttcagagatgatacgggtgtcaaatatggcttggtgggattggagcccaccaaggtggccttgaatgtggagcgcttccgggagtgggcagtggtgctggcagacacagcggtcaccagtggcagacactactgggaagtgacagtgaagcgctcccagcagttccggataggagtggcagatgtggacatgtcccgggatagctgcattggtgttgatgatcgttcctgggtgttcacctatgcccagcgcaagtggtacaccatgttggccaacgagaaagccccagttgagggtattgggcagccagagaaggtggggctgttgctggagtatgaggcccagaagctgagcctggtggatgtgagccaggtctctgtggttcacacgctacagacagatttccggggtccagtggtgcctgcctttgctctctgggatggggagctgctgacccattcagggcttgaggtgcccgagggcctctagtatgtccattactggagtccctaatcacgcctttggccagcctccttttgaaagtgtccgaagcctttttactttgcctcaagcaacctctagctcccacaattcagtgttgggtcctctgtgcaatatcatgatcatcttcctcatcccctaccttgtgaaagctaggcatacagccaaaccctccttttccccacccaccaacactactgccaatttcctaggctaccatgggtgtatcttccttgacctgcttccttcagtccctctgcctccctttgcccaggcctttctcagactgtattccatcctggggtcttatcattcagctttgtttgaatttattaatcaccatgatacctctccctccctttgtccacatgtaacttgttcttggggctctaccagatggctgaagagtaaatcctttctacctctggctgaaggagtggtgcagtcaatgacttggccctttttctacagcacatttagagtttgggctctggctccctcagtaagtgctttattaactcagtgtgtcaaaatgaaaacagagccctccttccccagtagctcagtgccacagaccttcagccccacacagctgtagctatccttaccctgagtccatctaccttaaatctgtacctctgacacccagccagtctgtcataatcattatcccagttataaccttgaccaaaggggaagagagacacttgggggatatctaggggatgagtgctagaaactatttatttatttttgagacagagtctcactc

SEQ ID NO: 2079 - DNA, 2107 bp, Homo sapiens
  misc_feature (149)..(149): n equals a,t,g, or c
  misc_feature (487)..(487): n equals a,t,g, or c
tttaggtatgcatataaaagaaaacaaaatatttaaaacacttaaaggagatctgacgaaacctaaagagaagaaaaataataaaattaagtaaagaaawggtatggcaggattttatgtttgcctgtgccctttatccaactgatcanggcttcctggawtcagtgacagcagaagttgcctaccagatcaagagactgaaatctcatccttctatcatcatatggagtggcaataatgaaaatgaggaggcgctgatgatgaattggtatcatatcagtttcactgaccggccaatctacatcaaggactatgtgacactctatgtgaaaaacatcagagagctcgtactggcaggagacaagagtcgtccttttattacgtccagtcctacaaatggggctgaaactgttgcagaagcctgggtctctcaaaaccctaatagcaattattttggtgatgtacatttttatgactatatcagtgnattgctggaactggaaagttttcccaaaagctcgatttgcatctgaatatggatatcagtcctggccgtccttcagtacattagaaaaggtctcgtctacagaggactggtctttcaatagcaagttttcacttcatcgacaacatcacgaaggtggtaacaaacaaatgctttatcaggctggacttcatttcaaactcccccaaagcacagatccattacgcacatttaaagataccatctaccttactcaggtgatgcaggcccagtgtgtcaaaacagaaactgaattctaccgccgtagtcgcagcgagatagtggatcagcaagggcacacgatgggggcactttattggcagttgaatgacatctggcaagctccttcctgggcttctcttgagtacggaggaaagtggaaaatgcttcattactttgctcagaatttctttgctccactgttgccagtaggctttgagaatgaaaacaygttctatatctatggtgtgtcagatcttcactcggattattcgatgacactcagtgtgagagtccatacatggagctccctggagcccgtgtgctctcgtgtgactgaacgttttgtgatgaaaggaggagaggctgtctgcctttatgaggagccagtgtctgaattgctgaggagatgtgggaattgcacacgggaaagctgtgtggtttccttttacctttcagctgaccatgaactcctgagcccgaccaactaccacttcytgtcctcaccgaaggaggccgtggggctctgcaaggcgcagatcactgccatcatctctcagcaaggtgacatatttgtttttgacctggagacctcagctgtcgctccctttgtttggttggatgtaggaagcatcccagggagatttagtgacaatggtttcctcatgactgagaagacacgaactatattattttacccttgggagcccaccagcaagaatgagttggagcaatcttttcatgtgacctccttaacagatatttactgaaggaatctaggttgtattttcagtggacaatgggaataaagcatttctaaagcaccgactggagaggaaggcaacagagacaaggagagaagccgagagacatgtctgcgtgctgccacgcatctgagcgattgctctgtgaagagttgtacactgaacattttcaggggaggctgtttacccaggcaatgtcctcaaacaagcctgtgccggggtgtcctggaatctgtgccaggactgtgtttttagcccttcacctctcagctttagcaggacatgaaccagttataacaagatgsccctgcagctggttacaagaatgtgacatggcaggatctatggaaccaaatggaaggttttgaggtgatgtaggtctttcacagttagctttggggaatacagaatactcaaataaagtgctttgttattatttcagagggaatggcgattgaaatgttacaacagagatttcttggtggtagctatttgggtaaaggtatatggatatttttctgtacatgtgaaattatataaaaataaaagttatataaattacattgaaaaaaaaaaaaaaaaaaaaaaaaagggcggccgc

SEQ ID NO: 2080 - DNA, 1260 bp, Homo sapiens
  misc_feature (32)..(32): n equals a,t,g, or c
  misc_feature (314)..(314): n equals a,t,g, or c
  misc_feature (356)..(356): n equals a,t,g, or c
  misc_feature (590)..(590): n equals a,t,g, or c
tttttttttttttttttttttttttttttttntttttttttttttttttttttttttttttttttttttttttttttttaaatttcacctgtttcctttattatgtggctacttgaaaattttaaaattacatatgtagctcacactataaaacacagattagaaatattgtatagcactgacctagaaacctccatttaggtaaaacatcttaacccctttggaagcaaaatatgttaaataacagcataaactcccaccaagaaaatcctcaccttcctcctttcaacacatttattatatacagctgtcantgcattgtcaatctgccaaatggctctatgttccaacagggntggagtagtcccctgctcacaccagccttcacaatacttcccatgtcttccctgttaacctctctccacccagcacccaggctcccaactctcctggctgcctccagccctcagctggcaccactgacatgctgtttccagtacccttttcttctttctgcatcctccctgggggacatacatccctcatctcgtgacttcagctgtcacataaattcaaatgtttcagaactntattttttacctcctacatctgtcagtttaaatgtcaggatattttactttcagtaaagccctaaaaagacaaatctatgtacttttaaagaataaaagaaatgactggctgcagctcaaacctacaactgcttgcgaaactctacaatgtctggcagatgctagaaagaaggggatcaagacagagcacacttggcgtggtatgctatctatagaaaatgttaaaataaaattaagtaatctaggtttcctctctttattttctacatctactctctgaagagggcaataaataaggaaatgtcccaaagagggacaaattaagtcccaaaataacacaaaattgggcaaatcccagtcatgaagaaagaacagaggttcttaaattgggacacacagaggcaggtctgcaggtctaggaatctctgaacatatgtgcaaaattctgggtatgtgtgcatatgttatataacaaagcgaagggtccatatagctttcatcgcatttcaaagggtctagcactgaaataaggactactgctatgtgacttaaaaaatgaaactcaggctgggcgcagtgctcacgcctgtaatcccagcactttgggaggccgaggcaagcagatcacctgagacgaggagtttgagacccgcctggccggacgcgtggg

SEQ ID NO: 2081 - DNA, 1875 bp, Homo sapiens
  misc_feature (38)..(38): n equals a,t,g, or c
aagcagccctcgtcggaagccctaccgtgccaactggnccctcctcccgacctgctcccggctcgtgccccgtcccacccaaaagtgggtaaaggttgccggcgccggcactgcagctggggctgagaagccaggacggcccgagaactgacagacggagtgacagacggactgaccatggccgaccagccaaaacccatcagcccgctcaagaacctgctggccggcggctttggcggcgtgtgcctggtgttcgtcggtcaccctctggacacggtcaaggtccgactgcagacacagccaccgagtttgcctggacaacctcccatgtactctgggacctttgactgtttccggaagactctttttagagagggcatcacggggctatatcggggaatggctgcccctatcatcggggtcactcccatgtttgccgtgtgcttctttgggtttggtttggggaagaaactacaacagaaacacccagaagatgtgctcagctatccccagctttttgcagctgggatgttatctggcgtattcaccacaggaatcatgactcctggagaacggatcaagtgcttattacagattcaggcttcttcaggagaaagcaagtacactggtaccttggactgtgcaaagaagctgtaccaggagtttgggatccgaggcatctacaaagggactgtgcttacccttatgcgagatgtcccagctagtggaatgtatttcatgacatatgaatggctgaaaaatatcttcactccggagggaaagagggtcagtgagctcagtgcccctcggatcttggtggctgggggcattgcagggatcttcaactgggctgtggcaatccccccagatgtgctcaagtctcgattccagactgcacctcctgggaaatatcctaatggtttcagagatgtgctgagggagctgatccgggatgaaggagtcacatccttgtacaaagggttcaatgcagtgatgatccgagccttcccagccaatgcggcctgtttccttggctttgaagttgccatgaagttccttaattgggccacccccaacttgtgaggctgaaggctgctcaagttcacttctggatgctggaagctgtcgttgaggagaaggagtagtaagcagaactaagcagtcttggagggcaaggggaggggaatggtgagatccgagccctgtgcatggacttggtgagactgttgccttaatgacatcctgcaccgtgtataacttagtgtgtcattttgaaacttgaattcattcttatcaatttaagggatcttaaaaggatttggaaatggaacaagtagcttccagaccagatactacctgtggcaagaatgctgcctaccagttaactgctggtcctaccacagtcaaagtattcctyaktaaagagwgaatctcaggttctcactggaggcactgtgcatattttcaaccagatcaccaggagctgagatcttcttcagtccctagccaggaatacccatttgatttccagggtgccatctaatcctgggctgtacatgtggatatggacttgaggcccacctctgtgtccaagtggattgagcatatatgcctaggaggagatagactgttaatcgttggattttgattttttttttttatgcctgcaaataatcaaaagtaaaactggagtagcctaattttctgggagcaggtggagaactttccctcctacacagtgaggacagtcccagtctgctgggataagtgagaaagcccagggtgtaggaaggccctttttacatactcttttctcatgagagctcactattttaacaataaacaataaacgttgtttctaattttaaaaaaaaa

SEQ ID NO: 2082 - DNA, 1212 bp, Homo sapiens
gccctccccagctagaatgaacattctgccaggcagggaccaatatgttttatctctgaatctctaggacagtgctaatcaaataatagaccatcagtaatattcgaatacatgtatggataagggatttgttccaggtcacatagctagttgttgctaatagaaaggacaagtatgtagataccagccacagtttttttagtatctctacgccctattgcctttcctttaactttaagcttggtcttacccatattttctgtagtttaaccttgcttttgatccctctaaggggctgttttatataaactcatgatcattgttcttttttctctctctttccttcccctccttccttcccttcttctctcttcctacctctgtctctttttctttccttcccagtctccctcctctttcttttttcacttgtaggcttctgttaattaatcaatatggtacttattaagcactgagtcaaatgtctaacactgtactgtatcctatgagaaatgaaatagaagcagattgaagacataccattacttgaggaatttaatattttattagccccttcttctcaatggcctttgtgctcttctggttctggttatctgtgttcttttctggccttctgccttgaccatttcttttggcccctgccttggaaattagtacataatttaccctcattttggcttcacatgatccagctacagcaagacccaaataagaaaagatgttacagcgacattgatgaagttggtctaacacagaaactgaaagagtgagagagacagaagaaagaagcatgaagtagggaatgaggagtagagaatgtcaccaacggggaattacatgtgaccaaaaaatcaaaagattatgactgggtacatatgaaaaataggtacaggccaggtgtagtggctcacacctgtaatcccagcacttggggaagccgargtgggtggattgcttgagcccaggagtttgagaccagcctgggcaacatggtgaaaccccatctctacaaaaaatmcaaaaattagccsggcatggtggcacacaactgtagtctcagctactcaggaagctgaggtgggaagaycattgagcccagraggcaraggttgcagtgagctgtgatcctgccactgsactccagcctgggtgacagggcaagaccctgtytmaaaaaaaaaaaaaaaaaaa

SEQ ID NO: 2083 - DNA, 1018 bp, Homo sapiens
ccacgcgtccgcggacgcgtggctttgaaccattcaaataccacattaggcaagactgtgataggccttttgtcttcaaatacaacaggcctccactgacccatccctcaaagcagaaggaccctttgaggagagtacagatgggattccacagtggggtgggtggaatggaaacctgtactagaccacccagaggttccttctaacccactggtttggtggggaactcacagtaattccaaatgtacaatcagattctagggtctgttttcggaagaagcaagaattatcagtggcaccctccccactgcccccagtgtaaaacaatagacattctgtgaaatgcaaagctattctttggtttttctagtagtttatctcattttaccctattcttcctttaaggaaaactcaatctttatcacagtcaattagagcgatcccaaggcatgggaccaggcctgcttgcctatgtgtgatggcaattggagatctggatttagcactggggtctcagcaccctgcaggtgtctgagactaagtgatctgccctccaggtggcgatcaccttctgctcctaggtacccccactggcaaggccaaggtctcctccacgttttttctgcaattaataatgtcatttaaaaaatgagcaaagccttatccgaatcggatatagcaactaaagtcaatacattttgcaggaggctaagtgtaagagtgtgtgtgtgtgtgtgtgcgtgcatgtgtgtgtgtgtgtatgtgtgtgaataagtcgacataaagtctttaattttgagcaccttaccaaacataacaataatccattatccttttggcaacaccacaaagatcgcatctgttaaacaggtacaagttgacatgaggttagtttaattgtacaccatgatattggtggtatttatgctgttaagtccaaacctttatctgtctgttattcttaatgttgaataaactttgaattttttcctttcaaaaaaaaaaaaaaaaaaaaaaa

SEQ ID NO: 2084 - DNA, 2045 bp, Homo sapiens
cccgggtcgacccacgcgtccggaaagatccaaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctagaggactgtcactctagcatctttgaggactgcgacaggaccgggacagcaggccccttgacagcccctcccacaggatgtgggctctgaggcctaaaccatttccagctgagtttccttcccagactcctcctacccccaggtgtgcccccttagcctccggaggcgggggctgggcctgtatctcagaagggaggggcacagctacacactcaccaaaggcccccctgcacattgtatctctgatcttgggctgtctgcactgtcacaggtgcacacactcgctcatgctcacactgcccctgctgagatcttccctgggcctctgccctggcctgcttcccagcacacacttctttggcctaagggcttctctctcaggacctctaatttgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagacctttaacaaatgataccaattaaactgccctggaaagggcataggtgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2085 - DNA, 343 bp, Homo sapiens
ccacgcgtccgcggacgcgtgggcgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctacttttttgaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2086 - DNA, 1766 bp, Homo sapiens
ggcgcgctgcccggarctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatctccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggaggtgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactrcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacawataaatccacacccatgccctcaaacacaaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcatatttatttttgtaaatgattctgtgcccaggagcagctgggggttccacctcagggtggggcgggcaggaccccgtctccccaggtgtcggagcctgacctgaattaaagtactgactgctcgccacaaaaaaaaaaaaaaaaa

SEQ ID NO: 2087 - DNA, 847 bp, Homo sapiens
gcgtcgcgcgctcttcctcggagctacccaggcggctggtgtgcagcaagctccgcgccgaccccggacgcctgacgcctgacgcctgtacccggcccsgcatgagccgctacctgctgccgctgtcggcgctgggcacggtagcaggcgccgccgtgctgctcaaggactatgtcaccggtggggcttgccccagcaaggccaccatccctgggaagacggtcatcgtgacgggcgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagcttgccatcgtcctcttcaccaaggagctgagccggcggctgcaaggtacgggggcgctaggctcggcctccctcttgctttactctgagcctagagcggcctttccatgatcctaggcttggaattggggggg

SEQ ID NO: 2088 - DNA, 1174 bp, Homo sapiens
ggcacgagcaaaggcaggaacttttgtcatttttgttcttcaagatgtccccaatgcctacagcagtaagtgcactgctgggcacacagtaggtattcaataaacattcaatgaatgaatgaatgaatgaatgaatgaatgcattgccaaaccttgcatggctgccttttgttcctgccctagctgctgcctccccagccggcctggctgctcccgagagcagagatgtgccttttcctgtgagccctgccacacagttgaacattgggtagagcccatgggccaggggcagaggcaggaacacactcagggcagcgtgctgccttcctcccatccttctagaggcaaagccaccacagtccattcctgttgccaagagccttgggggtaggggaagtagacaggaattcaccactccttaaaaccagagaagtccagagtcctctgagggacagggctcttgatgttcagagggaatcagcctcggcctggggaggctgggatttgggtggtttattcttcagcatccacttcttctccagggagtctgtcagtgacaggaaaagtgactcagaaccccagagccaggcctagtggacactaggttctgcctgtcccatggagggtgctgtggctttgacggattagaagtcaggacttggccatcatgactacatgctttaaaaaatatgagttttctttttttgttttgggttttttaaggcggtggggggctactttgtgtttaggttttacatcctttgcaataaagttccacccatccagcttgtgcagtgaaaaagagggaaaggacttcagtggctttgccttgtctatacatgggccagagagaaaaaaggaagagggctgggcgcggtggctcacgcctgtggtcccagtactttgggaggccgaggtgggaggatcacctgaggtcagtagttgagaccagcctggccaacatggcaaaatcccgtctctactaaaaatacaaaaattacctgggcgtggtggtgggcatctgtaatcccagctactccagaggctgaggcgggagaatggcttgaacccaggaggcataggctgccagtgagccgagatcatcccatggcactctagcctaagggatagagtgagactctgtctcaaaaaaaaaaaaaaaaaaaaaaaaaaa

SEQ ID NO: 2089 - DNA, 1890 bp, Homo sapiens
  misc_feature (260)..(260): n equals a,t,g, or c
ggcagagraaaaacaaaatgggtaatgcattcgaggtgacagggttaatgttggcattactttgttatgttgttgatgggcagaaacccaaggkggggttttkttgagcataaacacaagaagcaattatttgtggcactagacttaacccaaaggacagacccctacatgtatatagtagagaaatcctgtcttttagcactatctcacaggggaagctgaggaatcacattatctttaatataaataaatgaaatgcnagcactgtataatttatatccttaagcaactggattcamcgtaccactaatggcctggtcatgttttaaacattaccccaaaacagcctaactgttctgtgactcagtgtctctgtggaatcctatttagtagcaccatggtctctaaatgttttgattacacatcagtattaggaaaacatgtttgaagcattgtctaagtctgtttgtgctgatgtaacagaataccatagactgggkagtttataaagagagaaattattggcttacagttgtggaggctggaaagtctagtatcagcgtactgggatttggcaagggccttcttggtgcatgatagtatggtggaaggtatcacacggcaggcagaaaggcagagagagaacaaaagggggcgaacccactcccttgatgagaacctaaatacctcttaaaagtcctaactctcaatgctgtttacaatggcaaccaaatttaaacaagagttttgtagggaacaaacactcaatcaaaaccatagcaagtatgtaccatgactgtatgtgtatttataaaatacattcatatatttctacagcaatatatatgaggtacatttaagcatgtaaaaataggaatttttaaaaataggacagttgtaataatttctttgtacattccactttggagactgtttttatatggrgcttgttttatcaccaaaaggcattttaattttgcacactttagawttcttacaatgtgtaattgactgctagttgctgaacaaaggacagataaagtgtttcctgcacctgagcagcctaaaggtgagtgtaatacagatgcacaagtgactggttgataatggaatgagaccccttataagaaagacatacagagcacggcagaggagcaagaacmacacagaggcaatgacatttgagctaggcctcttatatctgtagatgaacatttgatggtaggtagtagggaagatggaactaagaatatttgagctacttaatatatgccaggcagcatgctgagtgcttgtgttcatttaattctcaagacagccataagcggcaatacaggtattgggcctattattctaaatcccattttataagagagttaggattagattcagttccatctttctacaaaacctggcactgtcattccaggcaaagggagtacaatccatttttctcttaagaggttgattttgccaatgagacagaatgaatctctacagcttgttaagtttcwacccgtctttgggtgactgaaaaattcaaatgtaaagatgtggcaaaattggttctctaaggattttaagtacagccaaatgatatgtcacaagttttttcctaaatatccaaccatttagtctttcataagcttttaattccactagcctcactttctgagattgttgatgttttcttgttctaacctgaaattttctttgtttgatgttaacaggagtataatgaaggagtaaccatttttattttatgatagtctatcaatagactttttttaaccttctttaagctaggtgtgtttgtcctttattaaagtcagtttgacccagcctgtacaacattgcaagaccttaactttaataaaaaaaaaaaaaaaa

SEQ ID NO: 2090 - DNA, 822 bp, Homo sapiens
gatttaccacctagaaatggtgtttttaaatttcttaatatatctccttcttgtctttttctatatatctttatttcatagtcgagacaattttatactctgaatttttatcatataagtatctacccacattatcaggaatgctttgtaagcatcattttaatggcttcaaaatagtctatgatttagataacgatgatttggccatttttgtggtcacctaccacttattggagacatattatattctgagaatattatgccatttataggcattaattccaatatgcaaaagaactttgaaatgaaggcgttattattcccaattttacagatgctgaaactgaagctcagagaggttaagttgcccgaggccatacaggacaataggggcaaagatggttttgaatcaatggatgtctgacgacaaaggccatgatctcaccactgcactgcactgtctcctgaagccctttgtgtgaaatgattaaatacatcatgattatgtcacacttcacttacccttctccaggtagttgaacatctggatgattttacatcgtcaaatacaaggttgttaacaattaaaggataaaacagggtgcggccggaaaggcggccgccccctcgcccatcatgcaatgcacattcgtggggaacctggcgctaagccattcgtagatgacctgcttctggctcggggtttcatatgtagcagagcagctccctcgctgcaatctattgaaagtcagccctcgacacaagggtttgtaaaaaaataaataaataaaacaaaaaacaaaaaaaaaaaaaaaaactcga

SEQ ID NO: 2091 - DNA, 1473 bp, Homo sapiens
gaattcggcacgagccgcggctgagggcagggggtcgctgcgaaccccggggttccgcggtggaggggtgctatactgggatgcaggcgcggcggggactggcagcaatcatgccctgggagctaacgtagagctttggataatgcttttgcaagttgtacgagaagggaagttctcggggtttctgacctcctgcagcctcctcttgcctcgggctgcccagatcttggcggctgaggctggcttaccttcgagccgttccttcatgggatttgctgctcccttcaccaacaagcgaaaggcttactcggagcgtagaatcatggggtactcaatgcaggagatgtatgaggtggtgtccaacgtccaggagtatcgtgagtttgtgccctggtgtaagaagtctctggtggtatccagccgtaagggtcatttgaaagcccagctggaggttggctttccacctgtcatggaacgttacacctctgcagtttccatggtcaaacctcacatggtcaaggctgtttgtactgatggcaagctcttcaaccacttagagactatttggcgattcagccctggtattcctgcctatcctcgaacctgcactgtggacttttcgatttcctttgaatttcgttctctgctgcactcccagctggccaccatgttttttgatgaggttgtcaaacagaatgttgctgcctttgagcgtcgggcagccaccaagtttggtccagaaacagccatcccccgtgaactgatgttccatgaggtgcaccagacttgaggcaagggattgctccctgacctcccttctaccccacttccctacacaattctcttatttatttggtttggctcctgttccaatttgaaaggagtctgtgttcataatactgtttcycctctcaatttcccagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaaggattgaataaattgagcttttcttctggcacagaggtactgagtggtaagtaacttttaccctgcctgagattcctcaggagaaaaggcaacctgcctccagcctgaaatacataaagcctcattttaagactgtaagtccatgctgcctggctactagagagcaaggggctttcttaccaccagtgctgaggagaaaagtactgaacggaaacggagttgtctttgtactcttgagttgtaccttattcttccacttggcctgagtttttataaaatttcaataaattgtgacagtgtgaaaaaaaaaaaaaaaaaagatctttaattaagcggt

SEQ ID NO: 2092 - DNA, 2534 bp, Homo sapiens
ggcacgaggtaacttttagaatgaggcagacaaagttggaaggctggttaattttccccttgttctcctgcttcagcttcatttccttgggttctgatgaaggacctgagatttttataagtcatcttaaaagccttgctgattactcaagagccttagtagaagtctgaaggggtgctctattgaggcctcatgtattcagcctcctactggtaacttttctgcataactggactgtaaccccagttacagatcttttaaaatttttgccatttctgaagtaagtctttattcctacagattattgtgactagagtgttaacttttcgttgtatgaatcaaagcatgtcttcagggcctcttgcactattaccccagtacctagattcctatatacattcttatgattgcctcttatagttatcttcttatagttttatctcttctttgattcattttcatttcttttttttatagacacatttattcagcatcacgatcaaactattacatttagcaatcaacagcatgagtaaaaaaaattatctacactaaaactctttgttggcatgctttacattttccacagaaaagaaactaaaataacctgttatacaattagtcacaaatacagtcctacttttttttttgcctatacacattaatattgtctaaaacatgtcttctttgtagcagctaggccctgccaccactgtgcttggctgagttcacaaatctgttgtaacctgtagcttctttgtcacttctctggctctcttctgctaagtatttttctggcagtaattaaaatctgccactgccatagctactgactggaaccaccatagctgccttggttttgtgttttggccagtatagaatccagagcttctgcctccaaagtttcctcctttcgtgcatccaaaatttgaggactgattgttataattgccaaaattattgtagcttccaccacctccaaaattgctttcactgccaccaacaaagctgcttctgcctccatcgttgttatagctgtgagagctgacactcctgctgtagccactgccctgatttccataatcctgcctccacttccatagcctctgcttccttcagcgtaaccagggctgcccctctataaccactgttgttaccaaatccattatagccatccctgttgctaccagatcaccaccagcatggctgctaccaaagtcaccacaaccactgaagtttctcctccatgaccaaagttgtcattcccaccaaaaccacctccacgaccatcaccagagtttccagaaccatttcgacctctttggctagatgaaacactagccatctctttcttcgacagggcatccctaacttcatagttgtggccattcacagtatggtatttctttttttttctctcgagacaaggtcttgctctgttgcccaggctggagtgcagtggtgtgaacacagctcactgcagcttggacctccggggctcaagtgatcctcccatctcagcctcccgagtggctgggactacaggcgcgcaccactgcacctagctaatttttgtattttttgtagagatgaggtcttgccatgctgcccaggctggtcttgaactcctgggcaagtgatcccctgcctcggcctcccaaggtgctggagttgcaggcgtgagccactgcacccagccagtatttcttttaaaaatatttgtttatttattttgagacagagtctcacactgtcggccaggctggagttcagtggtgtgcgcatggctcactgtagcctttacctcccaggctcaaacgatcttcctgtctcagcctcttgaatagctgggactataggcacatgccaccatacccagctaatttaaaacaaatttttttaaatttaaaatgtatcttttttaaagcccccaacaaatatccttttcatagttaagtgggcatgtggtctttgagaatcttctcttgatacagctcttctgtccaccttatgtagccttgcattcacggctgcatccacctcctccacagtggcatatgtgacaaacccaaagcccctggagcacttggtatttggatctctcattaccacagtctgtgagtgctccctgttgctcagaatggctcattggaccctcactggtcatttcaaagctcaactctctgatgaagaacttctacagctgttgggactacttaagagactctgtcttagacatgatagcagtgggaagagagactttaatgatgttttcagcggcatccatgggtagaaaaagccattctcgtttctaattgctgaatatactctgctgtgaaattagacttagggcaaactgagactcagtaggcatgttatagaaaaatatataatcaggccagttgtggtggctcacagctgtaatctgagcaccttgggaggctgaggcaggaggattgcttgagcccaggagttcaagaccagcctggacaacatagggagactctatctctaccaaaaaaaaaaaaaaaaaa

SEQ ID NO: 2093 - DNA, 928 bp, Homo sapiens
gaggagcatcgctacttcaaggccaatgacacgctgggcttcatgcttatgttggctgtgctcatggcagctacccatgctgtctacggcaagctgctcctcttcgagtatcgtcaccgcaagatgaagccagtgcagatggtgccagccatcagccagaactggacattccatggtcccggggccaccggccaggctgctgccaactggatcgccggctttggccgtgggcccatgccaccaaccctgctgggtatccggcagaatgggcatgcagccagccggcggctactgggcatggacgaggtcaagggtgaaaagcagctgggccgcatgttctacgcgatcacactgctctttctgctcctctggtcaccctacatcgtggcctgctactggcgagtgtttgtgaaagcctgtgctgtgccccaccgctacctggccactgctgtttggatgagcttcgcccaggctgccgtcaacccaattgtctgcttcctgctcaacaaggacctcaagaagtgcctgaggactcatgccccctgctggggcacaggaggtgccccggctcccagagaaccctactgtgtcatgtgaagcaggctggtaggcagacaggcagagagaaggtcatggccaccgtgatggggccaacagcaagggaggggtaggggcccatacaggagtcctcctttctgagctccagccccagcccctcgaaccacctgtaatctaggcacctttgccaacacctcccaaggatggaggactgggcgagggactgggaaagaggcatatttagttttgtggggcctgtctccgctgcctccttctccacttctacaatctcattctctctctctctctctctgtctctctctctctctctctctctcagaagtgacaattcaaaaaaaaaaaaaaaaaa

SEQ ID NO: 2094 - DNA, 1984 bp, Homo sapiens
  misc_feature (1115)..(1115): n equals a,t,g, or c
cgtcagaatccaccttgacgtgctgtgcgtatctgtgaacctggagcrgttacttattttgacagatatcactttgggtctttttacattaaatttcttttctctaaggaatataagacataccccatagctctgygtgagccagcaataccgctgccccctggcgacagggcagaccaatgatgccaggcagctgtcacacgctagtattggcttcattgtgatctgagccctgcacgctgggccttcagaattaatggccagcagtgtcagggatgagcccgtcagccagggcacaggcctggytcacagtcctkcacacctgctggcctggggagctccagccaggcagcgagtcctgccccgcccgcagctccctcccacaccccgcctggccaagatgactgcttcagggggctttggggaaagaattaggaagggtcagaaccaaacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcagtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcccgcctcccctgccatgcaaccagatgtgttgtgagtgggcagcgtgccccacgctggagtaactccgcacgcttctgtctttcacggtgggcgctcggggggagcctgaggaaaacccccttaggtacctgtgcgaggctgtggagtgcaggccagagcagggtgtgcgtanccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatcccacgtgtctacccagacccttgtgcggcccatgcccygggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttctagtcatcaggactatctcaccctcccactcctgtttttaaaactcagaattctttcctaagagcccttcgagcaaagcgtgccgaagttagttgtcttctctgtgstggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttcttcgtgccgaattcggcacgagcccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctatactttctgcataatgaattaa

SEQ ID NO: 2095 - DNA, 1124 bp, Homo sapiens
  misc_feature (1)..(1): n equals a,t,g, or c
nccagattcccataaagcacatggtctaatctgttacgtaacagcaagacagcgtcacctcacctgttctcgccctcaaatgggaacgctggcctgggactaaagcatagaccaccaggctgagtatcctgacctgagtcatccccagggatcaggagcctccagcagggaaccttccattatattcttcaagcaacttacagctgcaccgacagttgcgatgaaagttctaatctcttccctcctcctgttgctgccactaatgctgatgtccatggtctctagcagcctgaatccaggggtcgccagaggccacagggaccgaggccaggcttctaggagatggctccaggaaggcggccaagaatgtgagtgcaaagattggttcctgagagccccgagaagaaaattcatgacagtgtctgggctgccaaagaagcagtgcccctgtgatcatttcaagggcaatgtgaagaaaacaagacaccaaaggcaccacagaaagccaaacaagcattccagagcctgccagcaatttctcaaacaatgtcagctaagaagctttgctctgcctttgtaggagctctgagcgcccactcttccaattaaacattctcagccaagaagacagtgagcacacctaccagacactcttcttctcccacctcactctcccactgtacccacccctaaatcattccagtgctctcaaaaagcatgtttttcaagatcattttgtttgttgctctctctagtgtcttcttctctcgtcagtcttagcctgtgccctccccttacccaggcttaggcttaattacctgaaagattccaggaaactgtagcttcctagctagtgtcatttaaccttaaatgcaatcaggaaagtagcaaacagaagtcaataaatatttttaaatgtcacagatcaaaattgtttccttcaaatggggtctgccaattcacaaccagatgacccattttaccctattcactgcagactgaatccagattttacacatacttatcccccccaagaccctcactctgtctccattggcctacttgttcatctttcactcattcgacaaatctttttgaggtaagagcgaggtgggacaaaaaaa

SEQ ID NO: 2096 - DNA, 1003 bp, Homo sapiens
  misc_feature (6)..(6): n equals a,t,g, or c
  misc_feature (28)..(28): n equals a,t,g, or c
  misc_feature (810)..(810): n equals a,t,g, or c
acgggnaatcccccctcactaattgccnacaaaagccggagctccaccgcggtggcggccgctctagaactagtggwtcccccggkctgcaggaattcggcacgagtgcaaagctccagatttttggggaaagctgtacccaactggactgcccagtgaactgggatcattgagtacagtcgagcacacgtgtgtgcatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtntcaaactcctgagatcaagcaatccgcccacctcagcctcccaaagtgctgagatyacaggcgtgagccaccaccaggcctgattgtaatttttttttttttttttttactggttatgggaagggagaaataaaatcatcaaacccaaaaaaaaaaaaaaaaaaaaaaaaaaaaaaaaaaaaaaaastcgacc

SEQ ID NO: 2097 - DNA, 1892 bp, Homo sapiens
ggcacgagagaaggtgtttaagaagaagccagcagataaatgaagaacaatcacttgttttatgatagtatattacttggcattttttggactcctagatttatgccttggtgaaggtaatttttcagcacgtgaggctgtctgggtcatctgtttttttgctcgtgattactcacctaagtactataggtaagttgggcggaaatccttgctgttatgtttaatgtcccttgccattttcactgcattagtgttccctccttgctatttggatgtaaatattcaccattttcactttccctgctgactttctcatctgtctctgacaaaattcatatacatctttaccaggaaagcatattttatctaaataatagctttagtcacaaaggtgtgtttttttgatagataatctgagagaaatgagtggaactcttgatgttttccaaggaactgatttggtaaatcagatttactatattatgatctatttttctaaaaatccgacaagaactaagaagcaagaaaatgcactccagcctggccaacagagtgagactccgtctcaaaaaaaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtaagaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaataaaaaaaaaaaaaaaaaaa

SEQ ID NO: 2098 - DNA, 2184 bp, Homo sapiens
ggcacgaggcgcccgaggatgtgctgctggccgctgctcctgctgtgggggctgctccccgggacggcggcggggggctcgggccgaacctatccgcaccggaccctcctggactcggagggcaagtactggctgggctggagccagcggggcagccagatcgccttccgcctccaggtgcgcactgcaggctacgtgggcttcggcttctcgcccaccggggccatggcgtccgccgacatcgtcgtgggcggggtggcccacgggcggccctacctccaggattattttacaaatgcaaatagagagttgaaaaaagatgctcagcaagattaccatctagaatatgccatggaaaatagcacacacacaataattgaatttaccagagagctgcatacatgtgacataaatgacaagagtataacggatagcactgtgagagtgatctgggcctaccaccatgaagatgcaggagaagctggtcccaagtaccatgactccaataggggcaccaagagtttgcggttattgaatcctgagaaaactagtgtgctatctacagccttaccatactttgatctggtaaatcaggacgtccccatcccaaacaaagatacaacatattggtgccaaatgtttaagattcctgtgttccaagaaaagcatcatgtaataaaggttgagccagtgatacagagaggccatgagagtctggtgcaccacatcctgctctatcagtgcagcaacaactttaacgacagcgttctggagtccggccacgagtgctatcaccccaacatgcccgatgcattcctcacctgtgaaactgtgatttttgcctgggctattggtggagagggcttttcttatccacctcatgttggattatcccttggcactccattagatccgcattatgtgctcctagaagtccattatgataatcccacttatgaggaaggcttaatagataattctggactgaggttattttacacaatggatataaggaaatatgatgctggggtgattgaggctggcctctgggtgagcctcttccataccatccctccagggatgcctgagttccagtctgagggtcactgcactttggagtgcctggaagagctctggaagccgaaaagccaagtggaattcatgtgtttgctgttcttctccatgctcacctggctggcagagcatcaggctgcgtcattttcgaaaagggaaggaaatgaaattacttgcctatgatgatgattttgacttcaatttccaggagtttcagtatctaaaggaagaacaaacaatcttaccaggagataacctaattactgagtgtcgctacaacacgaaagatagagctgagatgacttggggaggactaagcaccaggagtgaaatgtgtctctcataccttctttattacccaagaattaatcttactcgatgtgcaagtattccagacattatggaacaacttcagttcattggggttaaggagatctacagaccagtcacgacctggcctttcattatcaaaagtcccaagcaatataaaaacctttctttcatggatgctatgaataagtttaaatggactaaaaaggaaggtctctccttcaacaagctggtcctcagcctgccagtgaatgtgagatgttccaagacagacaatgctgagtggtcgattccaaggaatgacagcattacctccagatatagaaagaccctataaagccagaaccctttggtgtgtggcacgtcttcttccctcttcccctgccacagagatttctcccatccaacttgcttgtttgccttctgctaactcagctgcacgctgagcaccaagagcttgtgatcaaaattctgttggacttgacaatgttttctatgatctgaacctgtcatttgaagtacaggttaaagactgtgtccactttgggcatgaagagtgtggagacttttcttccccattttccctccctcctttttcctttccatgttacatgagagacatcaatcaggttctcttctctttcttagaaatatctgatgttatatatacatggtcaataaaataaaactggcctgacttaagataaccattttaaaaaattgggctgtcatgtgggaataaaagaattctttctttcctaaaaaaaaaaaaaaaaaaaa

SEQ ID NO: 2099 - DNA, 1191 bp, Homo sapiens
ggcacgagagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagcctttgcaaaatgttagcacagtgctgcagaagcctaatcctctctataatcagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaaaaaaaaaaaaaaaa

SEQ ID NO: 2100 - DNA, 2526 bp, Homo sapiens
gacaggctatccgagaatctgagagctgggcccggcaattcctccagytacccttgtgacctaagtccagtcacacatttcccaaagtttctctttgtcataaccctggtctggctggttttgrggrcttgagaatgggtcagggactccaggccaagtccaacagagaccccaaacccaccacacaccagcagccacaacctcaccaccaacaaagaggacttttgtggggccacaagtaagaggtcatttctggaatggactcagacctttaaacaggagagttgagcacttccagksagtttttaagcaaggcatggggaacagggaatagaacctttcaaagaggttgcccagagaaaagctgggcctcttgcattcggcttccttggagcagcctcttctggcagaaagccatcaggtgctcaatcatcttctcctggccaaggctctgaccatgcttagtactggaatagaggtggccaggcccccagcgactcttcttggcctgatgtttgtcctcacaggcatgccacgtggcctgagatgattcagaacaaatcatgctaactttgaatccatccagccacttgcaaatgataatcagaagtcagcttgttcactgttagaaagaaactaacaaaagagaacccagagcaatctagaatctttgagtgcttggctttccaaggatactgcggagactctggccaagctgatgamcttctgaartgtcactggcaccatatgcaacaagaaccaccattcactgagtagctaatgggtttggggcctgggacattccatctgaggtccttcctgaacatgtcactccacagcagaggaccggttgcagcttacccagaaccactcctccaggagagctggatgttttgcgtgcaacaccttgagcactgactgctattgttcaaaaaaagcctttgctgcattcggaggactgccccgtgccctgaggtgacttcctaactatgtggtttcattagcgaatttattttttgtgctgggtggacatttgtattttgttaggttgctgtttaagctcaagtttgctgtgctctctgcagctacaaaacatcttggcatatttaagaktggcttttataaatagctttattctgatattaatcagattcccaactttactgagaattaaggactggggtactttaaagaaatgcaaatagcaattgaagaaccactgctgcaggtggtagccctggctagactgaattacactagaaatcagccagaaggaagcgtccttgggatcccagatcactctttttttttttttttttaaaaggggcagccccttgatggctcatctctctgaataacagttacgtcttcatatcgataccagatgccttcttcatcatgccactgaagccactcaccaccttcaagaacatgccaacctctgtcagattcacttacccacaaacaaggaggcacgtttggcacaaagtgttgtcctccaggtccaagtggactctacagagtgcttgacctcaacacactggattccaggtggactggaccaagagcaggcaaagacacgggaactgaaaaactccacagggtttggagaatagaaatgaaaagccacgtcatataactcaagaataaatggtgttttggaaattttaaaattatcatcgaaggtggtgaaactatttcaggcccaaatgaaaggaaatcgccagttggggatgaaatcacagagcctgtgttttatgatatggttggatgtccactgatgaaattttaaaggagtttcatttttaaaagtgcgcatgattctacatatgagaattctttaggccaagaaactgtccttggctcagaggtgttgggaattaaagcagagagaagccattcgtgatgcttagaaccaaggatggtcatgtacacaaagaccatcgagacggccattcttgtttacaaaacacttaccaagaaagcactttgtaggggaactttagtaagttcttctcatttcattatgtttcttccaaggaaacaggagagactgaattaataattctctctttcctcttaagcacttttaaaataataaagtacatcttgaaatttgggggggcatctctgatttaaaaaaagaaaaaggctgcttgatgtatgttatgcagagacactctgcctctggtggctgcagagcaatacccaagcctcatttggaaggctcaacatttggaattgcactttaattgattaatcctcaattcatgtggccttacgggatggtgggtctgggaccccaattcattcttatctgccaaagaattatctagaagcacatcaaataccagcaccccacctgcacaatgggggtggaaaacttttgtatccctaagcatattattttatagtgtctgccatgccatgtggaaatactttatttttaacctcaggatttaaataaagtaaacactatgacatttaaaaaaaaaaaaaaaaaactcgaggggggcccggtaccca

SEQ ID NO: 2101 - DNA, 1249 bp, Homo sapiens
  misc_feature (1214)..(1214): n equals a,t,g, or c
tttttttaaaatactcatgcaattttatttctagttgatacaattttaaaggccatgtacaaatgttatacatttttatttttgttctttttttaggaaaaaatacacaaaaggcaaaacatcctcaaatggtccttttatacagtgcagaaggaaatttcaaatttcaaatacgtgtcacaaatgctgcactctagcagccaaaatacaaaaaaaaaaaggagggtagtccttcatattatatatatatttatataaaacatatggaaatttgtttttacacagatcggtctttgtttcaaatttacaatggatatctaaaaaaaattctacacggcaaatattgccaacaaagttacaccattaatactgataaacggaggagcctacgcggtgttttgattattagggaaagaaagtagaataaataaacaggagccttgctatagtttttaaaagtgccttaacctttctgcgtccccgcaatcctgaatccgcgcggtcaccgggccgtcctagtccctgcgtcgcgctgtgttcggctcgttctcggaccagaaagtttacagtagaggttggaagacagaaaaatacccactgaaaaagtctaaataaaattcaagacaaaacataacagaagaggctgaagcgaaggaagaggaggaacatggaaggggacggcagrcggacgcccggacggccgcttgcttcgtggctccttcgactttctgtttaaagacggacagtggcttccgaaatgcaagttgttcgcacaaagatccacctgtggtccacggaggagacttcggaggtggggagggagatcgggagggagatctgagctcttgtcacttcccgctccctgcaaaagacggctctaaagggagacttgcgcattccaagacattctttcaaaaaaaaaaataaaaaataaaaagataaatactcaaccaaaaaataaaagtatttgataatgattggtctcacatgtttgcttttcttctaaaaattttcccccacttctgccattggccggaaggaggggggacctcagcagaattcctgtgtgggtgcggaaggctttcccctcacagcaccgtctcaggcgggttcaacaggatcaaaaacttttatttaccgatggctgcagtcagatcagacccaccactaacatttcttaacaattttgagggagtgaggaaggaggtgccaancgcagcgctgtgtctttgcattggggactccttgc

SEQ ID NO: 2102 - DNA, 1787 bp, Homo sapiens
  misc_feature (1)..(1): n equals a,t,g, or c
ntgcttttcccagcagtattagtgtcccccaggacaggggaccttttccacattacatcactgccccatcccaccttacaacactctggcccctctgcttggtccccttttcccccaggcaggaggcaatcccaggggcctgcctgatagaggcatttcctgtccctgtctcctcctgcatctcctttatcctgcactgccaccctctattccccattctgtgttggactttgaaggccccaagcccagccaaagcactgagttcccccttaagacacctccacaccctccccacaagcaaagcacaaattttggggtccatgtagcatgggccacgtaggaggctcctgacttgccaggggcccagcctcagcatacccaccgagcagctgccagcctgggctgagggtgggcatgaggcaggagtcagcacttggacctagggatgtgaggttttctgtgccccaagtttgtgggaaggtgggcactactgctgggcccacagacacagccagctggcaaaagggaggtctagcccagcagagagatgaggacattttgcttctccttcatgcccacagcatgagctgagcttctgctttgctggaaatgaaataaacttggtatgaattgtgccaaggcctccccagttgtcatcctgcctcttgttgccctccctgtccttgccccccaccccacacccatgcccctgtttccttacagattttgatattgttctaatgtgtaatagaaccagccgagtccccttttatcagaagggtctgaaaagcagcagcacagagtaggtgaacacaggcctgcaagtgcgaccacctcagacccagtacgtgtgcccacagtggacacaytcacacctccaacacacccacgcgcaggcatgtgtacacgcatgtacacacggcatgcatgcacagccagatggccactcagcacagatgtggcagagggaatggtctgatcctgctgaaagccattaaggagaaacgaatttcccagtgcccgggctgcaagagagccttataggggccctgtttcctgggcatgcgcttcctctgccagccaacccccacttgcccaagtcactggtgcaataacttttctgccttcctcagagcagagaaattgggaattgtgttaggtgggtgtgggcagctctgctgagccaagcagacacggatgtcccctcttctgggaggagggtagtgctcccaggcctcaggagtccagacagagacccccaaagcctgactgccaacagaaaccctctcctagtgaggggcaggtgggtgtgccccaggtccccacacccacagggaggcttcacacactgcccagtaccggggatsccaggaggcaggcccctctgctgctgccactgctgccaamactgcccagcttgtgaggcccaggaggagcccctgtcccactcggtgctgctgctcttctgacccctgctgtgaggaatgggattcttggtcgaaaaaattggttttccttttttgtataaatgaaaagaatccaggagaagctgccaccctcccctcccagcgtgatgcgctaccttgcttcggcgtcttgtcgccctttccgcctttggtccagggacagcccagcagatcctcctggttctgacctggggggtgtttgcatcacccccttttacttgtattaaaaaaaaatgatgggttgaaaatgtactgaggattaaaaatgtacttttttataaataaagtgtttaaaacaaaaaaaaaaaaaaaaaaactcga

SEQ ID NO: 2103 - DNA, 1131 bp, Homo sapiens
  misc_feature (839)..(839): n equals a,t,g, or c
cactgcaccagctttgttatctgtaaaatgatgataataccaacaccttcttcttggggtactgaagatgagagaacatgatatgtgtaaagtgccttccacaatacccagaacatagcaaacatgtaatgaatgtagtaatagtaattattttattttcttttgattcagttgggactatgttcagctgtaacagaatacccaaaataactgttttaaacaaattaaagtttwgttgtgaagttttgttacgaattcagacaatccagggcttttatagatgcaccaggatcagcaggtacaaaggcatctttcctgatttctgccagtctcaatgcatgggttgcaatccagartccargatggcagttccagccctggttacgcccatattagcacacagaaagaaagagaaagggatgtgcctcttcactttaatcatagctcccactagatgcacccactacttctgctgatactccattagctaatgcttgcttacatggtcacacttagtttccagagagacatgtctggacagtcatgtgctcaattaatatccaagtgtccaattactgagaaaaaaagaaactagcacctttgcttggttgcattcctcttagcataagccacattctttttatgaagttgtcctcagttacttggatgcctcagttgtcctttcawttagaaawgcycctkggacaycctgaawctgacttcttttgtcatcagcaccatcactaccactgccytcttcaaagccaccacgttctgtccccaggatggttgcaacaaccaccatagggactttttgccttctacttccacacaatagnccagagtaagcttttgaaaatgtaggtcagatcatgtctctctcttcctcttcaaaaccctcccgatggcttttcatattactcaaaagaaaacctaaaactttgctgtgagatctatgtgacccggcttattcttcctcttactttatctctgtattgctcttcctcactctactccagccatcccacctccttgctgcttgtcctatactcctaaaagaagttcagtcttcccttatgatatttgcacttaaaatagaaaaaaaaaaaaaaaaaaaactcgaggggggcc

SEQ ID NO: 2104 - DNA, 643 bp, Homo sapiens
gaattcggcacgagctgctgtggggccaaacgcatcatgaaggaagctctccactgggcccttttcagcatgcaagccacgggccacgtgctgcttcacctcctgttacctgcagcagctcctcgatgccacagaggacgggcatccccccaagggcaaggcctcatccctcatcccgacctgtctgaagatactgcagtgaaagcccaagccctagctttccccagtgaaggactagactaggggccccacgctcaactggtagtggccacaagcctggcagctgtagagccgctaacctcccgacacctccctcaccacacaggaccctgagtgaggaggaggggctggaaacctgggrtgggttggccaaaggagaacctcaggctcctggcctggcccagctccttcctgcccaaggtagcttagcccatccagactggtcctgaagtctgtccctccattggcatgaagtctgcccctcagcagtccggcctcacaggctgtactttcatggtgctctctaccttctggcccccatcccagaacattcgtgagtgaattcgcaagcatactagcatgtgatattagggagtttgcaataaattattgatgctgaaaaaaaaaaaaaaaaaaaactcga

SEQ ID NO: 2105 - DNA, 689 bp, Homo sapiens
  misc_feature (281)..(281): n equals a,t,g, or c
ggcacgaggaggcgatggcccacggggctgctagccgtgctgcggcccctgctcacctgccggcccctgcaaggcacgacgctgcaacgggatgtgctgctctttgagcatgatcggggccgcttcttcaccatcctcgggctgttctgcgcgggccagggcgtcttctgggcttccatggctgtggcagccgtgtcccggcccccggttccggtgcagcctctggatgcggaggtcccaaatcgtggccccttcgacctgcgctccgcgytctggcgctnacggtctggccgtcggctgcggcgccatcggagccctcgtactcggtgctggtcttctcttctctctccggtctgtgcgctcagtggtgcttcgagctggagggcagcaggtgaccctcaccactcatgccccctttggcttgggggcccatttcacagttcctttgaagcaggtatcttgcatggcccaccggggtgaagtccctgccatgctacctctgaaakkcaaaggccgacgcttctatttcctcttggacaaaactggacacttcccytaacacaaaactytttgacaatactgtgggtgcctaccggagcttgtgaagaaatgacctcaagtcactcacctctccaagaggaggataaaaactgaacctyggggagccaggtgtgttggttcacacctgt

SEQ ID NO: 2106 - DNA, 1302 bp, Homo sapiens
cctccggcgggagccacctctccggggcgcatcatcckgcccsscagtgctgtccttattcccagcccagtcaagagctaccggggctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtsctacgccatcattcaggcagagagtaaacaagcaggccagagtgtcttccgacgtggactcctcaaccggctgcagcaggagtaccaggctcgggagcagctgcragcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgartctccgactaggcytccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaaaaaaaaaaaaaaaaaaaaaaactcga

SEQ ID NO: 2107 - DNA, 1147 bp, Homo sapiens
  misc_feature (66)..(66): n equals a,t,g, or c
  misc_feature (1146)..(1147): n equals a,t,g, or c
tcgacccacgcgtccgggcgggcctgtttccgggaggcgcgtggggcttgaggccgagaacggccnttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaaaaaaaaaaaaaaaaaaaaaaaaaaaaaaaaaaaaaaaaaaaaaaaaaaaaaaaaaaaaaann

SEQ ID NO: 2108 - DNA, 1092 bp, Homo sapiens
cagcttggaaaaattgttggccattgtcttttcaaaaatatccttgcttcatttttctcttctttttttgagactctagttgtacccatagtgaacatttgatatgttcacaggcctcggatgctctgtttttctcctctctgccgccgactcttttttcctctcctatttcagtgtagatggtttcttttgaacctgactcctttctcttgtgcccagtgtggcaataagtccagtgaaagaattcatctttgatatcctgtttttcatttccacttccatttggcttttaaaaatgtatagcttccatttctctgctgaaatttcctgtcttttcacagatatttatcacagttattttaaatcttcatctgatgagtccaacatccaggcttggtccctcattctgttaactgtttgtttctttacagtgggtcacatcacttcttcgagggtcttttaatttttaagtaaagtaaaacctggtgtgtaaaagaatgacagagacagaaataacactagaagctgaagtaaataatatttacatcagtccagaaaacagcatgccttttctgttcaaacccattcgtgtgtgtgtgtgtgtgtgtgtgtgtgtgtgagttaatttagtatttatagttgaaccgggcctgggctgtattgctgcttaagttagattcaagacctcacaaatatcaaattaattgaaggtaggattataaccttcccacttgtagtggcttaggatatgaatgcctggaaggtgtgtctattttcctgccctgccattggacttcagcaggctctgtgtgtgtgctgagccttgtgggcgagagcctttcagttccctcatccctttccaaccaagatggacctcttcttggtcctgggtgaggcctagagtgccagtgggaatcataatatttgcctcatgtgattataattcactggtcaattagacaacatataaaaacacctcaaccatctcagtcacgtattaagtgatagctgttattacatctgtggtgattttttaaaactttttgttttgaaataatttcagacatacagaaaaattgccaaaaaaaaaaa

SEQ ID NO: 2109 - DNA, 1639 bp, Homo sapiens
ggcacgaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcgcttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaaaaaaaaaaaaaaaaaaaa

SEQ ID NO: 2110 - DNA, 2708 bp, Homo sapiens
agcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagarctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgygkgccacaacaacctgattcctttagggtcctccggcgcccagggyagtggtggtggcagcacgagtgcccactatgcagtcaacagccagttcaccatgggcggccccgcattctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgcagcacaggcagttttcttctccttctgctcccctgtttctcatacccccaaactcagatgctggagctcaggcccgccgtgtgtgcacccaggcaggagcgggcgctgtccaggctgggccgcccccttggctctccctcctgttccaggggagccataggagggaaagcaggtggcccgggggggatatggggccccagccctgtcccaaagctccctgctcggctgcccctcgcccgcctttatataaattctctgaatcacctttgcatagaaaataaaagtgtttgctttgtaagaaaagtctggaaagtaaaaaaaaaaaaaaaaaaaaaaaaaaaaaaaaaaaaa

SEQ ID NO: 2111 - DNA, 678 bp, Homo sapiens
acattttctatgtagtaaacatgtatgtgtatgtgtgtgggtgtgtgtctaattactttgttggacagattcctgtggtttggaactgctggggccaagtttatacaaaaatctacatttttgagtaaactccccatgactctagtaagtttccacagtatttgagtattctttatttcctaaagctgtacaaacatcagataatcaatatttgtaaggatcgataatataatttataatgaaattgctttatcagctattaatgttaactacatcatcttcatatagccttataactcatttgtgctattccattttcctctgttccttttattttcacttcccttgtaatgttagtctctttgtactgatttctgaagagttcatttatgattaaacatgttaacattttgtctagaattgcaaatatgttttttctcattcattttactatggtgttttattttttggttatacagaagttgtatattgaaatataatcttgttctgttttatgactttggagttttgtggttttttaaaacatgtttacattggtatcatttatttgtattgccttctatttcagcagttagtttgtcatttctttttccattaatcatcattctggtgttaatgaatgcattaaatatttaaagtaaaaaaaaaaaaaaaaaa

SEQ ID NO: 2112 - DNA, 1351 bp, Homo sapiens
gcgctgtgtggctccctcgcgcccaccacgctggcccccgggccccggctcgcccttcccaggcgccggctgcagcagagtttcagaacaagcttcctggaacccatgacccatgaagtcttgtcgacatttataccgtctgagggtagcagctcgaaagtagaagaaagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccagtgagtctgctcctttgcctccctgccatggtgcggtccctcctcatctctcccaccctgaagcccccaccattcatgctgcctcttgttactcttagcataaaatgggccttaactgcagaaatgtcaaatcagaacagtagctgcctagtaatgcccagtgatgggggaccctttgtgcccttggaaaacctcactccaagtagaggctgtatctggagtgagtgtctacagagaggggaattggtcagtgcatggcagaacttgacatggcagaactgttccgtgggccccagagcagggccgtgccgtgccttcctacttggtcatcctgtggctgtaggtgcactgtcccaactgctcacacaccttccagtcccctccctccattctcaccacagttacagtcggagcagggagagacaggacaccaagagacatgggcagggccacgtgtagtctggacagagcccacccagcccagacttggcctcctgtctctctgtgaggggcaagcatagtccgaaggcctggattataaatattagaacataatgaaaaggaaactgtgtggcaaagggataaagggatacagagaaaagaaacaaggaagagatgaggtgacagtttggaccaaggaaaatgccaagagaagacttcacactacctttttttttttctggttttgccattcttttattcatgttgttacactcagtataggat

SEQ ID NO: 2113 - DNA, 1360 bp, Homo sapiens
gtaaccaaatgtttttaaaactccaaggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaccg

SEQ ID NO: 2114 - DNA, 1089 bp, Homo sapiens
ggcacgagctacctttctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcaagacaccctcagtcatcatcctcatcaggacagtcagccctgaactcaagtcttacgctttgggagttctttttctcctccttcgtttgttgggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgctgaggaaaaactataaacgctacatcaaaaaccacgagggcgggctgagcaccagtgagttctttgcctctactctgaccctagacaacctggggagggaccctgtgcccgcaaaccagacacataggacaaagtttatctataacctggaagaccatgagtggtgtgaaaacatggagtccgttttatagtgactaaaggagggctgaactctgtattagtaatccaagggtcatttttttcttaaaaaaagaaaaaaaggttccaaaaaaaaccaaaactcagtacacacacacaggcacagatgcacacacacgcagacagacacaccgactttgtcctttttctcagcatcagagccagacaggattcagaataaggagagaatgacatcgtgcggcagggtcctggaggccactcgcgcggctgggccacagagtctactttgaaggcacctcatggttttcaggatgctgacagctgcaagcaacaggcactgccaaattcagggaacagtggtggccagcttggaggatggacatttctggatacacatacacatacaaaacagaaaacattttttaaaagaagtttcctaaaataaaaaaaaaaaaaa

SEQ ID NO: 2115 - DNA, 1789 bp, Homo sapiens
gaattcggcacgaggctgagggagctgcagcgcagcagagtatctgacggcgccaggttgcgtaggtgcggcacgaggagttttcccggcagcgaggaggtcctgagcagcatggcccggaggagcgccttccctgccgccgcgctctggctctggagcatcctcctgtgcctgctggcactgcgggcggaggccgggccgccgcaggaggagagcctgtacctatggatcgatgctcaccaggcaagagtactcataggatttgaagaagatatcctgattgtttcagaggggaaaatggcaccttttacacatgatttcagaaaagcgcaacagagaatgccagctattcctgtcaatatccattccatgaattttacctggcaagctgcagggcaggcagaatacttctatgaattcctgtccttgcgctccctggataaaggcatcatggcagatccaaccgtcaatgtccctctgctgggaacagtgcctcacaaggcatcagttgttcaagttggtttcccatgtcttggaaaacaggatggggtggcagcatttgaagtggatgtgattgttatgaattctgaaggcaacaccattctccaaacacctcaaaatgctatcttctttaaaacatgtcaacaagctgagtgcccaggcgggtgccgaaatggaggcttttgtaatgaaagacgcatctgcgagtgtcctgatgggttccacggacctcactgtgagaaagccctttgtaccccacgatgtatgaatggtggactttgtgtgactcctggtttctgcatctgcccacctggattctatggagtgaactgtgacaaagcaaactgctcaaccacctgctttaatggagggacctgtttctaccctggaaaatgtatttgccctccaggactagagggagagcagtgtgaaatcagcaaatgcccacaaccctgtcgaaatggaggtaaatgcattggtaaaagcaaatgtaagtgttccaaaggttaccagggagacctctgttcaaagcctgtctgcgagcctggctgtggtgcacatggaacctgccatgaacccaacaaatgccaatgtcaagaaggttggcatggaagacactgcaataaaaggtacgaagccagcctcatacatgccctgaggccagcaggcgcccagctcaggcagcacacgccttcacttaaaaaggccgaggagcggcgggatccacctgaatccaattacatctggtgaactccgacatctgaaacgttttaagttacaccaagttcatagcctttgttaacctttcatgtgttgaatgttcaaataatgttcattacacttaagaatactggcctgaattttattagcttcattataaatcactgagctgatatttactcttccttttaagttttctaagtacgtctgtagcatgatggtatagattttcttgtttcagtgctttgggacagattttatattatgtcaattgatcaggttaaaattttcagtgtgtagttggcagatattttcaaaattacaatgcatttatggtgtctgggggcaggggaacatcagaaaggttaaattgggcaaaaatgcgtaagtcacaagaatttggatggtgcagttaatgttgaagttacagcatttcagattttattgtcagatatttagatgtttgttacatttttaaaaattgctcttaatttttaaactctcaatacaatatattttgaccttaccattattccagagattcagtattaaaaaaaaaaaaaaaaaa

SEQ ID NO: 2116 - DNA, 629 bp, Homo sapiens
agctcagttcccttagaaatgaaattttaaatgacactaccaggtaagccactgagaccagtggaggtgatagctaagaacataaggaattaagaatttttaatggagaaaggaggtaatgaataccagttacatcctaagactcactgtagtggtgagtgttgtaatttatctcgctatccatcctcttttaagtttttccttagaaagtcctctattggtaccttggagggactgctgtcaaaatatatggaaaagtgggtctgtgtggtacaagaggtggactttgccacacatggaagtttgctgccaagatcttcactaatgaaagaaatcaccagtgagctgcacagattagccaaatactgagctcattagaactactaaggcctggacatttctgcctaatccaggactcctgtaattatcagtctttgctttggagcttcccattgtgtagctgaraatttgtcatatctgcattataatctaaggctccacatacttaatcctgcttctccccctttttctttccctttcccagcggtcagctctgctgcatagtctgaagactttccctgcccaatcctgataaaattcttgcactcgtaaccccatctcagtgtctg

SEQ ID NO: 2117 - DNA, 1057 bp, Homo sapiens
  misc_feature (31)..(31): n equals a,t,g, or c
  misc_feature (50)..(50): n equals a,t,g, or c
  misc_feature (132)..(132): n equals a,t,g, or c
  misc_feature (751)..(751): n equals a,t,g, or c
cggccttccggggcaaccgttcgtcccaacncgggaaagggtcctggagncgggaactaggagcctcggaagtccaagggcggagcgccctttgctaataagccaatcagaacgtgagacgctccggtgggncggtgccgtcgagcgcggggtggagtctgggtgacttggctggcgggatcaagtgcagctgcttcaggctgaggtggcagatagtgagcgctggtggcggagttaaagtyaaagcaggagagtaatwatgaatagcgcagcgggattctcacacctagaccgtcgcgagcgggttctcaagttaggggagagtttcgagaagcagccgcgctgcgcttccacactgtgcgctatgacttcaaacctgcttctattgacacttcttctgaaggataccttgagkttggcgaagktgaacagktgaccatwactctgccmaatatagaaagttgaaggaagcagtaaaattcagtatcgtaaagaacaacagcaacaacaatgtggaattcasccaggactcccaatcttgtaaaacattctccatctgaagataagatgtccccagcatctccaatagatgatatcgaaagagaactgaaggcagaagctagtctaatggaccagatgagtagttgtgatagttcatcagattccaaaagttcatcatcttcaagtagtgaggatagttctagtgactcagaagatgaagattgcaaatcctctacttctgatacagggnaattgtgtctcaggacatcctaccatgacacagtacaggattcctgatatagatgccagtcataatagatttcgagacaacagtggccttctgatgaatactttaagaaatgatttgcagctgagtgaatcaggaagtgacagtgatgactgaagaaatatttagctataaataaaaatttatacagcatgtataatttattttgtattaacaataaaaattcctaagactgagggaaatatgtcttaacttttgatgataaaagaaattaaatttgattcagaaaaaaaaaaaaaaaaaactcga

SEQ ID NO: 2118 - DNA, 409 bp, Homo sapiens
  misc_feature (291)..(291): n equals a,t,g, or c
  misc_feature (345)..(345): n equals a,t,g, or c
  misc_feature (349)..(349): n equals a,t,g, or c
  misc_feature (390)..(390): n equals a,t,g, or c
gaattcggcagagctgaaaagttccaaaccctttagtagtcacctcaatccatcctactctcgcccaactccagatagccactcgtagccactcatcctcttgctgtctttatcgattttccaattctggacatttcatatcaatggaatcatacaacatgggacattttgcgcctggcgtctttcacttgggcataatgttcacagggctcatccctgttgtagtgtgcagcagccctgcattccttcctgttgctgaatacttaatccactgtgtgggtattcatcatntattagttgatgggacatttggggttgttttccaccttttggtaatgatggggnaatnaccgcaacaaacattcgtgttacaaagttttgcggtggcanggggtcgttttttcttggg

SEQ ID NO: 2119 - DNA, 708 bp, Homo sapiens
caggctgggtgcaatgcagaaatggagatctgccccggggaaggcagtttctgcccaaacggagccacgtgaggacgtctttggggatgtgtctccaagaaaagtgtgggctgccttcctcaccctggatgcctgtgggctgccttcctcaccctggatgcctgtgggctgccttcctcaccctggatgcctgtgggcagccttcctcaccctggatgcctgtgggctgccttcctcaccctggatgcctgtgggcagccttcctcaccctggatgcctgtgggctgccttcctcaccctggatgcctgtgggctgccttcctcaccctggatgcctgtgggcagccttcctcaccctggatgcctgtgggctgccttcctcaccctggatgcctgtgggcagccttcctcaccctggatgcctgtgggctgccttcctcaccctggatgcctgtgggcagccttcctcaccctggatgcctgtgggcagccttcctcaccctggatgcctgtgacttggtttcaatgggggcttcctaagctcagggaccccaagcctccatcaaatctaatgacccgccctgtctctgaacacacctgtgttgtccccgagcccctcaccaaccccctctgcaacccggccgacgcatttcccatcctgaagggtccagctcataggccggcccatgtgttccctttacccctgct

SEQ ID NO: 2120 - DNA, 326 bp, Homo sapiens
  misc_feature (42)..(42): n equals a,t,g, or c
  misc_feature (58)..(59): n equals a,t,g, or c
tcgacccacgcgtccggttggctttccgctgcagccagccgnagcactaagagatcannggggcagaggcttgtgcttgggtgaaagaggcttgagcagccattctagccggaggatacaaatgcccatggtgctgatcaactctggtaagcctggaagcaaatgctgctgggtcttcaggccaggcttgtcagctccctgctctgctctgtggtgggctgcctgggctgctctttcttttgccccagacgctattacaagaaattaaacttgcacaaggcctgtatggaaaactccgttagtgcggaaatcagatcagacagaag

SEQ ID NO: 2121 - DNA, 881 bp, Homo sapiens
aggaggctgaagtgggaggatcacctgggcccagggaggtcaaggatgcagtgagccatggtctcaccactgcactctagcctgggtgacagaatgagaccccgtctcaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccacaaacccttaaaaaaaaaaaaaaacaaaaaaraaagaaa

SEQ ID NO: 2122 - DNA, 2499 bp, Homo sapiens
cgccaggcagcaatgaggctgtatgctgagccccctggcgcctcgccccgagccgcctgccgggcacctgggcaccaccccgatgcaagcgggccctggggcttactccgctagcctgctgcccctggacccgtgacgacccgtatcggacgcgcactggggacttcacttgccgacgagcatggaggcagcttgagacccatcgcgtcaacaggcccatgagccaaatgtccaggccgcggctcgtggacgtgtccagtgatcatcaggtccaccagattattcagatggccatgtcacacaaaatccttcagggcaacaaacagagaaactgttccaattcaaagataatttcgaattagaggtccttcaggcacaatacaaagaacttcaagaaaagatgacagtaatggaagaagaagttctcattaagaatggagaaattaaaattttgcgagactcactacatcagcacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcagggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctgggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactgg

SEQ ID NO: 2123 - DNA, 625 bp, Homo sapiens
  misc_feature (3)..(3): n equals a,t,g, or c
  misc_feature (6)..(6): n equals a,t,g, or c
  misc_feature (14)..(14): n equals a,t,g, or c
  misc_feature (32)..(32): n equals a,t,g, or c
  misc_feature (88)..(88): n equals a,t,g, or c
  misc_feature (119)..(119): n equals a,t,g, or c
ccnccnggaaccancttatgacccatgattancccccaagctcggaaaattaaccccctcaacttaaaagggaacccaaaaagctggnagctccccaaccgcgttggccggcccgctcntagaaacttagtggaatcccccccgggctgccaggaaatccggccacgagatttttagtagagacatggtttcatcatgttggccaggatggtctccatctcttgacctcgtaatcctagcactttgggaggccaaggcgggaggatcgtttgagcttaggagttcaaggccacctagccaacataatgagagcactttggaagcccgaagcgggtggatcacgaggtcaggagatagagaccatcctggstaacatggtgaaactccatctctactaaaaatacaaaaaaaaattagccaggcgcggtggcgggcgcctgttgtctcagytactcgagaggctgaggcaggagaatggcgtgaacccgggaggcggagcttgcagtgagccaagatagcgccactgcagtccggcctgggtgaaaaagcgagactgtcttaaaaaaaaaaaaaaaaaactcgagggggggcccggtacccaattcgccctatagtgagtcgtatt

SEQ ID NO: 2124 - DNA, 689 bp, Homo sapiens
gaattcggcacgagctaaggtgggcgggtcacttaagcctcgaactcctggcctcaagcaatcctcctgcctttccttcccaaagctatgaaattgcagacaggagccaccatgcctggctggtttttgggggccatggcaagtgcaggcttgtcagaggaattggagaagcagggattagttaggaaaacctctccacttcttgtgtttcatgccaggtagtgtttgtaacttcagaacccgcccttaccttacctacctaccatgttatgctcatttcacctactgtcccctgctgtatagggagtgccttgagggcagagatcatgttagttttgttccctcttctgtacagagggtggagcccagtacctggcacagctgaaggaggaatgtgctgctgctgtctctgtatttccaggtactccttgttgacctctagccaagacaaggaacctccttatgagatgtcatcttctgagctctcttgatggagggaataccacggtgatgattgaatatgaaaagtcttggcacagtggctcacacctgtaatcccaacactttgggtggccgaggtgggaggattgcttgaagccaggcattgagaccatccttggccaccaaacgagaccccatctctacaaaaaaagaaaaacaaaaccaaaaaaaaaaaaaaaaaactcgta

SEQ ID NO: 2125 - DNA, 2470 bp, Homo sapiens
ggcacgagctttcatcttttatgttcaaagtacttgatgcacaaagcctggtactcttttatctctgtcctatagactgatgtctagtcagtattcattgtgacaaaattgtttcattagagcaagttggatagtgtatggagattattataaaatgattttaacttgtcttctgtcaagtaattttataattggtattaatgttcatttttttccagtaccagtttcagaagctttcatttgtgtatgcatgtgtgtgttaaataagtgtattagatacttgaaaaatagtaatttaaatttaaacaatttaaaaaatgaaattgtaattttatgtgtaaaggtgtctgatgtgctttattctgcactgaaaacaatattcatttacagctcaacagacaccaaatatattctaaaattactttcctagagttatcagaaaacagcactgtaataatgaaatcaaacccatctttctttatgatttattcttagtctgatacgcatcagcctggtaagccttcctgtctctctgcttacttaccaatcactccaaatgtcatgtctttgggcaggcattaaattcttgggttttgggttttgttggatggactgcagtctgtgtgagcctatatgggtgtgtcaaatccagtctttggggtgtcatggaaacttagcatgatagacttgattttatccccaagttgacttggtaatttcattagatttcatcagtcacaacctgcattttatcttgtatgtgctgtctattggtcacaaaatcagaaaaccttcttgtccattcataacattagctgttttttcaggtggctagagggacatgtcattgcttcatctgcatgaatttgaaagattaaatgcataaaggaattttcttagagtagagtaggccttcaccatctctttaactgggaaagaagttttgggagtaacatactcatcactcacacccccctcccctcaaacacacacactcacccattagaatgtaagggccttgaggcaggccttgtgtttgcttttcgtgttcactgtcagcatttagaatagtgatagtcatatagatggatagtgctcaatcaattattgtcaaataaagtaatctacttgttccttgatttagactagcaaaaggggctggtacattgtaggtacacagtaaatatttgtagaacagatgaatgaaccaacccaacagatttcttagaagtagcctgcttttggttactaattattttatagaacatataaaagaaaattttagaatacctaatttgttcacaaaaatgttatattgtctcccctgatacttggtattcctgtgtcaggctgagcactaaggttatacattttttgttaagcatgtaattactgttatttctcatgtactttattttgtgtattgatttcagtagttgtagctgagggtaatccttaagagcatgcagattttaaaaattacatagattgccttgccaagccgtctgaaagtcatactagaaaatttgataagagcctgctgttaacaacacattgagttatttttatcttaatgctaagtggagaattacttgaatttattttttttgctgcatttaatgttttgatacattcaataaataaggataaatccacttactgaaggacaagaaaagatcaataagagatccttgaggttattgggttctatggcatctattatatcaaattccttgccctttcactatactgagaaatttgacgactgggctagcaacaagatacctaccccacattagctgtggtacctgctgaaatgtgaccatgtgagcaaagaaaatgagccaaaagaaactctttctgaagattcactgaagaaaacctggagatactctttcattagtagaccccacagagacaggtggagtgtccgttatccagaatgcctgggaccagaagtgttttgtatttcagattttttcacacttgggatcctcaacatgtgtatttgttggaaatggctacttaatttaaggaaaagtttaaggtggcctggaaaataagtagtagttgaactaatcaacaggaaccaaaactactttcaatatatagtgtacttatactcaaagagagacggaccattttatggtggaaccctgtctatggtagtattttgtgatgttttatttttgttgctattgtttgcactgttttctcctataacagctcttctaagccttaagaggataaattttatatgagattcaaactcttatttttgttaagaaggatgtaagtcaccatgcccagccatgactgatctgcttttgatttgactggaccacttccacttctttgtaatcccagcactttgggaggccgtggcaggtggatcatgaggtaaggagctcgagatcagcctggccaacaatgtgaaaccccgtctctactaaaaaaaaaaaaaaaaaaa

SEQ ID NO: 2126 - DNA, 949 bp, Homo sapiens
ggcacgagctcccattgaccttattgctcagagtgcagtattagggcaaggtttcgccactgcctccctccatgaatgtatttctccctcctgccctggggacatggggagtggcccgtttctttccccatctagtcccagaaagatggtgtttggttttctgttgttggattttttttttttttttttttttttgcaccaaagtggcaactaggtcagtgttgggggatcaagctggcctcggggtggggggcccccacctgcctctccctggttcccacagtgttagcgtccctgaaaagacaatattctctctaaagcaataaggggtgacgggccggggggagtgtttgctgctgctggcccccagctccccttccctgccaggtgtgggggagactcctgttgtgactgaatgtaacccccccacccctgccgcagccaatgcaggggaagggggacactcttcctgtctcttctccccagctaaagagactttggacttagggggcccatgagcctggagaggccttaaccctgtgaggaagtatagggggagccctctcccacccccatccccttctgagagtggtcaatgtttacaagcccctgagcccccctgcccagggactcagaccccgttgctgtccttccccggccccggtcttcctgggccctcgctgctcctctgccctttctggggttggggtgggtgcaggggtcaccgtgttccctgtctgccttgtacccacagtctccccgccccctctccaccctgtgtgacttccctctcttttacctgctcctgtaaatactcccttctcccaataaaacttggtgtgtgttctccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2127 - DNA, 1037 bp, Homo sapiens
agggttgatgggttatggtcaggagtcccagctgggcccaccacctcctcaggaaggcgggtgaggttggtgtgagactgacggtgcctcctcatgtccccttggagcgccccaccccacatctcccggcctcgggtccttgcctggcccagcatgagaggtgcttcataggaacggagggaggacatgtygggacagctcgatgctcggcctgctgctgctctgcacccccagggcctggctcaccctctctggacctgtctgcttccaaggaaggggaccctctgaggtcccacagaggccaccccagytgtgggtcgtgagcatctctgtcttgcagggacagcatcgtggccgagctggaccgagagatgagcaggagcgtggacgtgaccaacaccamcttcctgctcatggccgcctccatctatctccacgaccagaacccggatgccgccctgcgtgcgctgcaccagggggacagcctggagtggtgagtggcctccctgctctgggccagcccagggaggcaagtgccccctgccacatctccaggctgcgcacggcctcgctggctgtcgtcatgggagcagagaaaggtggtgctgaaatgaggccctggcctgctgtccaggctccagctcccctgcccagtgtgggaggcactcccatctgcgcaccaggctgcggatccaaggacacggtgcccargctgcaaccctctgttcccaagggcagagcagaaagcggctttgtctctgctcggtttctgtgtccccaccccccacgaagccttctgtgtctcggccctgggcccagtctctcaggcctccccgggccccccataccggccctcctccagggccctctggggttggggtgctgaagccctgcaaggttggtgcccccctccaccctaggatgtgactccgggccatgtccagggcactggtcacagaaagtgtgtcagttcttccccgtgagctgtccctgcagtgcctgccttccactgtgagttgcaagctgggcatttcatg

SEQ ID NO: 2128 - DNA, 767 bp, Homo sapiens
  misc_feature (292)..(292): n equals a,t,g, or c
cggcacgaggggacagatggggtttagggggttgtragccggggcttcaragctctgctgtctgggggtaggggggagctggaagctggaggtgtggcagccatggctctaggagccctgagcctgaatgctgcccttgcaccctgggcctcctcccctggcccagacctccccattctraaagagaagcagcccctctctagttacccgtyttctgggggagccaggttccgattacccaccacctccctgggcacacgtgaaagttcttcatttaccacctgtyttgtgncaggagcgggattgtgaaggtcatggatgactaccaggtcatggatgaatcctctacaacctcagcttcgagatgaacttcaatgacaagtgagtgggagcttggcccccatgccaggtgcggggtggagcatgaggggagctgctgagctgcagaggctcccaaatgccccagctgccacagtctgtgcaatctccccagaaacaccccactgagatttcagaggccagggctccacacatgggccgggaccagccagggccaggtggccgaaggaattcatttgggcctcttggcctcagctgctccccaaccctgtctctgtcctgtcaatggcctggcacatgttttgcttgttgttttttgaaacagagttttgctttgtcactccagtctgggcaatagtgagtcggtcaaattccatttccccctccgccccatacctcttcaaatgtttaaaaaaaaaaaaaaaaaa

SEQ ID NO: 2129 - DNA, 504 bp, Homo sapiens
ggcacgagccaacagccgttttgaaggtagaggagagagatgttgtggtatttkttccccaccaccccactccctgcccaggtgcagttttggtggtgcctgtgttgctgctacatccatggctcctggtggggacccctctcccaaagctccagctcctgcaatgcttcagtaactgcactcagctcaggctgttgtagacctagggccagcagtcccacagtgcctcaccatcgcttgttccctatgcctgcccacacatctgtaaatagtcccttcatttcacatccttcagttagaccctttgagtatgccatctgcttccggtcaggacaatgattgattctatctgaatcaaacctgtcctttatttgaacaggacatcaagtctagaaaaacaagttaacaccttgagataacaaacaaatccagaatttgggaccatttactagtctggttctttcaaaggtcaatgttataaaaaaaaaaaaaaaaaactcgtag

SEQ ID NO: 2130 - DNA, 714 bp, Homo sapiens
ggcacgagtaatgcttctgtttctcccactatatgcatatgtatgtgtgggtacgtgcacatttggttttttatttgtttgtgtgtctatctgaaagttctgcagggcagcgcttgcccttggattgctgctgcagtggtgatgagaaggatgaggaaagtgcaggaaaaaggggaggtgttcaggaacatggcggccacctgggcccttcgttctggcatacaaagcctgaattctcttgttagctctgccttttttactattttcatgaccttgggctcttcttggaacctcattgtctcactttcctcattggtaaattggaccggtctcttttctttctacttctcaagaaactgatgaggattaatgagatagaatctggagcccgttttgtgttaaaaagagttaagggatgctagaagacggagttaatgtcatagagaaggggaacacacattgcttaccgtgtgatgtgatagagtctcagggagcacttctctttcaactgttaactgttaactagttgggcaggtggcagcctcatttctatttgtgtctgaagtggatgacatgttagtgcaggatgataggaagtcaaaccaaatgcagggactggtggaatgacgagtcaagattcatgggggaacatctagccttctgcattgctacctgaaagaaacttagctatttaaaaaaaaaaaaaaaaaaaaa

SEQ ID NO: 2131 - DNA, 1950 bp, Homo sapiens
gagcggcgggttccgggctccgggctctgggtggcggcggctgtgagcggcggcactgcggcgcaggcggcggaggccagcgggcgccgtcggcggctggccctgtcggccgcgggatgaggaagcggaccgagcccgtcgccttggagcatgagcgctgcgccgccgcgggctcgtcctcctccggctcggccgccgcggcgctggacgccgactgccgcctgaagcagaacctacgcctgacgggcccggcggcggctgagccgcgctgcgcagccgacgcgggaatgaagcgggcgctgggcaggcgaaagggcgtgtggttgcgcctgaggaagatacttttctgtgttttggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagatttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccggggggccggcacctgcaatgctcaggagcccagctcgcacctggagagcacctcagatcccagggtggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctggttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtcaaaaa

SEQ ID NO: 2132 - DNA, 608 bp, Homo sapiens
  misc_feature (73)..(73): n equals a,t,g, or c
ccctcactaaggggaccaaaagctggagctccaccgcggtggcggccgctctagaacttagtggatcccccgngctgcaggaattcggcacgagaaacactgaaattgggcagagtagaagtcagcatttagtgagaccaaataaaattagtaatgggcaagctgctgtttcctttgcttttagctccattttctcccataaacaaatatattcttcactttgcaagagatggagtagaagaagttttgaaatttgtatcctaaattagcttcaagtaagtgcctaaagagacctctttcccttaaaacctgttaatcagttaaaggcggggaacactggtgcctttttttttttttttttaacttcttaaccaagggacagtgaagacttttaagttagatctgattttagaattgcagttgaggtagtgcctagtgtgtgaatttgaggtcattttctaaactggccgggcacagtggctcatgcctgtaatcccagcactttgggaggcccaggtgggagaatcacttgagtccaggagtttgataccagcctgagcaacacagggagaccccatctctacaaaaaaaaaaaaaaaaaaactcga

SEQ ID NO: 2133 - DNA, 1134 bp, Homo sapiens
tctgaaggtctcagcttcctagatgttctacactcttcctgaccattttcactgaaccctatttgatttactgaaagcatatttactaattgtttgcacttaaaggtgcttttatcctagaataaacaatgcttttaaaacaattcactattctaaattgatactggcttaagatgttgttccagtgtcaggtattgttatcgattttttctttcctagaacctgtcctttccagtggctccagtagacttgtattttataatctttcaaatattatgtagcttgttaaacttcccatcatgatcttgttcagtttctcaactcatttgcaaaagagatgactagcatgggagcctggattccagtatctgttttagtgccttattagtgcctcttagcttaggttcttttgatgattcagcgtccagataatccaagggagtgactgtaatcataggggtttctagtagaatgcaatcatgagccccttaggaagttttggtcaataataaaccacacatagggtggtggtcccctaagattataatgaagctagaaaattcctcttccctagtgagttgtagccatcccacactatagtagtgcaacgcgttactcactgtgtttgtgatgatgctggtgtcaacaaacccgcactaccagttgtataaaagtatagcatgtacatacatttatatgtagtacatatattgataataaatggctgtgttactggcttatgtatttactatgttttttaattgttattttacagagtacatcttctacttattaaaagaagttaactgtaaaacatcctcaggcaggtccttcagggggtattccagaaaaaggcattgttatcgtaggtgatgacagccctatgcacgtttttcaccagtgggatgaaatatggagatggaagacagtgatattgatgatcctgatctttgcaggcctaggctaatgtgtgtttgtgtcttataagaaaaaggattaaaaaagaaagaatttttaaatggaaaaaagcttatagaatatgaatataaggaaagaaaatatttttgtacaactatacaatgtgttggtgttgtaaactaaatgttattacaaaaaaaaaaaaaaaaaactcga

SEQ ID NO: 2134 - DNA, 709 bp, Homo sapiens
gaattcggcacgagcaggtgtttgcctccacatctgcatggtggtgagcaacagcaggtacctctgtccttgacatgcaaggttagttggcacaaatgctytcrgaaaggatggcttcaagtcccccaggcacctgctgaaagtgggggactgggatgggagaataagattttatgcattttttgttttttgttttgttttgagacagagtctcactctgtcacccaggctggagtacagtggcatgatctcagctcactgcagtctctgtctcccgggttcaagcgattctcttgcctcagcctcctgagtagctgggattacaggcacctgctaccatgcctgactaatttttatatttttagtagagacagagtttcaccatgttggccaggctggcctcgaactcctgtcctcaaataatcctagcactttgggaggccaagaagggcggatcacctgaggtcaggagttcgagaccagcctggccagcatggtgaaatgccgtctctactaaaaatacagaaattagctgggcatggtgctgtgcacctgtagtcccaggtactcaggagactgaggcaggaaaatcgcttgaacctgggaggcggaggtttcagtgagctgagattgcgccattgcactccagcctaggtaccaagggtgaaactccatctcaaaaaaagaaaaaaaaaaaaaaaaaactcga

SEQ ID NO: 2135 - DNA, 721 bp, Homo sapiens
  misc_feature (264)..(264): n equals a,t,g, or c
  misc_feature (340)..(340): n equals a,t,g, or c
gaattcggcacgagtcatccctctccctctttcactcccttactcttactctgttttttgtgctccagacagacagaccctacctcttttgcttcttttttgtttgtttgttttgagatggagtgtcgctcttgttgcccaggctggagtgcagtggcgcaatctcggctcaccacaacctctgcctcccgggttcaagcaattctcctgcctcagcctcccgagaagctggggattacaggcatgcgccaccacacccagctnaattttatatttttagtagagatggtgtttctccatgttggtcaggctggcctcaaactcccaacctcaggtgatnccgcctgctttggcctccccaaagtgctgggattacaggcgtgagccactgcgcccagcctcttttgctcctttatactcattaactcacgcctgtaatccctgttttgggaggccaaagtgagaaggttgcttgaggccaagagtttgagactagcctgggcaacacagcaagatgccatctttataataaaaataaaaataaaaatcaattagctgggcatggtggaacgcacctgtagtcccagccaattgagaggctgaagtgggaggatcattgagcccaggagttgaggttgcagtgagccatgatcatgtcactacactcagcctgggcaatagagggacatgttgtctctaaaaaaaaaaaaaaaaaactcga

SEQ ID NO: 2136 - DNA, 1264 bp, Homo sapiens
  misc_feature (1057)..(1057): n equals a,t,g, or c
ggcacgagggcactgtttcctcagtccatggctgagtacatcaccggtgttttctctcttattcctcccatcaagcctaaaaggaatctctattggagatactgccattagtgttccttttataggtgaggaactgaggcatakagggttccccagttgaaccaactgataaatagtagaacttggattttaattcagtcttgatgccagggataaggctcttactttctaccttaggctatttctaggaaacgcaggagagtgttgaaggggcagagaaagggatccagttcctttctgtcccgcatcctagtccctgagaagcaaagaaraatgtgtggcttcttttgctttgcttttgttgtcatcccacacatctccaggggamctgggctcttgatcttggsctcttcccctttaactgttaagtgggagcargtaagggggtacagtagggctggcctggagttagaggcttggatgccttagctcctctgtctgcactccagaactgcctgacttcatttcgtatgttgtcctttgttttgacaattgatccatgtcccagtccgtctcttcttccttcttgatacttacactgcttctttctgttggtttccagtgtttaacactgtatacaacagtgacgacaacgtgtttgtgggggcccccacgggcagcgggaagactatttgtgcagagtttgccatcctgcgaatgctgctgcagagctcggaggggcgctgtgystwcwtcaccmccatggaggccctggccagarcaggtatgacgtggcgctgtgtcatgtgaatttcccaagaagcatttcatctgtgattccgtatgaaggctttctaagccctgaaatttgcagggtcatttcctcagtttgtgtattaaagaaaagctgccccagccaagcgtggtggctcacgcctgtaatcccagcactttgggaggccgaggcgggcagatctccggagatcaggagttcgagaccagcctggccaacatggtgraaccctgtctctactaaaawtacagaaattagctgggngtggtggtgtgcgcctgtaatcccagctacttggaaggctgaggcaggagaatcgcttgaacccgggaggcggaggttgcagtgagccaagttcgcaccactgcactccagcctgggcaacaagagcgagacttcatctcaaaaaaaaaaaaaaaaaactcgagggggggcccggtacccaattcgccctatagtgatcgtattaca

SEQ ID NO: 2137 - DNA, 941 bp, Homo sapiens
ggcacgagtagcatttcatttaatctgcaggtatattctcccaacagtttattgtcatgtgatgtcctcagccaagattgtraggcagagaggagctgtcccaacctactataccaccgaggctggagagatcatatttttggtattaaactggagtctctccatccttcacattgttgatgtcctctgtagcaaaccggaaaagtcagtgacagaagatgccgctagcggtttgagccagagaatgacagctctggtttggagaaaagggccggatggtggctctagaaagcccatccttctgctcttcttttttctcccccttatattgtgctttcattcattcattcattcatcaaacatttgttgagcacctattatgtgtcaagctctgtgctagcctctggaaaacctgccctcatgtagctcactgtggagtaggagaaacaatgactacactatgataagcacgggttgtcagggtctcacagagcagtggcccctcatccagaccgatgaggtcaaagaaggcatccaggcgaggatggtgtcagagctaactgaagaatgagagggagctgcaccascaggggttggaactgaaggtggcagtgcctggagtcttgattccagcagagggagagcagtctgtgaaaaggcaccaagggtgggagagggcagagcacatggaggaacttcaggtagttctggatggcsctggggcaaagctagagaggtaagaagaatctacaaatgttcctcgagttacatgaacttccatcccaataaacccattggaaacgaaaaatttaagtcagaagtgcatttaaggctggtccgagtagaatgatttttacaacgaattgatcacaaccagttacagatgtctttgttccttctccactcccactgcttcacctgactagcctttaaaaaaaaaa

SEQ ID NO: 2138 - DNA, 925 bp, Homo sapiens
gaattcggcacgagagaaattctgcccgcctctgtaaggcacagtacacacataagacatgcttgttgtagctgtgatctttcttcatggcgctggggctatgaactatctaattgctaagattctggaggtgcagggcctcagggaggtgccatgcacatacaatacaaggggtatagcgccccctggaggcaacgttggatttgaagcagccagtgtggtggacaggccttgtgggcagtgaggaggcctgattctaaccttggccctgcagagaactccctggctatggaactcaggggcagatctcaccgaacttctctgggcctcaaatccacatctgtaaaaggaaggggttgtactctcaatggttctaaaactccttctcttcctctgtcccttcctttctgcatcttcttggcagaatcctttcctcaaatcagtgctccgatagacccctaatacagtaaacagctgaaggtggagagtctctgttggaagtgggtcttggcctaagcctccctcattgacccatgatgactgcmcagaagagatttccaaactcctcccagccctagcagttatgggtccagggcctcatcactgagaacagccccacaccagtttacttttcattttttagagtgagggttttactctgtcacctaggaggcggaggtcagaatgagttgagatcacaccactgcacttcagtctgggcaacagagtgaggctctgtctttaaaaaaaaaaaaaaaaaaagaaagggctggctgtggtggctcactcctgtaatcccaatcccagcactttgggaggctgaggcgggcggatcgcctgaggtcgggaattcaagaccagcctgaccaatatggagaaaccccgtctctactaaaaatacaaaaaaaaaaaaaaaaaaatccgc

SEQ ID NO: 2139 - DNA, 840 bp, Homo sapiens
  misc_feature (364)..(364): n equals a,t,g, or c
agatttttttttttttaatgtccggagaaggaactctcagattactctcctccctgcaaaacgactatttaccacctcccctttgcttcaacttggtctgagcgtctttaacctcaccattttgaatgtgcgcaaaatgattaccagtcatctgagggaggccaaattaaaggtgcatctgcaagaggagctctggcctgacatcgctaactgagagcagccctggcggaaaggtgctgatcccgggagtagagcgactgctgcggctcgagcggggtgtctgcgtgccgagcctcactgacaatcggggaaaatgcagacgcccagcaaaacgacggcaacagaaggctcctcgggggagggntgctgcaggcctgtggcgtaagatggttccgctctacgcgggktgacgggaaaccgcagaagtgggtgtgaggtgttggttggggggcaaactcttgtacagtggcgagtgtaggggaaagccagcgggctccttggccaagtcaccaaggacagcagaagaggcagcagtaaagagcggcagcgaagaccccgataccaaccaatgtcatctgtcggggggcggcgggcgcgaccgtcccggataggagcgcggcccgggtccgggctggacagggcccaggaggcgaagaaggcctcccacagccatcaaccccacccaccatggccggcgcagcaggccagggacaagccccgctccttccgaagctagagacagagaaactgaggagctgaacgcagcaatttcctcgccccgacccccacactcccgacagcggaacaagccagactgaaaaaaaaaaaaaaaaaactcga

SEQ ID NO: 2140 - DNA, 1687 bp, Homo sapiens
  misc_feature (334)..(334): n equals a,t,g, or c
  misc_feature (505)..(505): n equals a,t,g, or c
  misc_feature (1044)..(1044): n equals a,t,g, or c
  misc_feature (1670)..(1670): n equals a,t,g, or c
  misc_feature (1678)..(1678): n equals a,t,g, or c
  misc_feature (1683)..(1684): n equals a,t,g, or c
cggggtcaccagttattagaggaagtaacacaaggggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcgtatgcgacttactgaagtgcaagatgataaagaggaggaggaggaggagaatccactgctggtaccactggaggaaaaggcagtactgcaggaagaacaagccaacctgtggttctcaaagggcagctttgctgggnatcgaggacgatgccgatgaaggccctggagatcagtcaggcccagctgttatttgagaaccggyggaagggacggcagcagcagcagaagcagcagctgccacagacacccccttcctgtttgaagactgagataatgtctcccctgtaccaagatgaagcccctaaggnaacagaggcttcttcggggacagaagctgccactggccttgaaggggaagaaaaggatggcatctcagacagtgatagcagtactagcaktgaggaagaagagagctgggaaccctccgtggtaagaagcgaascgtgggcctaaagtcagatgatgacgggtttgagatagtgcctattgaggacccagcgaaacatcggatactggaccccgaaggccttgctctaggtgctgttattgcctcttccaaaaaggccaagagagacctcatagataactccttcaaccggtacacatttaatgaggatgagggggagcttccggagtggtttgtgcaagaggaaaagcagcaccggatacgacagttgcctgttggtaagaaggaggtggagcattaccggaaacgctggcgggaaatcaatgcacgtcccatcaagaaggtggctgaggctaaggctagaaagaaaaggaggatgctgaagaggctggagcagaccaggaagaaggcagaagccgtggtgaacacagtggacatctncagaacgagagaaagtggcacagctgcgaagtctctacaagaaggctgggcttggcaaggagaaacgccatgtcacctacgttgtagccaaaaaaggtgtgggccgcaaagtgcgccggccagctggagtcagaggtcatttcaaggtggtggactcaaggatgaagaaggaccaaagagcacagcaacgtaaggaacaaaagaaaaaacacaaacggaagtaagcagagctgccaggctcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctraataaaaccaggataatggaaraaaaaaaaaaaaaaaaaaaaagggggggcccntaaagggncccannttt

SEQ ID NO: 2141 - DNA, 326 bp, Homo sapiens
  misc_feature (1)..(1): n equals a,t,g, or c
  misc_feature (326)..(326): n equals a,t,g, or c
ngcctttttatacttactgttttcatcaaatgtctttttccaactagtttccaacctgtctttgtatttgaagtgcatctattgtagatagttcagtgttgcttttaaagtgcttactccatttgtgtttagtatgttgacatggttggatttagatctactattttgctttctgtttttattcctgtttatccttttttacttcttacagcttaatgaattttggggggggaattccattttaatttctctcttgggtttttagctacatctttctttaggattgcactagagattacaatatacattcttaacgtctcaccctn

SEQ ID NO: 2142 - DNA, 1810 bp, Homo sapiens
cacgagggtgtgcgtgcttaggcaggaacccagttttactttatgccatgtggaaagtttctttttccagtatcaccagtgagttcactgtctctccactggtctgcagtgctgcttctgttacttgcagacttcccacgtgtgcatggatctccacctggggtctctagggtctctattctacactgcctatttccctttctgtcctaacaccatagcatttaactcacccgtcatcctgtgttgctgagaatttccttcatagaactcatcaaagtatgattaactgtgctccctgagggcaggaattatgccatctggatcaccagcctctcccttgtccttagcacgccatctgcaaattagcagatactcggtaaatgtgtattaactcgaagtatattttgtgtcttctctgtgcacagcactgccctgggaagaactaggatgaggtattgacttgctgttgccacataacaaaccctgccagaactccctggatggaagtgaccaccgtgtatctgtggattgtctgcagggctctgctggggtcagcaggtcccacaacagagccagggctcggtctcctcatggctgtcagaggtttacgtattccgcctcctcccaccaaagtctgaagttgttgtattccattccttgctatatccacatcttttaataatgctaaaatcccgtgtttctctaaagcattggattgaaccaactgaagaaggaccacgtgtgttgctgggcctgcttgggcacaagccgtttccgatccaagtcaactgctggtctgcttagacgaaggtgtgtgggtgtctccaccacggagaggagggacagcaggtgagaccataggccaggaaggaagggcacagcctaagcgtgcagtggcttagccagagaccctcgtgcaccagccttccaggtgcttattggaacttatgtcagcccaggccatatccaagtgtgtgatgtctcggagcatatatgccaggccagccggagaggcttagccctgccctggtggagctggagggccgcagggccgcccggtggggtcaggaggttgtgaagaggatcctgatacaggctgggcctccctgcaggcgtgagccccggagcacggggtgagcagctccacccagaggggcttgcaggaccaagctgggacagcaaccaccaggccctggggcagatcagtgagcgtccaggagatgcagatgcagaagacagccaaattcattcacctctgcgtgggcctgtgagggcccacagagatgcattttcattcacgaccaggatttcctcggccggagcagccgcttttcccagccgaagctcactgtgtttactacataggatgtgagtgtatagaaagactctctctaacgttagtacgcgtgcagaaatgtggggccgcttacaagtgtgggcagccgcagcctgttcctcacccctgtcctaacgggacatactccacgcatgcacatttaggatcaccgtgtcttctcgttggactgatctgtcattaggaccctggacccaagtaattgtctttgctctgaagttttgacagtaacaaaggcattccagctctttctttttcactcctgtcggtgtaacgtgccgtttttcatcctttgacttttagcccgcctgtgccctgtctgaagggagttgtctgtggacagtcacggagtggtgggtgtttgtaatccactctgccagcctcagtcttctaactgttgcgtatggaccaattacatctgccctttctcttccctgctaaaaaaaaaaaaaaaaa

SEQ ID NO: 2143 - DNA, 1405 bp, Homo sapiens
  misc_feature (8)..(8): n equals a,t,g, or c
  misc_feature (35)..(35): n equals a,t,g, or c
  misc_feature (59)..(59): n equals a,t,g, or c
ccctcctncccttccttggtccttccaaccttaantcctttttccaaaaaaaaaaagangaactgtgaagaacccccaaaaaacttcccacttcctgggaggccagcccacaggaacagggaacaatatttatttgggtctcttcagttccccctttgagaacaacattaaatacatgttagctggggctcccagggcattctccttcccacagtagtgcggccaaattcccagtctggccagtctctttgttgagactgaatagaaggactgcaggtttttttggaggatgagataatttttcctcgcaggcatttttcccttgccttccttatgcatgaatggtccctttgaatattatttccaaaagtgagagctaagacaaagtcatcaaaaagagaggataacagaaggtgggggcgggggcggggtgcagtggggtagggttacctgttaattgctgagactcagatgaaagtccagctctccctgggcaaccctagagggcagcagaggaccccagagctcattcaggccttgctgcttgttctaaactacaccttaggattttttcttctttccaaaacattccattgattttataaagactttctatagagaggctttcacttttgagttctttgagtttaaagattgcttttcttgaaacgctctttttttaatgtagaaaaattttactttttcaaatatgcatacaatttttaaaacagtagaagcaaattcattttaatgaccatgtaaagagcgaatgtcagacagtattattaccagtttattcaaattacatacatgttcctaccaaggtggaaagaaattcaaacctcatggtaaaacttaagcacgatttaagataaaagcatagtatttcttcagtgtagacttattaagtgccttattgaacaggatcttaacctgctttttctgtttttttgaaagagttaatgcaattgttgaagcttctaaccaagaaacaacttaaggaattgggagacttggtcccctcgttgtcagggttctggctataagtacctccccacctttgggttttcttaaatatgccaaaaggaattctagtttttataaccaatgggtttttttgtttgtgtgcttatggatttgtgtaatcattgatgcttaatgttgtggattcataatataaaaagtggctcctgtcctttatatttattcatgtgctagaaatagtatgcattatataaagagtatgaagttttcataagcctttatatttcaagctctttatttaaacattgttggaatatgtggcataagccttgtttcatttatttaataaactggagtaatatataataataaaaaaaaaaaaaaaaaactcgagggggggcccggtacccaatcgccctat

SEQ ID NO: 2144 - DNA, 1219 bp, Homo sapiens
  misc_feature (3)..(3): n equals a,t,g, or c
  misc_feature (19)..(19): n equals a,t,g, or c
  misc_feature (90)..(90): n equals a,t,g, or c
  misc_feature (599)..(599): n equals a,t,g, or c
ggncacgagccgcggcggnaagtcggttcccgtgacgcggcgcgccccaagggccggctccgttgagggaagggaagcccgcccggtggnggctggggtcggctgctgggaggaggtggtgggctggttcggacgtgggtcgaggctgtagcaggactccaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtgtgtccactataggatttggctttgtgctggacatgggattctttgagacaataaagcttctcctttgggttgtactcatagattgtgtaggcgttggtcttctgatagcaactttaatgtggttcatctctaacaagtatttagtgaaacgancagagcagagactatgatgtggaatggggctatgcttttgatgtgcatctcaatgctttttatccactcctggtcattttgcattttatccagctttttttcatcaaccatgttatcctgacagacacatttattggatatttagttggaaataccttatggttggttgcagttggctattatatctatgtaactttcctgggatacagtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaaaaaaaaaaaaaaaaactcgagggggggcccggtacccaattcgccctatagtgagtcgtat

SEQ ID NO: 2145 - DNA, 1964 bp, Homo sapiens
  misc_feature (353)..(353): n equals a,t,g, or c
  misc_feature (476)..(476): n equals a,t,g, or c
aagaagacatggaaattgctgaaggatgtttcaggcatattaagaaaatctttacgcagcttgaggaattcagagcctctgaattgcttcgaagtggactggacagatctaaataccttttagtgaaagaagccaaaattattgctatgacctgtactcatgctgccttaaaacgacatgacttggtcaagctaggtttcaagtatgacaacattttgatggaagaggctgctcagattctggagatagaaacttttatccctcttcttctacagaatcctcaggatggatttagccgactaaaacgatggattatgattggcgatcatcaccagttacctccagttattaangaacatggcctttcaaaagtactcaaacatggagcagtctctcttcactcgctttgttcgcgttggagttccgactgttgaccttgatgctcaagggagagccagagcaagcttgtgcamctnctacaactggcgatacaagaatctaggaaacttaccccatgtgcagctcttgccagagtttagtacagcaaatgctggcttactgtatgacttccagctcattaatgttgaagattttcaaggagtgggagaatctgaacctaatccttacttctatcagaatcttggagaggcagaatatgtagtagcactttttatgtacatgtgtttacttggttaccctgctgacaaaatcagtattctaacaacatataatggccaaaagcatcttattcgcgacatcatcaatagacgatgtggaaacaatccattgattggaagaccaaacaaggtgacaactgttgatagatttcaaggtcaacagaatgactatattcttctttctctggtacgaaccagggcagtgggccatctgagggatgtccgtcgcttggtagtggccatgtctagagccagacttggactttatatcttcgccagagtatccctcttccaaaactgttttgaactgactccagctttcagtcagctcacagctcgcccccttcatttgcatataattccaacagaacctttcccaactactagaaagaatggagagagaccatctcatgaagtacaaataataaaaaatatgccccagatggcaaactttgtatacaacatgtacatgcatttgatacagactacacatcattatcatcagactttattacaactaccacctgctatggtagaagagggtgaggaagttcaaaatcaagaaacagaattggaaacagaagaagaggccatgactgttcaagctgacatcatacccagtccaacagacaccagctgccgtcaagaaactccagcctttcaaactgacaccacccccagtgagacaggagccacttccactccagaagccatccctgctttatctgagaccacccctactgtggtaggagctgtatctgcaccggcagaagctaacacacctcaggatgccacatctgccccagaagagaccaagtagccaaactgtagtccttctaaaggaggacatggcagtcaaaaagtctgagtaaagctgttttttgtattttatatttgcttctgccattttactgtcactaattaatgtttagttcttatatttgttaactgatttcggtgtcttgaatatatttttttaaattatgtgtatgaacaattctagtttcatttgttcaatcagaagagcaaataaccattcctttcatgttttgatcactgagtgtgtctgtaatcatacctacattaaaatcattttctatgaatatataatatatacttcacatttttagtgaacttctctaaagaagaggacagaatatactggacttaaccacgaatacccttgagtgtccaaattgggaaggaactkgtttcttcygttatactaycaaatgcttaaattckgtttccttttttcttacctttgtttgctgtctttatgtaaag

SEQ ID NO: 2146 - DNA, 1724 bp, Homo sapiens
  misc_feature (51)..(51): n equals a,t,g, or c
  misc_feature (371)..(371): n equals a,t,g, or c
agaggggctatgattcggagggttctgccgcacggcatgggccggggcctnttgacccggaggccaggcacgmgcrgaggaggcttttcwcwsgtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagaggcaggagggagccaaagtttctctgatgtctcctgatcagcttcggnaacaagtttccctgggataaacacagagggagtggctttggcgtcttatgggatggaggacgraggttggtttracccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagcaggaagaaccggacccggcgaacctggaagtggaccatgatttcttccaggacaaggtgtggccccatttggccctgagggtcccagcttttgagactctgaaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccaccagggcaatccatctggaggcctgagcaccctggcccaggactggcttcatcctggcactgaccaggaaagactgcctctgaccctcttagcagacagagcccaggcatgggagcactctggggcagcctggctcaggtttattgattttcgtctgtttaccctatccattaatcaatacatgtaattaactccttcaaaaaaaaaaaaaaaaaaaatcgcaggggggtcccg

SEQ ID NO: 2147 - DNA, 682 bp, Homo sapiens
tttgaatgttatcatggctattacacttttacttcctgactttaatattgatgaataaagcaagtttaatgaatcaactaaaaagctgcaaaaatgtttttaaaatgtgtgccttttattacctatcagtctatgttttgggagaaatgggaagcaacagatcactgtgtcctgatgtgcaggacgcatgttaccacactcacaaatgcctaatattggtctttatgtggccattgagtcctgttgactttccactcatgtgctttttactctagcattatggaatctgggctgtacttgagtatggaaattctcttatagacttagttttagtactctattacacctttactaagccacataaaagtaatctgtttgtgtgtaactgccagatataccacctggaattccaagtaagataaggaagaggatgacatttaaaagagaatggaattttgagagtaggaatgcaaggaagacagcatgaacatatttttttcagtgcaaataattttttcgtaacaaagaaacggaacaactttggtatgatcttaagcaaaaatactcactgaaatagtatgtggatgaattcacctacttacaattttatggtttctttgtaaataataaatgtgaatctcaatcctgctttaaaaaaaaaaaaaaaaaaaaaaaaaaaaaa

SEQ ID NO: 2148 - DNA, 1321 bp, Homo sapiens
ggcacgagcactgagctctaatcactaaccaggcacttgtccagtcctggtgggtaggataagagggtatggaagtacatttacctccctgcaggatcttggaaggaaaatgattgggaccagagtaatcagtggagaaaaagaactagacaaactgtaatcagggagtcttgctgctacaggaggtcataggaggaaagartcaaagcatgtggtgttggttggaaataattaaggagggcttcctgcccaatatggtctaaggatggaaaaactttgtatctcccagtttgtctttcttttctccatagccctgcctctactttccttccttggaatcaggggttccttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtartgakagtaaggggagagcaggmgaagsctctgtcctgtataggcaactgcmtgactatgcggtgcactagctgtaarccaagatcaggtgcccagycctttttgtccattaacaccccttcttgatctttcaaaggcagctaattgctagcaaatccccccgattccggtccttttccctctatttctttgttagaagttttctgtggagctgaaaccccagcctctgtttgactgggttttcatttaggcttagttgggttcttggagccccctgtttgttgttttgtgttgtttccaatgaaaagcaagtttaccctcagagttatgcttttccaaagaggctgatgtctttgtttttgttttttttaaatgtttccagggttctaaagtgaaagtgaagttggggaagggggtttgggagtgttaagtaatccaaggtttagaaacacccatgagatagttacccctgatctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttggcaaattat

SEQ ID NO: 2149 - DNA, 810 bp, Homo sapiens
ggcacgagtcctgcctcatttttctgtgggcctcatttggtatgcaaggaaataagccaaacagcctgaaagtccagtagaagtgacagccagacatcccagtcctccctgtagggttttctcagaactgttcctttaaggtctcaggctgctggaagggagggctgatagcagaaaaagtggggacactgggaactccaaagggaagacgcgcatggcctgaaaccgagttctttcgctttctggagcctggtctccctatgtggagggtcatgctggcatggctggcaatggttaattcaccgatggccatggagtcccaagttggccatattattgcggtaaaagatacattaacccagatgaccttgccgggggccagaatagagcccgtgaggaaggagagcaaggcaggatcggccgggaagcgagagggattttgttgaggagcaaggtcttccacaggaactgcgacttggaaagtattcaccaagggctgtgccatgcgaaaccctctttaaaggaaccgcatcgtacgcctaacgggcatttcttttttaatgtaatggttcagagctattgtctaccacgcctcgcgtgcacacgcacacacacgcaagttccctcagtcagccgagaatcctgccatctcttttagataacaaaagctcttaggccttatgctttgggtaggatttgtcttccatggacaggtattcagttggaaacaagtatatagtcactgcctctatggtatggagatactccgatttagtccctctgcctcttggggaaaaaaaaaaaaaaaaa

SEQ ID NO: 2150 - DNA, 1176 bp, Homo sapiens
  misc_feature (569)..(569): n equals a,t,g, or c
ggcacgagtgagcttgaggatgatatctataaagccagccaatattaattacatcttcaagtgaaagtacattacccgcctccctgcagttttaaccctatacagtggaagtgtagcctttccttcttccaggaattgttagcataaatcctgacagttccagacagtatggaaggatcccagtagatagggaaaagatccccactcgaaggtccaagcctagtgggatacctttcctgggcacatggtgccaagagatgacttaaatatctacaaccacttgtcagctcagtttttttggggactactccagaggtgttccctcacagaggcagtggtagaaaaagtaaggtagaaaaaagcagtaagacagggatgtttggacaaggcactcattcataagaaaggaatgatagcagattggatgttttttgtttatgccttatgtattgacgttactgccaatgaattttgccttacactgacctttttaacgtcaaaagtgtcaaaatagatttgttgttgttgcagttttgtaatgggcgggtggtattattaatccgggatgnaggctggatttattttttattttaattttttggcttggctgacctggaagatctactagctctctgccctcacggtccaaggtgtgttcttcccccactgacagttgggctgctgatggctcccttttaattcccatcagctgagggctgactcagtcaacatcttctccccatcctggaccccaagaatacaggaaaaaggctcagagacttagcacattatttttgttttaagatgtcagcacctgatgtattattttagtgcttgtttaaatattctgaaactgtgttttcttttttcctttaatttaaatttgtcttcataaagttggcttacaagaacatttctttatcaagtttatctggattttctgggtcaaaagtataagtgatttctggacttttcttgacaaaaagtaccaagaaaagctgcattaaaacaacaaatctaattttaaaaacacttagtgagctaaaacgcagactcaaaccaaactaatgaaagctatttaagagaagtcagttgaagtagtttccagaatttatttcattgttttttcaactctttgttaacaccataaacgtgaattaaaaaaaaaaaaaaaaa

SEQ ID NO: 2151 - DNA, 1087 bp, Homo sapiens
  misc_feature (408)..(408): n equals a,t,g, or c
  misc_feature (1005)..(1005): n equals a,t,g, or c
gtccattcttaccaccactctcccaggtaaatgctccatcttctctgtcttgggttgcatttggtcccacctggtcttctttcagttaactcccttcagtccacccaatgcagtcttttctctgcagccaaatttttttctatagttcaggtctgatgataccactttccattttcaaactccttaaattggcctcggagacctgtgatggccaatcttccccacccctgtgggtcaggttcctctggtgtgggcctatctcttagtgcaaggctccctgtagactgtcctggggctgcctgtctaattgtcttctcatgaaccaggtaggcargcaggaaccactcatctagtctgggggtgactggggggtgcgaaagttttgttacaggatgtatttaacacttncattgtctggctcaaaattctctttgaagaaactgcctttgtttaattctgtttawttatttagaacttacctagaattgatttgcacttgcaaaaatgctgctgttttagagtttgctttctaggctggttgcttgctctgtcaccttagctaaaaactaggtactggagtgccttttctattcycttctcttctttctttcttcttcttttttttttktttttttagtggagtctggctttgtcgcccgggcttaagtgcagtggcacgatcccggctcactgcmtcctccgcctcccaggakaagcccttgaacctgggagggagttgcggtgagcggagatcgggccattgcactccagcccgggcaacagatcctgactcttatcaaaaaaaaaaaaaaaagaaaattaaccttagtttaactttcttgctttaccaagtttttaatttttaaaattttttactcttttgtaatagcacttagtttaaaacacaacacattgtacagctgtactaaatatatcttcatttatatcattgttccatagcttttttcttttgtgtgtgtgtgtgtgtgtgtatgtgtgggtgancagtgagatccgtctcaaaaaaaaaccaaccaaacaaaaaaaaaaaaaaaaactcgtagggggggatccggtacccaattcg

SEQ ID NO: 2152 - DNA, 1004 bp, Homo sapiens
  misc_feature (471)..(471): n equals a,t,g, or c
gtgatggtccctttggttttggtgcctcttccatgagcttcagatcagaactagctatgtggttccaggctgccttggtttcatcccttgtcttgcctactccaccaggctcaggagggacatcaaggaggaagaaatggataaagtcctggagggacttcaaacagtatttgacccattccagccgccatgactcccaccagcttcgcagcagcaatgccttcctctttgatgcacaggaagacccctctgctctggatatagccagtcctggtggaatggctgcagaagatgagatccagagacagcggtagcacctgaaggaaacccttttcatcaacaactgcctgtgagaaaagctggaatgtcatctcarcagctttgatgaagaaaatggtgggagaggcccaacatgcacctctwaactctacaggcacatcatagattccatcgkccagctgtataatgaanacagagttctcaragaacaccggaractyccccgacttgsctgaatcaagtttctagaggtaacmactgatgttggaactwtkaaaagctcttctctacttttaacaaagcttagtcacaaacagttccccagttgacgagaacaactaaaacaacagaacaattgaaagtccaaatttgaaagctccatctccgagaagcaaattttacagccactccagatttgtattccaaatggatagtttgattataaaaatcacatcccttcagcctgcaaatgtgataactgcccaagagacagtgatgcctacatccatagataatcccctttcccccaacctatatataactggagtcaacagcagctggaggaaaatggcaaggacttgtaatcaagattaagttagaaaaacactgctgtagactgtttatcagctcttcagcatatgtccgttttccttgaaggatgagcgtttagaaacctctgacaataaagtttattttacacacaaaaaaaaaaaaaaaaaactcga

SEQ ID NO: 2153 - DNA, 808 bp, Homo sapiens
  misc_feature (1)..(1): n equals a,t,g, or c
ntccgtggggcaccgatgtctgggattactgcacggggtcgcgccgtggcggagcagcctccatccctgtgagatcactgccctgagccaatccctacagcccttacggaagctgccttttagagcctttcgcacagatgccagaaaaatccacactgcccctgcccgaaccatgttcctgctgcgtcccctgcccattctgttggtgacaggcggcgggtatgcagggtaccggcagtatgagaagtacagggagcgagagctggagaagctgggattggagattccacccaaacttgctggtcactgggaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgccttcccaccagccgcgtcgtgtgactccttcaagaccagctggtcacccgggaagggaatgagctctatcactgtgtcatctactggccctggggaatacatggttcatccccacgatggatgtttccacg

SEQ ID NO: 2154 - DNA, 2076 bp, Homo sapiens
ctgcaggaattccccgggcagcgtcttggcggcagttggtggaaccggagcttcgagtccgtccccggtgctgcctgcgcgttcacctgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctatggcgcccaccatccagacccaggcccagcgggaggatggccacaggcccaattcccaccggactctgcctgagaggtctggagtggtctgccgagtcaagtactgcaatagcctccctgatatccccttcgaccccaagttcatcacctaccccttcgaccagaacaggttcgtccagtacaaagccacttccttggagaaacagcacaaacatgacctcctgactgagccagacctgggggtcaccatcgatctcatcaatcctgacacctaccgcatcgaccccaatgttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatctcacagcattacagcaaaccccgagtcacaccggtggaggtcatgcctgtcttcccagactttaagatgtggatcaatccatgtgctcaggtgatctttgactcagacccagcccccaaggacacgagtggtgcagctgcgttggagatgatgtctcaggccatgattaggggcatgatggatgaggaagggaaccagtttgtggcctatttcctgcctgtagaagagacgttgaagaaacgaaagcgggaccaggaggaggagatggactatgcaccagatgatgtgtatgactacaaaattgctcgggagtacaactggaacgtgaagaacaaagctagcaagggctatgaggaaaactacttcttcatcttccgagagggtgacggggtttactacaatgagttggaaaccagggtccgccttagtaagcgccgggccaaggctggggttcagtcaggcaccaacgccctgcttgtggtcaaacatcgggacatgaatgagaaggaactggaagctcaggaggcacggaaggcccagctagaaaaccacgaaccggaggaggaagaggaagaggagatggagacagaagagaaagaagctgggggctcagatgaggagcaggagaagggcagcagcagtkagaaggagggcagtgaagatgagcactcgggcagcgagagtgaacgggaggaaggtgacagggacgaggccagtgacaagagtggcagtggtgaggacgagagcagcgaggatgaggcccgggctgcccgtgacaaagaggagatctttggcagtgatgctgattctgaggacgatgccgactctgatgatgaggacagaggacaggcccaaggtggcagtgacaatgattcagacagcggcagcaatgggggtggccagcggagccggagccacagccgcagcgccagtcccttccccagtggcagcgagcactcggcccaggaggatggcagtgaagctgcagcttctgattccagtgaagctgatagtgacagtgactgagtcccagggcattcagggctggttcagacaccattattgtgagcagcaaagcacttttctagtggtctgtttgtgagcctttcacttgtttgttccccacccccaaacctttgctgttaataaagtcaacttctytttaaaaaaaaaaaaaaaaaaaaaaaaaaaaaaaaaaaaaaaaaaaaaaaaaaaaaaaaaagggcggccgctctagagatccaa

SEQ ID NO: 2155 - DNA, 612 bp, Homo sapiens
cccgggtcgacccacgcgtccgggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccg

SEQ ID NO: 2156 - DNA, 336 bp, Homo sapiens
  misc_feature (1)..(1): n equals a,t,g, or c
  misc_feature (297)..(297): n equals a,t,g, or c
  misc_feature (310)..(310): n equals a,t,g, or c
ntgagaatgaaagaagacacaaataactattaagccaggacaagagattcctgataaatcaggaaatatggtcatactactttgaatgtagttatctattaaatgtgtctcttgtcattcaactgtaaagctgtgttaagtttgagccttatttctcttagcttcctttgttgcctggaattgtgtctggcacgttgtggtggcagaagaaatgttagtgcccctttaaaaatgttcatttatttaaaccattatactatattgatgtaggaactcatacccatcccatttgggggncctttttatgagnccattttctccagtatttccaaatgt

SEQ ID NO: 2157 - DNA, 1262 bp, Homo sapiens
  misc_feature (621)..(621): n equals a,t,g, or c
  misc_feature (641)..(641): n equals a,t,g, or c
  misc_feature (722)..(723): n equals a,t,g, or c
  misc_feature (726)..(726): n equals a,t,g, or c
  misc_feature (730)..(730): n equals a,t,g, or c
  misc_feature (1259)..(1259): n equals a,t,g, or c
  misc_feature (1261)..(1261): n equals a,t,g, or c
ggcaccagaaaaaaaaaagataatccaaagaatttaaattgtaatcatgtttcatgtatttgttttattacttacttttatagcacttagtcccagtggtattagactgctatttggtttcatacaaaaaggattaaatttaaattcattcatgtttagacttgagttattacatttttaaaactatcatcttgcctttaatgtttgtggtcctacacaaactattagtacatttcagtatcctcttacccctttgtttttaagtttttgattgctaaagcaagacttttttcttctagaatttaagtcaaccaagtgttatctatgttgtaaaaatggataatagtagattttaggtgataaaacaacttgttagtaagacatttcctagcttaaaaaaaaaaatcaaaaattccatgatagaaatgcagacctgtgagggaaactcctgaaaagcataagaagcatcccagagagccatgggttttctagaccagagaatttagagggagattgtggaactgaggcttaggtggtcagatcgtttcccttatcactgtaatattttctgggggaaaaatgctttctgagttgtttaaacaagcatccttacattttttntttaattaaaacagcctgtntagggcttgggattccctaatactacagtagcagtatatgaatatgattttgtgattgtgttttttaaaagataagtaatnngangaantgttcttttgcagtcagaaaacactcacaaaaagacaaaaaaagttccacagtattatatttcatgtcagttcaggcctaaaatcctttgcaaataagatgtttataggctggtcacaattaacaatgttattattggcagcacttcttggatggataccttttgggacctttcattagaaagagggaaagaatggggtggttttgtatgggctcctgtttggggtaaaaatagcagagtcagttgctgaggaccaatgacctttccttataaacatttagtttcatacccatattaggtcttgtcttgaggaccctttatatgtgcttgtttactagtggccttccagccatagcattcttacctttttttcctattctaagaattaaaaaaaaaaattatagagccagcaagggaggaggcaggaaacagaaatcgaatttcatcattccagtatagttgtccctttttttgtatttctgacttggttttataattatatttacttactaaaaaaaaaaaaaagggnana

SEQ ID NO: 2158 - DNA, 1146 bp, Homo sapiens
gctgacctcataatccgcccgcctcggcctcccatagtgctgggattacaggcgtgagcaccgcgtccggctgtcagaatttcttttaatgctacacatatataagcaaataatgtttttaagaagctaaccttgatgttaagagtggcaggtgttctccagtttttacctctttcatatgggaccaaagtagctagtttatggaacacatatgaaaatgtggttatgccaccaagttttactactacacttgtcttaccacttttaagtcatgaattctataattattcatacccctttgcctgtgatcagaagtaacttttaaaattatcacttgactttggatggaactagtataaaggcaggaattttgtctttcagtggagatttattctgttcaaggttgaagtggacacatcattatcttgggatggtacttctttatttaaatagtcctttaaagttctttgagtggcagagaacgtttttggtttcagtctgagaaggctaccaaatggtttaagttcatttcatagttaggagaaaaagattttgagtagtctaatgtcgtcagaaaggattaaaacgttgtatgtaccaagaaggcagaatgamgaaggatcacgttcacaaatgctgtatgtttaacaaaatacgtttagatggtaatatccaatagtcttatcaagtgctacaatctttttaaacagggaatggccaaatccagtgctattgaaacagcctgaagaatgcaatcttaatttgcctgtatgggacccaagggttagtgtattattttttcccctaccaattcacactgtgcaataacaagtaaaaatcatctgcataaactccagggagacttccagccttttacttatgaatggtcatgtccgtattacactttcttttagataacctcaactataattgtcctcaactataattgatgtgagaagcataattatgtaccctgtaaaccacatttaattgtacatagtttttaatacagattttactaacattttaatttattctatatagaactaccttgtaagtcaaagttgtgtgggcatttgtgctttaaaaaaaataaaaggatactaaaaaaaaaaaaaaaaaaaactcgagactagttctctctct

SEQ ID NO: 2159 - DNA, 1497 bp, Homo sapiens
gtgtaaaaccagtttcgggttagccatgtccgttgcacacatgcatgcatgtgtgttcttgtgcgcgtgtgttttctgtttagcagagaatgcgctagagagcgtgatcatcctgtgctattcatataataaagatgaagtgagagaacattagaggaaccaaggccatgtgatggtacacgtctgacgttttttcctttcggttacatgtccgtatctcctctttcccctttttcccctttgtcttcatttggttcccctccctatagggagtttaggacaagaagaggctaaagtttcactgatgagcctttctgagggttctccattaaatccaaggacagaaaatgtacagtcctcttattagcataacgaagccatcagcattgcatcaagcgggtcctcgtacccttttccttgtaatggtgtttggtgtagggtcctgaggaagagctgccagcccctacctgatggatcaaaatccccttggcaccaaagagtgactgatagtgttaaccatcacaggagacatgtatgtatgtgtgtggaactctgacgtgtattttaaactttgcaatagcccaaagttaatttgtttctttgccatttgttttcgaatgggtgtggcattgcttataaaatgttgaatgtaagttgcctaggacggcgcctggcatatggtggaaactgaataaaggctgctaggtagtgtagactagatggactagaaaacagyacagatgcagatgctttcagatgttctctctgccacagagagacctttctgtgtgctttgttcaaagttgacagtgtgagtaaactaccatcaacaaggsgttacttttgggtaattttttcaatgkttatcccagttccttcatccgcttttacatagcctcttgkactgcaagctacactcagttttgaagatggtgggttagcgttagagtggtgttctgtggccagtggaggaggaagcttgctcactttaatgcagaatgtctaagcatcctgcgctaaccattggcaggaaggttatttcagtgagacgctggttccttctcacccctgcacccttcctggaatcaccactggttgcagaagcctatatagrgtggctcatttggacgaagtattgttaaggtggttattagaagactcgcaacttagaaaaggaagtaaacatgttaatactagctttcataaatccccctctctaaaaaacacccctttctaaaaaattcacattactaaggcatcccctacacagaatgtttagtagggaggtattaaaattaatagcaattctgagtaagttccttctcatgtagttaatgcagcatgatgaaagaaataaaagtctccttatttttttactttctgtgttgcttcttaaatatactccttcaagtcaggttagcttaccttgggtgtttgtattttgttggcttatgtttgcatgtgtgaattaaaaaaaaaaaaaaaaaaaaactcgag

SEQ ID NO: 2160 - DNA, 1688 bp, Homo sapiens
caaagaagggattcatcttgcattggtggagctgctgaaaaatttaaccaagtaccctactgatagggactccatatggaagtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggacttgaccccttatttgggatgtgtgaaaaatttttacaggaagtagacttttttcagaggtatttcatcgctgatttgccccacttgcaggacagctttgtggacaaactccttgaccttatgccccgactcatgacatccaaacctgcagaagtggtcaaaattctacagaccatgctgcgacagagtgcctttctgcatctcccgcttccagagcagatccacaaagcctcagccaccatcatcgagccagcgggcgagttcagacaaccctttgcggtttacctctgggttggtggttgccctgggatgttgatgcaaccctggagcatgtgcaggatcctcagaacactgttaaggtccagggtcttatatccagatggccaggsttcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaaggcaaaaacagtcttcccaaccgtgcctagagggcccttcttaggtgtcagaatgagccaagcctgaagcacttcacctggaattgatgtgtaggcttaaggagtatgtgacccttacagtctcatctggtatcaaacacaggataaattgtttcttcattaaaaaataaaaaaccttcaagtctacttacccttctcctgtccacaataaagttgagaaaacac

SEQ ID NO: 2161 - DNA, 1795 bp, Homo sapiens
ggcacgagaacaaactataaactacttacctgcatattgctttactgggaaaaatcttagcagatgatacttccttacatttgtagagtagaatgtgttttatgtcttttattagtatagatgactggccctatatcatctaatagatagtccttttcatcatggagatgaattattgtgggtccagagttttgtatatgtctctaatcctgctagggagtccaatcatacccttgtggtcctatacttcagccacacaggctgcagctttagtgacatcacacgtgtggaaaccctctctagaggctcaccagatcaatatttctcctgaaccttcaatacattatgatagatggcacactcagagtaattgtagtttaataaattctcttcaataaatggttctggaaaaacaatatctatatgcagaagaatagaagaagactgcccacttctaacaatatacaaaaatcaaatgaaaattaaagaattaaatctaagaccctgagctatgaagctactacaagaaaactttgggaaaaatcttcaggacattgacctgggcaaagattttttgagtaatactccataagtacaggcaaccaaagcaaaaaatgaacaaatgggatcacatcaagttaaaaagcttccacacaacaaagaaaacaatcaaagtgaagagacaacccacagaatgggagaaaatatttgcaaactacccatttgaatgggattaataatcagaatatatgaggagctcaaacaactctatagaaaaaaatataataatctgatcaaaaaatgggcaaaagatttgagtagacattcctcaaaagaagacatgcaaatggtaaacaaacatattgcgaagtactcaacatcactgatcatcagagaaatgcagatcaaaaactacaatgagatatcatctcatctcaattaaaatggcttctttttccaaaagagaggcaataactaatgctggtgagaatgggaagaaaaaaagaatcctcatgcactgttggtgggaatataaactagtaaaaccactatggagaacagtttggagtttcctcaaaaaactaaaaatggagctactatataatccagcaatttcacgcctgggtatatacccaaaagaaaataaatccatgtatcaaagaaatatttgcactttcatatttgttgtagcaatgttcacaatagtcaagatttggaagcaacctgagtccacaaacagataaatgaataaagaaaatgtactatacacaatggagttactattcagccatgaaaaagaatgagatgctatcatttgcaacaacatagatggaactggaagtcattgtgttaagtgaaataagccagaaacagaaagacaaacatcacatgtcctcacttatttgtgggatctaaaaatcagaacacttgaactcatggacatagagagtagaaggatgattaccagaggctgggaagggtagtgggaggaaggtgggtgttggggtgaaggatgtggggatggttaatgggtaccaaaaattgaatgaataaggcctactatttgatagcacaacaggctgactacagccaataatagtttaactacattttaaaataactaagagtataattggattgtttgtaacacaaagataaatgcttgaggggatggatgtctcattttccattatgtgattattacacattgcatgcctatataaaacatctcatatctcatgcaccccatcaatataaacacctactgtgtatccacaaaaaaaaaaaaaaaaaa

SEQ ID NO: 2162 - DNA, 1522 bp, Homo sapiens
  misc_feature (1282)..(1282): n equals a,t,g, or c
  misc_feature (1376)..(1376): n equals a,t,g, or c
  misc_feature (1462)..(1462): n equals a,t,g, or c
  misc_feature (1492)..(1492): n equals a,t,g, or c
  misc_feature (1501)..(1501): n equals a,t,g, or c
cgtgtccgcgcgcctgggagacgctgcctcggcccggacgcgcccgcgcccccgcggctggagggtggtcgccactgggacactgtgaaccaggagtragtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatcyatcttaatactaaggaaccaacaatcttcctgtttaaaaaaccacatggcacagagattcngaactaaagtgctgcactcaaatgatgggaagtcccggccccagtacaccaggggctttggacttttttcaacttcgtttccttttgtttggantccaaaagaaccactttgtggttcttaaaagggtgtgaaggtgatttaaggggcccaggtcagccactggttggtttacaaaatcngggtaactaactgcatacaactttttcccntttccatgncatcaggactttgctaaagac

SEQ ID NO: 2163 - DNA, 875 bp, Homo sapiens
tgggatttccctttatcatggaggccttgtcccacttcctctatgtccctttccttggtgtctgtgtctgtggggccatctacactggcctgttccttcctgagaccaaaggcaagaccttccaagagatctccgaggaattacacagactcaacttccccaggcgggcccagggccccacgtggaggagcctggaggttatccagtcaacagaactctagtcccaaaggggtggccgtagccaaagccagctaccgtcctgtcctctgcttcctgccagggccctggtcctcamtycctyctgcattcctcatttaaggagtgtttattgagcaccctttgtgtgcagacatggctccaggtgcttagcaatcawtggtgagcgtggtatccaggctaaaggtaattaactgacagraaatcagtaacaacataattacaggytggttgtggcagytcatgactgtaatcccagcacttttgggagccaaggtgggargatcaattgaggccagagtttgaaamcagctaggtaacatagtgagaccccctatctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggccaggtgaggtggctgatgcctgtaatcccagcactttgggaggccaagatgggaagattgctttgagaccagaagtttgagaccagc

SEQ ID NO: 2164 - DNA, 3468 bp, Homo sapiens
ggcacgagcaaatatggtgatcagcacagtgcggctggaagaaatgggaaaccaaaagttattgctgtcactagaagtacttcctcaacttcttctggttctaattctaatgccttggttcctgttagttggaaaaggccacagttatcacagcgaagaacaagagaaaagctaatgaatgtgctttctctctgtggtccagaatctggcctcccaaagaacccatcagttgtattttcttctaatgaggatttggaagtcggtgaccaacagactagcctaatttctacaacagaagacataaatcaagaggaagaagtagctgtggaagataatagcagtgaacaacagtttggtgtttttaaggattttgactttttagatgttgaattggaagatgcagagggtgaaagtatggacaatttcaactggggagttcgcaggcgctcactggacagtattgacaaaggggacactccatccctccaggagtaccagtgctctagtagcacccccagcctgaacctcaccaatcaggaggatacagatgagtcctcggaagaagaagcggcacttacagcaagccagatactctcacgcacacagatgttaaacagtgattctgccactgatgaaacaataccagaccatcctgacttacttctccagtctgaagattccactggcagcatcacaacagaggaagtgcttcaaatcagggatgagaccccaactttggaggcttctctagataatgctaacagccggctgcctgaggatacaacttcagtattaaaggaggaacatgttacaacctttgaagatgaaggatcctatataattcaagaacagcaggaatctcttgtgtgtcaaggaattcttgatttagaagaaactgaaatgccagagcctctagctcctgaaagttaccccgagtcagtctgtgaagaggatgttaccttagctctgaaagagctagatgaaagatgtgaagaagaagaagcggatttctccggactgtctagtcaagatgaagaagagcaagatggttttccagaagtacagacgtcgcctctgccgtcaccatttctttctgccatcatagccgcctttcagcccgtggcatatgatgatgaagaggaagcctggcgctgccacgtcaatcagatgctgtctgacaccgacgggtcctctgcagtgtttacttttcatgtgttttctaggctgtttcagacaattcaaagaaagtttggagaaataactaatgaggcagtcagctttcttggtgatagtctgcaacgcattggtaccaaatttaaaagttccttggaagtgatgatgctgtgttcagaatgcccaacagtctttgtggatgctgaaacactgatgtcatgtggtttgctggaaacactcaagtttggtgttttggagttgcaagaacacctggatacatacaatgtgaaaagagaagccgctgagcagtggctagatgattgtaagaggacatttggtgccaaagaagacatgtataggataaacacagatgcacaagaattggagctctgccgaagattatacaaattgcattttcaattgctgcttctgttccaggcctactgtaaacttatcaaccaagtaaatacgataaaaaatgaagcagaggtcatcaacatgtcagaggaacttgcccaactggaaagtatcctcaaagaagctgagtccgcttccgaaaacgaagaaattgacatttccaaagctgcacaaactactatagaaactgccattcattctttaattgaaactttgaaaaataaagaatttatatcagctgtagcacaagtcaaagctttcagatctctctggcccagtgatatctttggcagttgtgaagatgaccctgtacagacactgatacatatatatttccatcatcagacgctgggccagacaggaagctttgcagttataggctctaacctggacatgtcagaagccaactacaaactgatggaacttaatctggaaataagagagtctctacgcatggtgcaatcataccaacttctagcacaggccaaaccaatgggaaatatggtgagcactggattctgagacacttcaggcctttaggaaagaaactaaactgaagatgatgaagaatattaaccaagcaccttttatggacccttgcattcactgataactttctggcagcatctactttttagtgtaactaatgtcaaactgtatcatcaaaaacaaagatctgaaagaaaaaaacatctgatattttaacagctgccaatatctcccacaataactgcgtgaagaaggaattttttaattacttaacctacgtgaaaagaaaagggctaaaagtgatgcctacaaatacattactttctggggaaagaaaagaattccaagaatgtttgcaataatggcctccaatactgaaacaaccaaaagcaggtgaaatgaggctgaaatcaaggctgtttcattttagctgaagacctgcaaagctgcttggatttctagcagttgaaaacctaacctgcaattgatgcttaatcatccatccacatgaacatgcagtcagctatacgcatcaagactcgtttgcaaaaaccattgatttttcagtatgtgggataagggtttgggtttttttgttttttggtctgtataaggaattatgtgtgtgtgagttgggatgtatggatatgtgatagtcatattttcaaggtatggatgtttggtgataacgtctcagagcatgcctaaaagagcactgcaagattatttttgaagaaatgttattttattagatctaactcttcatagtatgtaaatgttagaacattttaataatattttaaaactgggctttcccagtatttcaaaaagaaataatatatctgttaacgttattggaatgctgctcagttctctgatcagtgcttatgttatgattgttgataactaaccaaagtagatgcctgcagagactttaaaatgtaaaataaagatgtatgctgcctgtcagctattctcattagaaaagttttaacttattttactccatatagaaactgtagagactaaaaccagttattttcttgtacatttgtgccatgcactgttgttatacaagaataggtgtacaaagctaaagaaaaattgtggtcattgatgatggaatatatgacttgcaggctttgaagtctgcagaattcaagaaaagagctgcaaatgcatttttgtatctttattcaggactcacatgctttaccctaaagaaacctggggctaggggaaatgaaaggaagcctgaagactgactaccaaaacatgcaatatacttattcactgtctaagtctgtagtataacatgaactggagtctctatccttttctaaaatcgcattttgtaagaaaagaaagaaaaaaaaaaaaaaaaaaaaa

SEQ ID NO: 2165 - DNA, 1223 bp, Homo sapiens
  misc_feature (1194)..(1194): n equals a,t,g, or c
  misc_feature (1210)..(1210): n equals a,t,g, or c
  misc_feature (1221)..(1221): n equals a,t,g, or c
aacctgaggaggctgtcatgataggagatgattgcagggatgatgttggtggggctcaagatgtcggcatgctgggcatcttagtaaagactgggaaatatcgagcatcagatgaagaaaaaattaatccacctccttacttaacttgtgagagtttccctcatgctgtggaccacattctgcagcacctattgtgaagcaatgtgtgcatctgaagcaacttgaaatgcagcttcttattgtctggaatgaatcccttaccaactcagtgccagcatcggtagacaccagtcagtgctgatcgctttttaaccctcttttgttgtgcattaattagaaagaaaggtattgaattgcggctagccagtaagccttgctaatctcttttattttgtaactgaagatgagacccaaagaaagggaaagctgagattttgtgccattccttttaaaatattcatcaggttaggtggggctgtgggggaaaagctactacagggaagagtgttctctgctgtctcttcactggaaaacagggaggggggatttcagactgtgaagaaagttgaatggtggtttttaaattataaagtaatgtattaaaaggtgcattaggctgtagttctaatattgagttcaactgtgaaatccatcagatgtgccaaatggagaagacagaaagcaacaaagtgaattgttctttagcccaagtggtacagtgaatttgctttaacagatgttgaaaactaaattttctactgtattcccagcacgggtgacttctttttctcttcattagccagagatgactaatttaaatttagaaccagattttaatttaaattaatatttccattaataacctattcattgcagatacctattatactgtgtaacagttgttttggaaattttatgtaaaattaaaactatcagtattttacagatgttttaattagacatgttattaacaggaacagtgcagaaactagaatcaagccttataatatcttatagaccatgcattttgaagttagtgtccactarggtcctattaactgtacattgcaagattcattattttgcctctgacactawgggaaaatttttagaagccaatgggacagattccagcctttaagcactgggtactacagccgtaaaaggaaatcccgcctggtagccagggatatncctccccaggttaaanccccccaaatnaa

SEQ ID NO: 2166 - DNA, 2465 bp, Homo sapiens
ccaccatttatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggagatgtaacctcgggtatggtgaaagacccaccggacgtcttggacaggcaaaaatgccttgacgctctggctgctctacgccacgctaagtggttccaggctagagctaatggtctgcagtcctgtgtgattatcatacgcattcttcgagacctctgtcagcgagttccaacttggtctgattttccaagctgggctatggagttactagtagagaaagcaatcagcagtgcttctagccctcagagccctggggatgcactgagaagagtttttgaatgcatttcttcagggattattcttaaaggtagtcctggacttctggatccttgtgaaaaggatccctttgataccttggcaacaatgactgaccagcagcgtgaagacatcacatccagtgcacagtttgcattgagactccttgcattccgccagatacacaaagttctaggcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaaaaaaatgtgctccgactagggggaaaacagtagttccgattttttcccattatttttattttattttctggttgccctagcttccccccctatttttgtgtcttttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaatttaaaaaaaaaaaaaaaaaaaactcga

SEQ ID NO: 2167 - DNA, 1480 bp, Homo sapiens
gaattcggcacgagctcaagctggcaggtggtcgggggagcggccggagaggagctgccgggagttcgtgccctgcaggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggctttttttttttttagaaagttagaattgtttttaccaagagtctatgtggggcttgattcacccttcatccattggctggaacatggattggggatttgatagaaaaataaaccctgcttttgattcaaaaaaaaaaaaaaaawaaaaaaaactcga

SEQ ID NO: 2168 - DNA, 1052 bp, Homo sapiens
gcaattttctgcatagcatcagcaatgagtctgtacaactgtcttgctgcactaattcataagataccatatggacaatgcacgattgcatgtcgtggcaaaaacatggaagtgagacttatttttctctctggactgtgcatagcagtagctgttgtttgggctgtgtttcgaaatgaagacaggtgggcttggattttacaggatatcttggggattgctttctgtctgaatttaattaaaacactgaagttgcccaacttcaagtcatgtgtgatacttctaggccttctcctcctctatgatgtattttttgttttcataacaccattcatcacaaagaatggtgagagtatcatggttgaactcgcagctggaccttttggaaataatgaaaagttgccagtagtcatcagagtaccaaaactgatctatttctcagtaatgagtgtgtgcctcatgcctgtttcaatattgggttttggagacattattgtaccaggcctgttgattgcatactgtagaagatttgatgttcagactggttcttcttacatatactatgtttcgtctacagttgcctatgctattggcatgatacttacatttgttgttctggtgctgatgaaaaaggggcaacctgctctcctctatttagtaccttgcacacttattactgcctcagttgttgcctggagacgtaaggaaatgaaaaagttctggaaaggtaacagctatcagatgatggaccatttggattgtgcaacaaatgaagaaaaccctgtgatatctggtgaacagattgtccagcaataatattatgtggaactgctataatgtgtcattgattttctacaaatagacttcgactttttaaattgacttttgaattgacaatctgaaagagtcttcaatgatatgcttgcaaaaatatatttttatgagctggtactgacagttacatcataaataactaaaacgctttgcttttaatgttaaagttgtgccttcacattaaataaaacatatggtctgtgtartttcaaaaaaaa

SEQ ID NO: 2169 - DNA, 2580 bp, Homo sapiens
  misc_feature (1777)..(1777): n equals a,t,g, or c
ggcacgagggccactggaacgacctcaatctctgcctcctcgccagttcattgtggtcgttgacccggcagcgagctttggagttcatcgagggagaagtcagcgcccagctccgaggttggagcagccccgccgggcaacttgaatttctgcaaacgaacacagcaccgggagctctgcagacctgtatcggcgcggaacccggactgagacatgccttttgaacttctcagatagaggaaccccagtgaagactgatcagttcttacagttctcaaagcatggcccataaatatgtgggtttgcagtatcacggatcagtgacatttgaggatgtggccatagccttctcccagcaggagtgggagagtctggactcttcccagaggggcttgtacagagatgtgatgttggagaactacaggaacttggtgtcaatgggacattcccgttctaaaccacatgtgatcgccttattggaacaatggaaagagcctgaagtgacagtgaggaaagatggaagaagatggtgcacaggataagaaagctccagtctacaaacaaaacatgccagaagatttttaggcgatgatgccacctgcacatggaaccaaaagatttgcagttggaagatgatacaatcggctgtaaagaaatgcccacctctgaaaactgtccatcttttgctctacatcagaaaataagtagacagaaaccacgtgaatgtcgggaatatggaaagaccctttgtcaagactcaaagcctgttcaacatgaaagaatacatagtagtgaaaaacccaacagatgtaaagaatgtgggaagaactttagtaatggacatcaactcaccatacatcagagattgcatgttggtgagaaaccctataaatatgaaaaatgtgggaaggcctttatcagtggctcagcctttgttaagcatgggagaattcacactggtgagaagccactcaaatgtaagcaatgtggaaagactattagcggtagctatcaacttacagtacataagagtattcatactgggaagaaaccatatgagtgcggggaatgtgggaaagcttttctagtatatggaaagcttacccggcatcagagtactcacactggtgaaaaaccctttgggtgtgaggagtgtgggaaggccttcagtaccttttcatacctggttcaacatcagcgaattcataccagtgaaaaaccttacgaatgcaaagaatgtgggaaggcctttagcactagctcaccccttgctaagcatcagagaattcatactggcgagaaaccctatgaatgtaaggagtgtgggaagtccttcactgtgtatggacagcttactcgacatcagagtattcatactggtgagaaaccttttgaatgtaaggaatgtggaaaggcctttagacttagttccttccttcatgcacatcagcgaattcatgcagagataaagccctacggatgcaaggaatgcgggaaaaccttcagtcgtgcctcatatcttgttcaacatggaagacttcacactggcgagaagccctgtgaatgtaaggagtgtggcaaggcctttagtactggctcataccttgttcagcatcagaggatccatactggggagaaaccctatgaatgtaaggaatgtggcaaagcctttattagtcgccatcagcttaccgtacatcaaagggttcatactggagagaaaccctatgagtgtaaggaatgtggcaaggccttcagagtgcacgtacatctcacncagcatcggaaaattcatactgatgtaaagccctatgaatgtaaggaatgtggaaagacttttagtcgagcctcgtaccttgtacaacatagcagaatccatactggtaagaagccctatgagtgtaaggagtgtggcaaggccttcagttctggctcataccttgttcagcatcaaagaattcatactggggagaaaccctatgaatgtaacaaatgtgggaaagcctttactgtttatggacaacttattggacatcagagtgttcacactggtgagaaaccttttgaatgtaaggaatgtgggaaggcctttagacttaattcattccttactgaacatcagcgggtacacactggtgagaaaccctttaaatgcaaaaaatgtgggaagacctttagatacagttcagcccttaaagtgcatctgagaaaacatatgagtgttataccctaagagtctgaggagtgtgggaagtgcttcgtgtgtagctcaaacattgttgaacatcggggaatttatgctggtaggaaactttcaaatgtgaagaatattggcaggtctattctcatcttataattcataatataactcagaaaacataagaatattcctttgtcatttataggtttgtaataccaatatttatactggtggaccattcagaaaaagtgggaaacattattacttaatggttacagcactgacagcatgaacttttatatgatgcatttattctaatgtgattgtatgaacaagtgaataaaaaaccttggacctcctaaaaaaaaaaaaaaaaaaaa

SEQ ID NO: 2170 - DNA, 1907 bp, Homo sapiens
ggcacgagccggcctgatcatagagtggaaaaatgaaaggcagaggtgaaggaagaatactaaatgtgaaaggctgaaatacacagggaagtgttgccagtgtgcaacagaatctcatctcgtgcaaaattgaattagacttccttactccttccttactctgggtaggtccatgtgcagcctttcctcagagcatctagcctgacatacttggctcatctgctgtgcttctaagccaaataaaaatcatcaaacacatcgaagatatttttgggagtcaccaggttaaagcaaagcctcagtcactgaaagcaaaaactgaattggccaggtctccactgacaaaacagagtaaatgatagtatgacagataatttcaagttttccaagactccaatttctgaaaaatgtctcatgactccaaaaaatcacgtacttcctaaaatgttgccagtggaggaccgaatcaaggttattgctgacctcattttttcaaccttttcagttatttgacctgaataggcaatcccccaggatttctgattgaattctacctgaaagtttagattttaaaagacaacctgtaggaagctaagtctcaggcaacaaaatttaaaaccatcagaacttgtttctccaaacatcaacctgctcctgtcaagtcctttttcatctctcccttttgtccctttacatactgttttgtaagttccttttgatatcatttattgcaggcagtatttttacatccatcttcaagaaacttgggagacatttagacatttagtatgtgtaaatgtctcccaagtttcttgcctctttatttcagataatgcctgtgattagtgaatggcggcattattcctgaagacaaatgaaggaacatagggagcaagattgactgtcatttgaatgatggaagagaagtagaattactgtgaggttacaaaaatcgtaagttagcagacattgagaaaggaaaacttcctacttgggcttttcaggcttatgtgacattatctggatgtgttttctagtctttcctaaaggagaaatttttattcctgggttgctgaaagctttctggactaaaaggatataagcagctcaatagcagcatagaggattagattaacggaacagcactgcatacaggaaagctacatctccaatagtttaggctgcaagtcagtagccaaacacaagagcatgtaagatttggaggacaaagtataaatattttaagtttacacaaccaagattataggctaccttcccaacttctaatttgaagagcactgaaaatggagctgtgaacacttcatttttaaaacctgacaatatggtgctattgactacttaatacaaagatatattacaatatttttaggtaaatgtattaagtctggcctgggcataaatgtacatacagaaaatgtttgtagagaattcatcaaaatcatgcccatttgctgttgtagagctacagtattcttcaatggtggtgactgaccagtgagtttctacttcttacagatgggacacaacagtcatgggctgtctcagctgcccaaagcctgaggcagaccacatgagagctgtggcttcttcttggattcaggttggataacccaattcagtaattaaatatgtaaattttggggggggttggggggtgttttctaggaacttgaagagtacgtgacattataaaaaatgggtgttggaagactaattgtagaaatttgacctgagggccaatgttacttggtgtaagttcactcagacagacatgtcagaacatgcccaaagaagcctatatcttgctgctgggaaatgtaaagcagttggcatgtagaatacgataataaatcatttaagaaaccaccaaaaaaaaaaaaaaaaaa

SEQ ID NO: 2171 - DNA, 2023 bp, Homo sapiens
cccacgcgtccgcccacgcgtccgaaaaaaaaaaaaaaaaaaaaaaattggcagactccagagcccacacatttgcactctagactctactgccttcctcatgaagaattttaggacccccgtctggctgtgttgttgcttggggttcaaattctggttgaaagatggcggctgcagtgggaccactattatctctgtcctcacagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcsaccagtacaaggccacagactttgtggcagaccgggccggcactttcaaaatggtcttcaccccaaaagatggcagtggtgtcaaggagtgggaagtgtacaacttccccgcagcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaattgtctgctgtgtttgtccctgaggggaggaggtagtgggaccctgaggcagaggccctgctagagctggcaggttcccctggggcagaccagagcacctcaggaaggggctgccacggcagggaagggaccaggcagccctgggagcccgcattccacaggggcccactgcggagttctcggacactcagggcacargcctgtgggttccctggaattttctagcatgatccagtttctgtgtccagttctccattctgagagtcaatcagttcctgataggttgtcattgatttttttcttcgttggttttaaccttctaaacatctccaggccactttcttagcctttttctaggtactaaaaagaggtcctacccacacctgcctcacacttctcctttccaaggctgcctgagtttggaggggcttgggtgtgtgtgaacaagggccctgcattgtctaggcctgcagttcccaggcttgggttcactttcaccatgcattggcaaaactagaaaagtaagcttgtgacaaattgttct

SEQ ID NO: 2172 - DNA, 843 bp, Homo sapiens
  misc_feature (2)..(2): n equals a,t,g, or c
  misc_feature (19)..(19): n equals a,t,g, or c
  misc_feature (87)..(87): n equals a,t,g, or c
  misc_feature (89)..(89): n equals a,t,g, or c
  misc_feature (525)..(525): n equals a,t,g, or c
cnagggataaccccaaagntgggaaataaaccctcaattaaagggggaaccaaaaagctgggaagttcccccccgcggtggcggccngntctaggaactagtggaatcccccggggctgcagggaattcggcacggagtgggaatgttgtttgtatgatactatttccacaawatgcattgagacttggtktgtggcctaggacatggtcaattctttytaaatattccgtgaatttctttagtgcatattctccgatgggggctgtggggacagagttctaaatatgcccattagattaaatctcttcattctgttgctcacatcttctatatccttattaatctgtcaatctcttcaagagaggtgttattaaaatctctcactgtatgtgtcactttgcccttaaaattctgatgatttgctttataaatggttataaccattttccaggaagaacattaaagaactttccattggcattatccagtttccctcaaaatactggttttttttattttggctnctaagcagctatgaatccagtttctcagaagcccttgtctcaaggcatttgtttccagattaccttgttagcatccacactatgggctattttagaaaaacaaaaaaagtatcaaaatcatatagctatgattttcctgtgcttgaaggagccttaaagctcatctagtccagccagtatttgttcatccaaattctgccaagaaatctctattgtcaagatattctttaccatctttgggacattctcattattagaaacaaatcctaagaagaaattctgccatakacaacccatccgttctttaaaaaaaaaaaa

SEQ ID NO: 2173 - DNA, 1841 bp, Homo sapiens
ggcacgagctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaaggtaccttaatttgaagaagtgttctgctttgtattaatagcctaataattattataattgtgaagtaatgtaagcatgtggaagaaaggtgataatgtaactataaatcatgctgtggactataaaattctctgcatttagcatagaacattgaattttattacataagtgtttaatgggtccttctgcattaaaaaagttgataaagatatagatgttaagctaaaaagcttgaatttattctgagatgttgtttgaggttttatcaatgtgagttcttaattttccattttgtagctcactcataacttcattgaatgtaattgtatgtgtctaataaactctttaaatgctagaggtatttcatttgatatttagcttctgaaagccctttgttataaagggaagtgattttctaaatttggtagcagcttgaaaacaagcaccacaaatgtaaaattgcatggttctttttttactaatttaatttttttgccaagttatgtgctagcaaaatgtttgaaattgctattctttttctgttagcttggtatatatgacttagactaagtatatgtatgtgatataatatatgtgtacatgtggctaaactgctaatgggcaaagattgttggttcttctgatgctgagtatacatcaagttcatcccatgattattttttattacgagctattgctgatgtgatgctactcttagctgcaccaccagtataaagcttaactgagaaagaacacccctccctcttagttccgtgccagactggtttgttagctttagttgtttcttagtgctctagccatgtcaccctgtggcactaatcaggacactgtttatattcttcctcttctgtgtccctattcactttgtaattattctattttagctggttatatggtagttaattggtagcctgttttcctttgttttctttacttgtgtcaagctccatgtcgttgttttgtgatgagcagtgatttagaactggccagaccttagaagagtcttcagcaagctgccctagggtaggggcatattctctgtttgttttgtactggtaccccaggaggatgccttgtaactgctctttggtcatgatagtggtaatgaatccattcatgtaaaatgcaatatgtctgttagtttggggcacccgaggctcagtagaggtttagtatgatgccttccctttcttctttgagttatgaagaaactaatttctggcacagtgtgactgcttcaaacctatgttctgctgctatctcctatagaggagggcagacttttttttcttagtgcatttgctggtaggtcaaggagggatggactttgaattagtgttcagagtcacagatcctacgtatgtgctcttcagtagaggattttctgtgatcctacaatgaagggaaagctatataatttattggtacttcctaaagatagagactaaagtcatggtagtattggccaaattaattttaaaactgaacaagtcatgaattttcatataaatcaaagaactttttccttataaaagcttccatttttgaaaagttgaaaaaaaaaaaaaaaaaaa

SEQ ID NO: 2174 - DNA, 990 bp, Homo sapiens
  misc_feature (657)..(657): n equals a,t,g, or c
  misc_feature (852)..(852): n equals a,t,g, or c
  misc_feature (859)..(859): n equals a,t,g, or c
  misc_feature (962)..(962): n equals a,t,g, or c
tggaagatttaaaataggtttcatatttctcttgaatatgaatatataagcttgaataagcttgagtccttattattatgaaattttccttattatttctaccaatgcttcttatattaaagcctgatctttttcatattagtatatgtacattagctgcctgtggattaacatttccatgaaatgtatttttgcattgtttgatcttaaactttttgtgtctttatataaggtatgctycttttaagcatgatatttttaaccacaatagttgaaagacaatctycaccttttacttgtatatttacatgtaatgtaatttttgatgcatattacgtcttattatttaaccaacctattttattttatctagggcatttttcagaaagccttattttcttgtattaatcaaatatttttaycattgtattttccyctattagttagkaatacgktacycyaaatatatattgtggstattttcagaattgcaatatgcctccttaatttattagaggctaacctaaattattacttttaccacttacttgaaaattctggaactttagaacatttattgttttatgcattttaattctacttgtatttttactactcctaaacattattattgttttagacaagccaaaatatatnttgttattatcttatyctccatttctttctgtatttttatgccactatgtatgctcaatttccttctatgtgatgaacctaattcagtacttttgttttttaatctgtgcaggtagcctggccattaaatttttatttttggtttgctgaaaaaattgtgtttatttctatatgcatacttatgcatatagaatnctaggtngacatatttttagtatttataaatgtaaagtcattwattkggcttctatcatttckgtkgagaaatcaattgtcagcccaatagtttttcattttaaattacngaattttttcatgtctctggttttagga

SEQ ID NO: 2175 - DNA, 1614 bp, Homo sapiens
  misc_feature (10)..(10): n equals a,t,g, or c
  misc_feature (1051)..(1051): n equals a,t,g, or c
  misc_feature (1160)..(1160): n equals a,t,g, or c
  misc_feature (1585)..(1585): n equals a,t,g, or c
aaataagacntctttgagcagcgattgctggatcattgatctgtttgaggaatgtctgacctgggcctraragctggagaaggtgcagattcaaagtragcggctcctraggagagccccaagstgctcgccttctccgtggcttccgcagctaccgtctgcacggtgagagggcacgggcacacggttcgggctggcgtgcagtctcccagccagccacgctctgctcaggcctggaagtgaaagccgcctccttcccgttatgccccccatacaggagcctcggtttttcagcaaaacgcggccagtccccttctccactgctgcctcccagcagagggccccaggatctccaaggtcccagctatggctttggacaacgtggcttcggcccctggggttgcagagcttgcattgggtttacctcggtctcattcattcatggagccaagggtggggtttcacctgcgaacatcagactgacttgctggcgtcaagagcagttgactcactgatgaaggccctggtgaggagaaagcactctgttcttcgcctactctgtaatcgttttgtcataatgagccatgaaaaaagtaatgaacttgtgctgttaatcgtcactgtaatgagaagtcttacgtacaacatagctgtggtggctgcgtggtttaatggctgcattagataggatcctcacatcccattcagaaccaaaactgatacagtgaaacaattaaggtgagcaaatagttttaacttttctttttttttttaagtttcattcttcctagaatatttttctaacaatttttatttcagctttaaagatgggtcatatagccaaacgggccatataatccaacattgttgagatgtcttaggacatctaaggcaaaactggcacatttgttctgcagactattgcaggaatgttttttcctagcatttctatattatctgtccattctgaggaaccagtgaatgtcctataaatgcacctcctgtcaaaaccatgcctgagaggtcccggctgggagtgacagggtgcttncttagattctattggtccttctctcattctccgaacttactcctttttatgggtaagtcaactaggtyyacagtcccttatttttaatgcctaagttttgacagcaggnaagaaaacaattttttaaaaattctcattacatagacgcacaagaatatgtcacataaagaaaatgtgtttagaatactggttttctatttacgcatgatattttcctaagtaaaattgccaagtggacttggaagtccagaaaggaaaataatttaaattaatgctggtgatcttaacaatattttgtaaaatgatgcttcccccttctccatggtgtagtcaattttgtacaattaggtatctgactttacaagtttgttatcctttctaatttttactgaactgaaagcacaaagaagactacacagaaaatctggaaacagttgcaggtgttgggaggaagatgaaatcgagctgtcttttaactttcgtatgtgttttatcagaatttgctggactatgctagcaaggactttgtttacnatcaaattgtactagtgtctgcagggttt

SEQ ID NO: 2176 - DNA, 1483 bp, Homo sapiens
  misc_feature (945)..(945): n equals a,t,g, or c
gaattcgscacgmgcgtggaggcgccacgtcccttgcggcggcgggagagaaatcgcttggacttcggggcggcctcggacggccatggcctttaccctgtactcactgctgcaggcasccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgtttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacataaaatgataaataggtaatttgaataattttattttaagctccttggttaattattttgtctattgtctcagctataaattcaaatttatacatactattgagtattaatattctctgatttcagggagaattctgtcagtcacatgatgattatgtttttntttaacattctttccatgcacttgttattttattaatttgcctgaatgatgagaccagaccagtgtctacagattttcattgtcagaaaaatctataagtctgccctttttacaatgatggatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaaaaaaaaaaaaaaa

SEQ ID NO: 2177 - DNA, 1373 bp, Homo sapiens
gtgaaatgaaatatgtataccaaaacacataaatttaagttttataattttctttccttgtggatctggaaaattttctttctgctgtttttcattctgatagttgctttggctttccctattccctgcctttccatattttgaaatgttttggtcaaattttttcctgttgagtgtgcagtatgttttgattgttaattttattgaccatcatctcagtggattatttatttgaaacttttctgtttcctgttctggaatgtttcctgctctggaagccatattttaactgtatactgatccagctttatttatcttaagtatttttacaattattttactgataatatataactaggtataatcactctagtcagtgaaatcaaactgataacacaaaatgatgctgctagtaaatttagcctgaaaaggatcagaggaagcactttttagtctaagtagtcaagatcaataaacttagaatgagagttttgtattatttagccttgtgatagaaggaaaaagtacagttattgaatctgtatattaatttatgcaaaatacacacattatctttccattaacacagtagtatgacatacagttttatcaccactggattcatgtatgcttaaaatgaaaatgaaaggaacacacaggaaagtagcttcttatcttcccagatacagcctccaagagtgcctctgctgtgtactggagtgagtttgaagaagttcaggtaatcctctcctaaccagcagcttaacttaaagtgcatcttcatttttgtcctaccactaaaagcttgcttattgacctccttctttcctgtctcctaaattgtgactggctctcagttagacttgcatctgttgctatttgtagcagcaattgcaggattcatttgctttttctcttgcagtgtatttctgaatgttttataactctgggtatgcataatgtacgtatatgcatatccatatggtcaagagttttcagaattctttgtttgaataatgaatgtgtgtattccctaccccttgttttgctctgtcttaacatttaagctttgcttattaaaatgtatttgttttaatgctttctctttagattgtaagctcttcatgggcagtggtcagatattctgtatttgtaacttcccgagaatctagtattttatcatgtacataatgaacatagaatagtattgattggaaggacagtgaagtacaaaatgagattctaaaatgacattttcattagggctcacaagtgtataagaagtatccctttcctatttttttgtttaatactttagaagctattacattaaaaaagctattctcattaaaaaaaaaaaaaaaaaaaaaaaa

SEQ ID NO: 2178 - DNA, 557 bp, Homo sapiens
  misc_feature (468)..(468): n equals a,t,g, or c
  misc_feature (479)..(479): n equals a,t,g, or c
  misc_feature (503)..(503): n equals a,t,g, or c
  misc_feature (539)..(539): n equals a,t,g, or c
  misc_feature (545)..(545): n equals a,t,g, or c
ggttatctgctgccttggtacccccccgccattacacaagagtacattttaagcacattatacctgagtgattgttgtaaaacacagatgcaatctttccaccatcctctaagaattcttctgtggcttccattggttaccaaaaaaagtctgtgtccagtgcacaagaccatgacccagctcagcctggtccttgcctccttgtctaactccctctccttcgggtatccaggatttgttcgtgctaacagacagacttctctaataggtgaattccttggtgggggtgggtggcatgcctttgcatattgctttctctctgctgagaatgcaagcctgtccctagccgtttctgccactcctcctgatctggtgagtttgatctgcctttcacaatgaatcccagkcagtaaatatttatcactgacatgctgaccctggcaaaaattgatgagagactcaactaangcagtgatagngaaggtacagatttgacatctggntaggacatagggttgacaaactttgtcactctttangtgtanagggaaatcccc

SEQ ID NO: 2179 - DNA, 1093 bp, Homo sapiens
ggcacgagtggactccagcggtggcttcttgatgctgcgcggtcccccactccctacatcagaatgcatcccgcatccagactccagcggtggtgctctacctgcacgctgttgccaagtccaagctaccatactcctgcctgagctatgacaacagcctcctcactgatctcccctttcttccctttgcctcctccagctcatttttcacagtgtagaatgacattttgtttgtttgttttgttttgtttgagatggagtctcgctctgttgcccagggtggagtgcagcggtgcgatctcggctcactgcaacctccacctcccgggttcaagcggattctcgtgcctcagcctcctgagtagctgggattacaggcatgcaccaccatgcccggataatttttgtatttttagtagagatggggtttcactatgttggccaggctggtctcgaacacctgacctcgtggtccacccgcctcggcctcccaaagcactgggattacaggcgtgagccacccggcctggcctagaatgacttttaaaagatcaaattaaatcaggtcactcctttgcttacaacgcagtgcgtttagaggtacaccccatgtctccacagggcatacagcatccgatttaatctggatccattccggcgccttcctctcccagtcacccagagggccccaaccccggcggccctttcttcctcaaatgtcctcggctctataccgtgcctgggtcttttctctttctctctgcctggaacattccttctttccccttttgtcttgcccactcctgtttacccttcaagtttcaagttcatgtcactgtctcagagaggttttcctgtgctcgccctgtttctctcaggaagccttgctcttttccatcatgcctctaatcacagcttataatcggatatttatttctgtgtctacagtcttgccctgccagactgtatgccccatgtgggcaggcgctcatgattgtttctgattgtttcacgcatgctgctaacccagagcctgggcccaaagctagttagtactcaataaacaatgcattgaaaaaaaaaaaaaaaaaaa

SEQ ID NO: 2180 - DNA, 1697 bp, Homo sapiens
ccacgcgtccggcggaacggtgaggccatctactgaaacacagaagcaattttaaaagaaaatggaggaagtataactgatctttgcagaaagtggggaagtgagttgaccagagaaggatgagagaattgccaagttgtactgaacgccaagctgagaatggtgattctgaagatagaatgcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgaatgaccctcgcctggtgtggtattgtgcccgatgtaccagacaaatgaaaagaatggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccttcaacagcaaaattgagttcaacaacacaaaacaatactgggaaacctgctacttcgtcagctaaccagaaacctgtgggtttgactggtctggcaacatcatccaaaggtggaataggttccaaaataggttccaataacagcactacgcccactgtacctttaaaaccacctccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattacagatggtcaagaagaaagctgcccaaaagaaactcaagaagtaatgtggccaagtaggtttttgtatcatattagcctaaagatgaaaggcttattattatgatataatctgtaatacactgtaatttgataaaagtcttcataatcaaaaaaaaaaaaaaa

SEQ ID NO: 2181 - DNA, 946 bp, Homo sapiens
ccatgctggacttgcagaagcagctgggcagatttcccggcaccttcgtgggcaccacagagcccgcctccccacccctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtc

SEQ ID NO: 2182 - DNA, 1448 bp, Homo sapiens
ctcaggggtacagtaccaaaccaaggttgatggtaccacttaaaatggactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaatggacagttctttgtggactctacccttcccttcaaggagtatgtcatatatcacaaaagaaattgccttacactggttcatgtttgcagttactgttgtacattgcatagatgtacacacgaatttaaatgtgatgtctttgtatatatctgtataatgttgagattacttacgaaatatgtctgagtgacacttttcacccttgtacagccaaaataatgtatatatggaaagtgacagacaaattctctaatctctttggtayctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaataaaaaaaaaaaaaaaaagggcggcc

SEQ ID NO: 2183 - DNA, 7644 bp, Homo sapiens
  misc_feature (403)..(403): n equals a,t,g, or c
  misc_feature (1529)..(1529): n equals a,t,g, or c
  misc_feature (7640)..(7644): n equals a,t,g, or c
agccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagntgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgyctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgncatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgayctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagmccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctakcatagcacttaaaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttsaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattaygtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaaraaaaagaagaaagacacaaagaaaataatctaaacaccaaaaactaaacacaattccaatcctttttctgtacctcacgcgcataaatttgctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgcttcaaaaaaaaaaaaannnnn

SEQ ID NO: 2184 - DNA, 1927 bp, Homo sapiens
  misc_feature (1920)..(1920): n equals a,t,g, or c
  misc_feature (1923)..(1923): n equals a,t,g, or c
  misc_feature (1927)..(1927): n equals a,t,g, or c
ggtggccccagcgtgctgtggcctccgggagtgggaagtggaggcaggagccttccttacacttcgccatgagtttcctgatcgactccagcatcatgattacctcccagataaccatgcctcgtacttactcaacaaaagtgaagccaaaagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgygtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacrgatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccstcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagasatgtctatggtagctgagccaaacacgtaggatttccgttttaaggttcacatggaaaaggttatagctttgccttgagattgactcattaaaatcagagactgtaaaaaaaaaaaaaaaaggggnccnttan

SEQ ID NO: 2185 - DNA, 756 bp, Homo sapiens
  misc_feature (354)..(354): n equals a,t,g, or c
tcgacccacgcgtccgagcatattaggattatatgtagatttgtatgtattttgcattatgtacttcagtctcctagttttattattctcaccttccgttttattcttggcgaggaaaaaatgcactagaaataatacattaaactgactcttagtcttaatgtacgcttgctgtcttaaatagggtgattgagtccaacagactcaatcatacatgtcatacatgtttatgattaagagatattctttttgtgtgctagttgattttgccgagaaaaaatgaagaagaattcaagaagagatgagggtaggtaagctctcagagcatttctgtctgcccatttggttctatgncttatgtgggctgctaatgtgactaattcagagtgttgtatttccacatctgtggattccaccatggaaaaggtgggctaccattggtccttatatggctttattagaaaaatagacattctatcgtttgtctgcccagtggccagagtcctggtgaacaacagagctcatgggaaaycagcctctctcagggcaccccgctatgaggatattgaaatatgttcaatcatttctcatctcccttggaatgtaattccctgccctatacaaaataggatattccaatgcgctatttgaatctagggattgaggatttgtagttgagttttggggtaaaggcttggctcattgccatggaagaataaaagttatttattaaaaaaaaaaaaaaaaagggcggcc

SEQ ID NO: 2186 - DNA, 1768 bp, Homo sapiens
ccacgcgtccgcccacctgtgttaagacagctaaatatttcttgatgttggcttgaggaccaagtgagccatcttgccagttaagcaagttttatatcagaggaccaaatggttaagaagagaatttgtacatttcttgagcttccccatgtgaagcttgggttcagtactatcctattactatccatcttcataatgagtgaagcaaactgaaagggaattcataatcttttttcttatctgaacagaaaaactaatgaaaatcaacaataaatctttattttaattttcattcaacagctgaaaaaccatgtctgttgaccacattggaccattgcctagttaaaatccataaaattccctataaaccaatgaaaagaaacttgtctggcaataatttccaacattttaaattctaatttttagttacaaagaaaaaggatagaatgaggcttttcaaggaattcttgctcatcccttcaattatttggcaggtaaaacagtcctagaattcagcttcctttttggttttattactattaaatagatactttcatataaatggaaacacttttcctcaaaacattaattcaaaacatactccttatattaaggattatagcaccatattttttgtatattccctatgtgtaactttttcctgttggtatgtgatatttttcatttaatatgactatctgctggtgttggggccaatagatttgtgaatattctgtggatgtgtctatgtataggtgtatatatatatatatatttttttttttttttcccagctaattacctcaaatgtgtgattgtttaatatataccacactatgtttgcacagagcagggcttccattagcagtggatatttttatgtctgactttgaaaatcagtcaacacaatttcattggtgtgaattatttgttgctctttttcatattttaatggagagattcctattataaggcccatgcttcaaacataattatatctttctatatccagccatctggaaatacataggggtaagaagtatttcttgaaatgtccttgtttagtaagttagtaaaaactgggatgactagttgccaagatgtcttgtaactgcatagcagatgacacctggcatggcaagtctcattcacttcagcacaacactctgtacatttcagtctgatattctactttgccatttaaggacaccattaaaatcatagagattttcagtgacattggagtattgtaattattactttcaaaaaattatttttaataggatgattaaaccaatgagaagaaacacacataaatgatattttgcagtttatctgtattaagaaatgcttcttgccaatttctagttttagtttttggattgctacataagactttctttccatttactttatgtgtttttaaaagctgcaggtaatttttaaggtttgatggaattataatggaagccttgtataagttaaatgaaattggtaaaggagagcttactttgtctataatgcattcaggattaaaaattagatttcaaaatgaaatgtctgatttgtaaaatatttaatgttatatcagacttacataaaattttctgtgagaactcaaatgcatttgatttttaatgaatgttctgaatgaaatatgaatttttgtctttcagtctctgtagtttatctcaatatattaataaaaaggtctgttctcactgtaaaaaaaaaaaaaaaaaaaaaaaaaaaaaaaaaaaaaaaaaaa

SEQ ID NO: 2187 - DNA, 1472 bp, Homo sapiens
ggccacgcgtccgcggtacggtggtgcggctgcggcagcacagacccagtgcctacatccttgtctccaccgtgctaaccctcatggtgccctggcacagcctggaccccgactcagcgcttgcagatgccttctaccagcggggctacaggtgggctggcttcatcgtggcagctggctccatctgcgccatgaacaccgtcctgctcagcctcctcttctccctgccacgcattgtctatgccatggccgccgatgggctcttcttccaggtgtttgcccatgtgcacccccggacacaggtgcctgtggcgggcaccctggcgttcgggctcctcacggccttcctggcactgctgctggacctggagtcgctggttcagttcctgtcccttggcacactcctggcctacacattcgtggccaccagtatcattgtgctgcgcttccagaagtcttccccgcccagctccccaggcccagccagccctggccccctgaccaagcagcagagctccttctcagaccacctacagctggtgggcactgtacacgcctccgtccctgagccaggggagctgaagccagccctgaggccctacctgggcttcttggatgggtacagccctggagcagtggtgacttgggcgcttggcgttatgttggcctcagccatcaccataggctgcgtgcttgtctttgggaactcgaccctgcacctcccacactggggttacatcctgctgctcctgctcaccagtgtcatgtttctgctcagcctccttgtcctgggggctcaccagcaacagtatcgggaagacttatttcagatccccatggttcccctgattccagccctgagcatcgtcctcaacatctgcctcatgctgaaacttagctatctgacctgggtgcgcttctccatctggctgctgatgggacttgcagtgtatttcggctatggcatccggcatagcaaggagaaccagcgggagctgccagggctgaactccacacactacgtggtattccccaggggcagcctggaggagacagtgcaggctatgcagccccccagccaggcaccagcacaggaccctggccatatggagtagctgatcagcccacacttgccccgccctcccacacctgcttgggaggccagagaggccagacaagccgagagccccttctgttgtgggcagcctgggtttgcaggcctgcacaggctggggagtcctcaggaccttaggaccttcatccaggggctgggcttcgggtcttcaggagtgggccttggctggtgctggtgccatggactctgcccagagccttcttgtttatgatcagctccagctacctgggcagttgtggtggggtggatgggaaggcccacagcccaagggatccataataataattgcttggccagccatgtggcctgctggcgtaaaaaaaaaaaaaaaaaaaaa

SEQ ID NO: 2188 - DNA, 2307 bp, Homo sapiens
ccacgcgtccgggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgataaaaaaaaaaaaaaa

SEQ ID NO: 2189 - DNA, 1538 bp, Homo sapiens
  misc_feature (1)..(1): n equals a,t,g, or c
  misc_feature (326)..(326): n equals a,t,g, or c
  misc_feature (1494)..(1494): n equals a,t,g, or c
ngggtagagagcgcgcgccgttccctccggagttcccgagctgctgaggagtctggattgtgtctgtccccagtgtcagatgaaagggcgctgaggctcttggccgctgccccgcgcccagctccgcgcacgcccctctgcgagtccggccgcccagcgcctcttcccgcccgagccgccgcctgcgctccggggcagccgctctgtctccagcgcgatgtggcctcgcctggccttttgttgctggggtctggcgctcgtttcgggctgggcgacctttcagcagatgtccccgtcgcgcaatttcagcttccgcctcttccccngagaccgcgcccggggcccccgggagtatccccgcgccgcccgctccctggcgacgaagcggcggggagcagagtggagcggctgggccaggcgttccggcgacgcgtgcggctgctgcgggagctcagcgagcgcctggagcttgtcttcctggtggatgattcgtccagcgtgggcgaagtcaacttccgcagcgagctcatgttcgtccgcaagctgctgtccgacttccccgtggtgcccacggccacgcgcgtggccatcgtgaccttctcgttcaagaactacgtggtgccgcgcgtcgattacatctccacccgtcgcgcgcgccagcacaagtgcgcgctgctcctccaagagatccctgccatctcctaccgaggtgtcggtacctacaccaagggcgccttccagcaagccgcgcaaattcttcttcatgctagagaaaactcaacaaaagttgtatttctcatcactgatggatattccaatgggggagaccctagaccaattgcagcgtcactgcgagattcaggagtggagatcttcacttttggcatatggcaagggaacattcgagagctgaatgacatggcttccaccccaaaggaggagcactgttacctgctacttttttttgtagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgttcaccctgggttttgatcttgtgggggaagcagcatcatcttattgttttaccccantggttttgtgggttccggtttcagagagctaattgcaggaggta

SEQ ID NO: 2190 - DNA, 2100 bp, Homo sapiens
ggttccaaacagcagttaggtcagcagtccgctcagccgaggcagctctgttcatggcgttctcgaagctcttggagcaagccggaggcgtgggcctcttccagaccctgcaggtgctcaccttcatcctcccctgcctcatgataccttcccagatgctcctggagaacttctcagccgccatcccaggccaccgatgctggacacacatgctggacaatggctctgcggtttccacaaacatgacccccaaggcccttctgaccatctccatcccgccaggccccaaccaggggccccaccagtgccgccgcttccgccagccacagtggcagctcttggaccccaatgccacggccaccagctggagcgaagctgacacggagccgtgtgtggacggctgggtctatgaccgcagcgtcttcacctccaccatcgtggccaagtgggacctggtgtgcagctcccagggcttgaagcccctaasccagtccatcttyatgkccgggatcctggtgggctcctttatctggggcctcctctcctaccggtttgsgaggaagccgatgctgagctggtgctgcctgcagttggccgtggcgggcaccagcaccatcttcgccccaacattcgtcatctactgcggcctgcggttcgtggccgcttttgggatggccggcatctttctgagttcactgacactgatggtggagtggaccacgaccagcaggagggcggtcaccatgacggtggtgggatgtgccttcagcgcaggccaggcggcgctgggcggcctggcctttgccctgcgggactggaggactctccagctggcagcatcagtgcccttctttgccatctccctgatatcctggtggctgccagaatccgcccggtggctgattattaagggcaaaccagaccaagcacttcaggagctcagaaaggtggccaggataaatggccacaaggaggccaagaacctgaccatagaggtgctgatgtccagcgtgaaggaggaggtggcctctgcaaaggagccgcggtcggtgctggacctgttctgcgtgcccgtgctccgctggaggagctgcgccatgctggtggtgaatttctctctattgatctcctactatgggctggtcttcgacctgcagagcctgggccgtgacatcttcctcctccaggccctcttcggggccgtggacttcctgggccgggccaccactgccctcttgctcagtttccttggccgccgcaccatccaggcgggttcccaggccatgggcggcctcgccattctagccaacatgctggtgccgcaagtgcggatgacagcagatggcattctgcatacagtgggccggctgggggctatgatgggtcccctgatcctgatgagccgccaagccctgcccctgctgcctcctctcctctatggcgttatctccattgcttccagcctggttgtgctgttcttcctcccggagacccagggacttccgctccctgacactatccaggacctggagagccagaaatcaacagcagcccagggcaaccggcaagaggccgtcactgtggaaagtacctcgctctagaaattgtgcctgcatggagcccctttagtcaaagactcctggaaaggagttgcctcttctccaatcagagcgtggaggcgagttgggcgacttcaagggcctggcatggcagaggccaggcagccgtggccgagtggacagcgtggccgtctgctgtggctgaaggcagcttccacagctcactcctcttctccctgccctgatcagattccccaccttacccgggccctacaggagcctgtgcagatggccatgcccaaccaataacgagacggttcccctccctttccctgccaggctcatgtctttacaccttcactcagccacgccaaccagagactgggttccaatctcaccccaccacatacagagccctcatctgtgaaatgagaatgatcacgtgacccaccccccagggcaggtatcagggtgaactgatcttagcaccggccaaataaatggaacctgctgagagagctgccagaaaaaaaaaaaaaaa

SEQ ID NO: 2191 - DNA, 1109 bp, Homo sapiens
  misc_feature (1109)..(1109): n equals a,t,g, or c
ctgcctgtgcgtccatcctcatgaactccaaatctccccgctactccacaggacaaagaaaacgagactgacaacgaagtcctgaaggagaaaggcaagtatctttctgcctggactggccctcaagacttagcacaactgccttcaccagtgagcacaaagccacatttcaaaggaaactgacaaattatccccagctgccagaagaagaaatcctcactggacggcttcctgtttcctgtggttcattatctgattggctgcagggatgaaagtttttaagttcataggactgatgatcctcctcacctctgcgttttcagccggttcaggacaaagtccaatgactgtgctgtgctccatagactggttcatggtcacagtgcaccccttcatgctaaacaacgatgtgtgtgtacactttcatgaactacacttgggcctgggttgccccccaaaccatgttcagccacacgcctaccagttcacctaccgtgttactgaatgtggcatcagggccaaagctgtctctcaggacatggttatctacagcactgagatacactactcttctaagggcacgccatctaagtttgtgatcccagtgtcatgtgctgccccccaaaagtccccatggctcaccaagccctgctccatgagagtagccagcaagagcagggccacagcccagaaggatgagaaatgctacgaggtgttcagcttgtcacagtccagtcaaaggcccaactgcgattgtccaccttgtgtcttcagtgaagaagagcatacccaggtcccttgtcaccaagcaggggctcaggaggctcaacctctgcagccatctcactttcttgatatttctgaggattggtctcttcacacagatgatatgattgggtccatgtgatcctcaggtttggggtctcctgaagatgctatttctagaattagtatatagtgtacaaatgtctgacaaataagtgctcttgtgaccctcatgtgagcacttttgagaaagagaaacctatagcaacttcatgaattaagcctttttctatatttttatattcatgtgtaaacaaaaaataaaataaaattctgatcgcatn

SEQ ID NO: 2192 - DNA, 798 bp, Homo sapiens
tcgacccacgcgtccgacttcggaaactgaataaggtgattagtgacctgactccagtcagtgagcttcccttaacagcccgaccaaggtcaaggaaggaaaaaaataagctggcttccagagcttgtcggttaaagaagaaagcccagtatgaagctaataaagtgaaattatggggcctcaacacagaatatgataatttattgtttgtaatcaactccatcaagcaagagattgtaaaccgggtacagaatccaagagatgagagaggacccaacatggggcagaagcttgaaatcctcattaaagatactctcggatttgtcctacagcttagtattgtggttgacagcgatactagggctgacagcacagaagtcacaagagaagagtggaagggcaagaattcaaagcatttgttcatacaatgtggcaacctcttttgcatagttgcgtaggatcctgtttgtaatgctatcataaatattctgtagttttttttttttctctcccaactggagctatgacactttttattggattcagtcttgtctcttgtctagaaagaactttatcttgttgacgcatgagctgtttaaaaattatcctattaaatgttggttaatagttgtgcagtttttcatttcagatggaaaggcaatgcaaattttgcctttgttttctgtcaccttccaacccctgagcacttctagtcagatacagattcatcagtgtatgcaacatcctttgtaatttaaaataaaaaaagatgaaaaaaaaaaaaaaaaaagggcggcc

SEQ ID NO: 2193 - DNA, 920 bp, Homo sapiens
  misc_feature (907)..(907): n equals a,t,g, or c
  misc_feature (914)..(914): n equals a,t,g, or c
  misc_feature (920)..(920): n equals a,t,g, or c
gtcggaattcccgggtcgacccacgacgtccgcaaaattaacatcaaaaaggtatatactttttaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccacaaattcttaaaaagrttgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaatgtctttgtaactaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtagtttttttttaaacaaaaaaaaaaaaaaaaaaaaaaaaaaaanggggggncccccn

SEQ ID NO: 2194 - DNA, 4699 bp, Homo sapiens
ccacgcgtccgttctgtccatgtcagcatccctgccttaagagaactcctcctggccaatggcattgccacccagcagtgggaccaagactctccaagacctccaggactggatcccattgcctggagaaactccagcaagggtctctcatggcttggacatggcacagtaaggggcagccaacccagtccatgatgacttttgctccaacttcttcatgtttctaaaagcccagtggctttattcactcctcctaaattgcctgctaccagaaggaacttcatcctgaagaaatgcattccattaccagttccagggaaagtgtccccttccccaaagcctcaggcccgtgggcctctgaggttccactggatgcggctcccccaggagtgggcctggagatccgctcagccgccctgcctcccaccttctatcttgggaccgtggtcagccctgaagggtggttccagccccgcgtatgctgcactttgctgctgcaggctccggtccctccagggcttttcaatgagagttcccaccccaacttggagcatttcatttttgcctacctaaagcaagaatctcaaagtttgtttgaataagaggcccattcacaagtcgtgcccttgtgagcacccctttgctgagtgcctcgtgggtgccaaacactgtacttggcgctttgcattcatgctttgaccctcacaacctccctttatagatgaggaaattcacgctccatgtgcccaaggacacaccagccaggaggaagagggaagaggatttgagtccaggcctgcctgacttcagtgcctgtgccctcccctctgtaaaagacaaaccaggcagggaagagatagaagctggctaagtggtggccaagtggcttcattgtgaggggggtgagggggcattcgtggctgctcccacacccaccatccctccagcccacagcagcctataccaaaggctgccccggactcaacagctgcgtctccatgacaggagaatgccagggtcctggtggttggcacagagccctgttccctgcttctaagctgttgccccctggggaatagagcttatggagcaacgggagctgaggtggcctcgagggccagcctggagggctctgagcatagcatgcagcggtcccatagggaggcaggtaaccaagggccaggcagagctgcttcctgtgcctctccggcatttgtaatggttttttcttttttcacgcactgccaaatctgttttctcccttgaagaaacccagggcagatgtggtcgtctgtcaaactgaggtctggagaggcatgactaaatcactgcagaagcaaaatcaggacccagcatttctagctcccagcccagagtaagagagcagagcagaaccccttcccattctacccgaccgaggcagccctgccctgccctgccccgcccctccccaccctgccctgccccagagatctccagttcacagtgttcatcaggcgagatacttttggacccacaaagccagttttttggggggatgctcagtgtctacctgcagtgccaaagttttgcttgaacagccctcttctgccgcgcctcccagctccaccccctatcaacgtgggtgctggctgcttctgcgtgaggagcttcctctgatcacctgtagcatctttagtgccttcgtccagtcggcctgcaaatcccatttcccagagaggcttgggcagggcccacttgccacttggccctgtgcccagagcgttgggggcagatggcagccaggggaagaagggaggtggggaagggccgccaccgcttgagggtcccctcccttgagaggaggccccatggcagttttcctgagttcttgatccactttggtttaaacaacttttgtgaagctatgtgagatttgactgcatttcaaaagacaaaacacatgtttttttctgatttgctctttgcctttcagcgacgctttcagatactttgtgagtgtctactctgtgctaggtgctgagtagactgggatgtgtgtggctccatccctggctggaagagctttgagtcctgtctgctgacttcactgaaggagtttctctcttgcttcattccttcctcccgggggtcagctgggtaggagcagacttgccctgccttcctctaggcagaaagttttcctgcaaatgaaagaatctgccattctcttttgctatgatgatgatgattattctgacatgacccgcgggtactgaagccacagtcctctctgttcactgttctctccttgagtcatatctatggcctgaggacgtctgtatccagctccttttcctacaatggtagacacttccccaggcagtgggtgggtcggggtggccagtcactctcctagctgtccttgcctggggacttagatttaccccatccaggactgtggtcgctattctgtgagcgattgatggcgcatatgcagaactcccctggagtcatggctctagaaagtgtccaggcccatcgtgacaatggtgccaagcaccgggctggtgaccagtgcctaaacacacacgctcccttaatccttacggcaagcctgtgaggcggataggaccagccctgatctatagtgagaaaattaaggttcagagggagaaggtccaaatagtggccaagctgggactgagatctcgagtttgggtttgtttgggttttgttgttgttgttctttccctcgtgtccatgacttttctctgccattagcagggaagtgtgcggagggcttccagggaatcaagtgaccctccctctgaatttcggtgcctcttccccccgccccttgctcacacatttcagtaggtcacaggccaaatggcagcccaaaaggtgggcagagattttttttttcttcccctcacccctgcttattaacacaattgtgacaactactttaccttacatcccagggcaaacggacagcttgcggtacctccaaaaatttggaaaaccctgagtctaagaccacctcttgataaaagaggcctttgctcacattttctgctcggaatctttctttgccattggtgggtgtatgtcgtcccagctgagactgcgggagagctgagctccagcttaaaccgcttttaatggcccttccctactgggggatcgctggagcccatgccaggttacggtagtcattttaaacctctgccacaaggccacgccatagaatcaatttccaagtcaatgttcttggccctaaaatgtttgcgcccactgaggatttcattaccaggtggaagatgggggaacatatgccacgttaaagagcaagtgctgagtgtgccaggacttgagaaggaccttaggctgaggagtggacagtctggtatttatttcgcctctcccaagtacccagcacagagtgggaaaaagaagaaactgctcctgccttccagtagctggcaacttgacatcaagaacaaaaacattcgtagctggacccccgtcctttcatcgtgcccaagtcttacatgttggcttaagctgcccccttggaggccgtacctttctctttggactgtgacagtggacacctaacagcctgagccatgtgtggctgtcttatcccccaagggttgtccaggcccgttctgcagggctgttgtgtagactgcagacatccatacctcaccacagaccaaagatgacctcgtgtcagactgtgggctgatgagaggtagagcagcatgcatcgaggcctgagggtgcagggcgccctctcttggcctggaggaattgctcctaactagagtaagtttccacgagggtcccaggcagagctgcagagctggaaccggaggctccacagtccttgcctgctcatggacctccttcagagcacctttctacagactggactgcccagctccgtggggtggcatctggtttctggtgctattctgccaagttatcgagctcctcctcatgtttcaacattccatcttcccgtttctatcctcgactccaaagtaagccttcttagctccaatcagggatgaggggctcaacctcttctgtcctcaaagaggccaaacgcagtgccacagtcggtagccttcacttttagatgtcctattcatgtaaaaaagaaggtgcccccaccaggcttacatcagcaataagcaattctaatgcaacgatggtgtccacattttaccccagtgtgtgcccatgtatgcctttgtgcccgtgtaattattgttagcgcccctttcacttagaggggtgatgataaactgtggccaccttgattacaacccacatttcctgctttggggagcttccaagtaacaggccatttcttacctccctccaggaacagtgggcactgcccaccacctcgtgtctgctcataggatgacgctggagatccccacacttactctaccctcttggcaaattggcattccggtggtggtttttgtttcctttaacacattaaataaatgagtatataggatgtgaggggaggggtgagaacaactagctgtagcatgtgtaggctatatactttaccattcgacttctttcctttttttttttaaaataaaaaaagtgcttgactggtttcaagcttcatcatgaaaaaaaaaaaaaaaaaaaaaaaaaaaaaaaaaaaaaaaaaaaaaaaaaa

SEQ ID NO: 2195 - DNA, 1859 bp, Homo sapiens
gtttcgcctcagaaggctgcctcgctggtccgaattcggtggcgccacgtccgcccgtctccgccttctgcatcgcggcttcggcggcttccacctagacacctaacagtcgcggascggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggargcgggagacacaactggggccagggctttcgacttggagaccagtgaaggggcggcctcgggcagccgctcctctcaagccacatttcctcccagtgctgggtgcrcttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgawggttstgtggtgywgtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactga

SEQ ID NO: 2196 - DNA, 2631 bp, Homo sapiens
ccacgcgtccgggcgaccgcgcgccgcccgccctcgcccgcctttgaagtttgctgtgccgaccgcaaagttgggacacttcagcggattgaatttttctcttttatctgcctccgtccccgccctccaggcttctcgttcctggatattggtgcttagcatcttggcagggtccggggacgtggactatttcgcacaccacaccacggggagggatttttttctattttccctacgaaaaacagatctttttaaggatggtgctgctccactggtgcctgctgtggctcctgtttccactcagctcaaggacccagaagttacccacccgggatgaggaactttttcagatgcagatccgggacaaggcattttttcatgattcgtcagtaattccagatggagctgaaattagcagttatctctttagagatacacctaaaaggtatttctttgtggttgaagaagacaatactccattatcagtcacagtgacgccctgtgatgcgcctttggagtggaagctgagcctccaggagctgccagaggacaggagcggggaaggctcaggtgatctggaacctcttgagcagcagaagcagcagatcattaatgaggaaggcactgagttattctcctacaaaggcaatgatgttgagtatttgatatcgtctagttccccatccggtttgtatcagttggatcttctttcaacagagaaagacacacatttcaaagtatatgccaccacaactccagaatctgatcagccataccctgagttaccctatgacccaagagtagatgtgacctcactggggcgcaccacggtcactttggcctggaaaccaagccccactgcctctttgctgaaacaacccattcagtactgtgtggtcatcaacaaagagcacaatttcaaaagtctctgtgcagtggaagcaaaactgagtgcagatgatgcttttatgatggcaccgaaacctggtctggacttcagcccctttgactttgcccactttggatttccttctgataattcaggtaaagaacgcagtttccaggcaaagccttctccaaaactggggcgtcatgtctactccaggcccaaggttgatattcagaaaatctgcataggaaacaagaacatcttcaccgtctctgatctgaaacccgacacgcagtactactttgatgtatttgtggtcaacatcaacagcaacatgagcaccgcttatgtaggtacctttgccaggaccaaggaagaagccaaacagaagacagtcgagctaaaagatgggaagataacagatgtatttgttaaaaggaagggagcaaagtttctacggtttgctccagtctcttctcaccaaaaagtcaccttctttattcactcttgtctggatgctgtccaaatccaagtgagaagagatgggaaacttcttctgtctcagaatgtggaaggcattcagcagtttcagcttagaggaaaacctaaagctaaatacctcgttcgactgaaaggaaacaagaaaggagcatctatgttgaaaattctagctaccacaaggcctactaagcagtcatttccctctcttcctgaagacacaagaatcaaagcctttgacaagctccgtacctgttcctcggccaccgtggcttggctaggcactcaggaaaggaacaagttttgcatctacaaaaaagaagtggatgataactacaatgaagaccagaagaaaagagagcaaaaccaatgtctaggaccagatataaggaagaagtcagaaaagtcctctgtaaatatttccacagtcaaaaacttgcagaaagcagtgaccacagaaacaattaaaggtcttcagcctggcaaatcttacctgctggatgtttatgtcataggacatggggggcactctgtaaagtatcagagtaaggttgtgaaaactagaaagttctgttagttaccttcttatagagatatattatgtagaactccaggagggacattaaatcactttaagtataaactgactactcccacagttgagagaagttgtgacctgtacttgtactatggaaggaaggatatcaacgtgtgtatattgatgtttatataagtaactcttgaaggagacttgttctagcgtgccccatggtacctagtgtgtgtctgatgccggttggtgtcaaagatagagggcttcttgaaggaacttgccattccttgctttgaccactgcatgaactgcttctaaattattttattacctaaaaatttaaaatatgccattcattgcacacacccacaaatgcaaatcattcctctctatagatgctaggatatatataaattattttataaattcttgttttaaatgtcagtgtttctatgattgtaaactattaaattcttttcctattaaagtacagatctaatctaagtattattaagttgatagccctctagtcagttatattgctattgtaaattcttgtttgttgagtaaaatgtttaaatactatatgtatctcatgtacaaagttgacatacattatattcatgtacataaaattaaagagattaaaaaaaaaaaaaaaaaaaaaaaaaaaaaaaaaaaaaaaaaaaaa

SEQ ID NO: 2197 - DNA, 957 bp, Homo sapiens
ggtcgacccacgcgtccgcccacgcgtccggctggagataaaatttatgttgttaaaagagaaaatgcaatattctttaggatgtacagctttaaagctgcattaggagtaaaacacaggaggtacatgcagcatttagtgatcatttctgctcttttctgtagtcttctaggtactctaatcacaaaatgttaatgcgcatctttaggggtaaaataatgtgctctaaagaatatggtagtcactgataatttgtaattatttactagattttttgttactaaataattcaatggtatgactatagtatcagtaatcagcctgctgaagaatgaataatgcaatcaatttacattcttttgttgccattgatagaccagtaacagcttacctttcctatattctgtaggcatctaagaagaaaatataccaaaactttaagatatcaaaatatatttttcagaggtaaaacaatgaccctcgtaaatacatagtaagtgcgtgtcataaatttatttgcctgatgaatgagggaatcaacataatggtgatgctgattcccagaaaattccacagataaattatatataggcactgatagaatgctagaataagattgtaagatcagtaaattgggctgggtgcagtggcctgtacccctagcagtttgagaggctgagacaagaggatcacttgaacccaggagttgaagaccagcctgggcaacatgtcaaaactccatctctacaaaaaatacaaaaaatagctgggcatgatggtgcatgcctgtagtcccagctacttgggaggctgaggtggaaggatcgtttgagcccagaatgttgagactgcagtgggctgtgatcatgccactgcactgtagcctcagcctgggtgacagagtgagctcttgtctccagaaaagaaaaaagaaaaaaaaaaaaaaaaagggcggcc

SEQ ID NO: 2198 - DNA, 496 bp, Homo sapiens
  misc_feature (22)..(22): n equals a,t,g, or c
  misc_feature (472)..(472): n equals a,t,g, or c
  misc_feature (479)..(479): n equals a,t,g, or c
  misc_feature (493)..(493): n equals a,t,g, or c
ccgtgatgtggcgcctgcacantcctttccctttcggattcccgacgctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggawcttgtactaacttatgatagaatgtatcagaataaatgtttttaacagtgtwaaaaaaaaaaarnaggrggngagtgggtggggtngag

SEQ ID NO: 2199 - DNA, 557 bp, Homo sapiens
  misc_feature (16)..(16): n equals a,t,g, or c
gcaggtacccggtccnggaattcccgggtcgacccacgcgtccggtatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgcctgcagtaaagattctcagggtgtcagagcagcatattgtcaaatcctgcttctgttttatgtttcagtgtattcactttcattttcttacttactagaccatttctgcagtttgcccaaacctctactgtttgggacagtaagccaaatacctcatttttaaaaagaagttttcatggcatcagtgttaataaagtacatttttaactgagtcttaatctctatttgaagaaaaagtagagacaaaagtaatgtcaatgtaatccccaggatcatgaaatgtatacaaaataaataaagtaggagagttaaaaaaaaaaaaaaaaaaaagggcggcc

SEQ ID NO: 2200 - DNA, 971 bp, Homo sapiens
gcttctatccatttattcaagcacatattggtcacctactgtgtgcctggcactcatgtcacaaagataagttcctgattcggtacacttactgagcacctgctgtgtgcagggagctgagctatgggatgggaatgggagtaaacaaggtacttttyacttttttctttttttcctcactgctagacggtgtgggaacttctcactcattggcttctttcccacacacctgaagagcactgactgtgtgccgggcactagtgatacaaaagagtgtgacagttgttcagtctgcattttcgatcatgggctacatgccgagtgctggggcacagagatgaacaagatcggttccttcacttcttcatgccacaagtgtttattgagcacctgtgtgccaggcctcacagactcccagttgggttgaagaatggttgactgagtttgattcttcctgtaccctcggtcgtctgagctgtgtgcagacaacatccccccaccacccaagagggagggtagctcttccgccaccaggggcaagcacaggtcctggtggccccacgccacatgttagcccccctggagggggcgccagttggagacgggggctgggtgtccctggcccactcccggtcccctgtgctttacctccttgcccttgtgtctcaggtgtggtccctgcctgcttgatgaagttgctctgttcaagcctttggtgggatcatgtgtttgggggcttttaggggacccagctgcactggggcactgcccgtggcctgggtaggacatttcccagcaagggctggaggagttgccgtgccttcagcctgaatcgaatgtcagaaccagccagcggtgcttcaccctcttggggataacttgcttagttttttaataaatgttcctggttggttttcacagcaaaaaaaaaaaaaaaaaaaaaaaaaaaaaaaaaaaaaaaaaaaaaaaag

SEQ ID NO: 2201 - DNA, 751 bp, Homo sapiens
ccacgcgtccgcggacgcgtgggagtcatctgtcttaagttggaaaaaagtttcatatgattctttcccatttcccctgtattccttttcattataccctcattccttgaacagaattgttattgttttgtttttccatccacacccctataatgcaaccttcctgtgtaaattttaggcttaagcttttctattcacatacttttatgctgaggcttggatttttatttgggctgttagatgcccattttgacattgacattaggggtttcaaaccatccttaaaaggttagatgtgacttgcaatgttattgaacaatttgatgatccgggatattatggctctatgaaatctccatggttcttggagctagcttgtttttattctgggaagaattttctagctccccagcttacggcctgaatggttagagtccagccagtgctgtttgactttatagttcaaagggggtcatttctgtggtcactatcctatttaacagtcatgtcatggtatgtcaaggtaggtcatcatacaaataatctgcattctgttttgactgttttatttttaaaaataatatctcctccttttaaactttaaaaaatttagtaaagtttagtaaactttcaaaaatttagtaaaaaatgtagtaaaaattcacttccttcattatgctttttgaaatctggctttttttctcattcttcccctattaatggttcttaaaaaaaaaaaaaaagggcggcc

SEQ ID NO: 2202 - DNA, 530 bp, Homo sapiens
ccacgcgtccgaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaaaaaaaaaaaaaaaaaaaaaaaaaaaaaaaaaaaaaaaaaaaaaaaaaaaaaaaaa

SEQ ID NO: 2203 - DNA, 747 bp, Homo sapiens
  misc_feature (605)..(605): n equals a,t,g, or c
  misc_feature (642)..(642): n equals a,t,g, or c
  misc_feature (645)..(645): n equals a,t,g, or c
tcgacccacgcgtccgcccaaaggaatcctgagtatgtatgcactttaaaagaacccagaatcatctaaatattgtcacatggctcttgcaagtgatgataatagtgatgcttataataatgaggattagctgcactcatcagcctgtagaaagtaaaaagtttccttttcgaaatttcctttcttgttaagaataaatcataagtgttagaaataatagtttcttttaaagactaacttccttcaagccttctctgctctgtgctaataactcttcgttaagccctatcctatgtagctgttagatataagggaataagtatattctatgtcctgtactttagccaagatatttgtgctggacatgctcacaggcacgttccagctggcagcctatgccccttccttatttggaaatattattacttttctaagtctttttgcaagcaacttcttcttttcctttgttctctgttgcctttccctatataggaaagttttaagttattagccagtcgggtttaatttaaattgtgaggtccagctccagccaatggagacaggacacaagctgcataagggataaaaactgcttccctcctttnttcgggtgtgctgtcaccattgtttcatctgtgaggngcnccctttctgccagaaagtaaaattgccttgctgaaaaaaaaaaaaaaaaaaaaaaaaaaaaaaaaaaaaaaaaaaaaaaaaaaaaaaaaaaaaaaaaaaaaa

SEQ ID NO: 2204 - DNA, 693 bp, Homo sapiens
ggtcgacccacgcgtccgcaaaaaggaatgctttccctaatgtcccatcttcatgtccagcaacatttgtcttccatcctattgatcctaatagtctttgccttcctaagcaatccattcctaaaccaataactggcaagaaaaataagattaccatgattggctctaggggttggcaaactttttcttaaagggcaagacagtaaatattttatgctttgcagtctatctggtctctgttgcaactattcaactctgctgtaatagcaacaatagacaataaataaataaataaataaatggatgtggctgtatttttgtaaaacttaatttacagaagcaggtggtaagcccatgggccatagtttgctaacccctggaaccttagaccagtaactctgaaacattagcatttgttagaatcmactggggacttgttaaaatacmagatcccatcctggktgctggttcagcatatttgggatagagccagtgaatttgcatttctaataatttcccaggtaatgctgaggctgtgaattcaagaacctcacttaaatatatttctctattgtggggctatcctgtgcattgtaggatgtttcacagcatccctggcctctacccactagatgccagtagccaccctgcctctcctctagtatgacgagaaaaaaaaaaaaaaaggcggcc

SEQ ID NO: 2205 - DNA, 1799 bp, Homo sapiens
acccacgcgtccgtaaaatctttcgctcattttataatcaagtagtttatttttgttgttgtatatattccaggtactagatccctatcagatttgttaatattttcttccattctgcaggttgtcttttcattttcctgataatgtcatttgatgcagaaaagtttttaattttgaagttcattttacagttttttcttttgttgtatgtgctttttttggtgttatatctgagaatctgttgtcatacccaaggtcatgaagatttacctgtatgttatcttctaagagttttatgatttcagctcttatgtaggttgtttgtcgattttaagtttatttttgtataaggtacgaggaggaaggggtccagcctcatttttctgcatgtggatacccagttgtcttagcaccatttgttgaatagtctgttctttccgcattgagtggtcttcatgtgcagactgttattgctgtgcatgtgtatatctgtttatctggaattcacttttaagaactgtatatgggccaggtgcagtgactcacatctgcaatcccagcgctttgggaggctgaggtgggaagatcacttggggtcaggagtttgagatgagcctgtacaacatagcaagaccttgtctcttcaaaaaaaattttaaaaactagctgagtgtggtagtacctgcctgtagtcctacctactcaggaggctgaggcagagggattgcatgggcctggaagtttagggcaacagtgagctatgatcacaccgccattccagcctgggcaacagagcaagaccttgtctcattaacccagttgtgcctagtgttccattattggaacactaagcttgtgggagttatttatatcctgctccaggtcattgccaaggtctgatttttcacaaaaaaagtttgcaaccttcggcataaatgggttaaaaaaaggaaaagctgtatatgaaggtctttggccacagtttggtttttgatggtagatagggttttgtcacttgaatgcaaaattagctttataactataactttgaaactaaatggctaaattattactgattttatttttatttttatgggtcgccttacaagatgtatttagtttgcctcttggttttgagtactgtggaaatgagcttactggttgctgtttctgaaaatgtgtactttaacttattctcaaggtaattattgatgtgtttttaaactgaaaaacactgaagaaattttatagataagttttctccatattttgtttcacataaattgtgtccattttgaagatgtagttcctcttttcctcttccaaatgattaaactggtaaaatttttgtattagaggaattaaggtgagaggtgctgagcaaaatatgaatcttccaaggtttattcttgtaccttgttagggatatgcgtgggtgtttgtgtgattgtgagagaaacagaatgtgtgtatgtgtcactgattttttaaaagtatagatgttgctttattatttgccttaaatatatagcaaaatcaacctgtagacaatgcacctgaagagaaaatgtaactgtgtgaagatttaataaagtggattggtggaaagaccattttattatttggaatgttattatttggaatgttaacagaaaaacttcagctgaattaaatttaaaggagtttaattgagcagtgaacaattcgcgagtcgggcagccccaagaatcacgggagattcagagactgcagtgcagctatgtggtggaagaagatttatagacaaaaaaaaaaaaaaa

SEQ ID NO: 2206 - DNA, 868 bp, Homo sapiens
cacgcgtccgcggacgcgtgggcggacgcgtgggcaaaaatcttaaaagcactttatcatttcatttccctgcactgtaatttttttaaatgatcaaaaacggtatcataccaaggcttacttatattggaatactattttagaaagttgtgggctgggttgtatttataaatcttgttggtcagatgtctgcaatgagtaaatttagcaccattatcaggaagctttctcaccaatgacaacttcattggaagattttaatgaaagtgtagcatactctaggaaaaaaatatgaatattttagcatctatgtattgaaaattatgttgaataaatgtcagactattttttacataacgttgcttctgtttaattttgtcacgttcagaggtggggggtaggagatgtaagcccttgacagcaaaataattccttttgcttgatttcagacagttgcatcagctcctttgttctgtgttcatgttacacttatttaggtggctgaatccacagaggagcctgctggttctaatcggggacagtatcctgaggattcctcaagtgatggtttaaggcaaagggaagttcttcggaacctttcttcccctggatgggaaaacatctcaaggtgagtgttataataaagatcttggcttatgcaacatgaatgttcctcgtttgcatcaatttaagaataaggtatgtttacacgtatataatcagaacttttaaacatacagaattttgctttataaatagcttcgctttaaagatctcttatatatttaacttttcttaatacacagccttttagtacacacaaatttaaaaagtaggtaatgcatatattgaaaaaaaaaaaaaaaaa

SEQ ID NO: 2207 - DNA, 674 bp, Homo sapiens
ggtcgacccacgcgtccgataatgtgtagctactgtatgccttatttaattatttttttgagtgtcattcacaatcacaaaacgatacccttactgaaagtgttagtggataaacttaattgcataattacggacctgtgtatttccagagatgatgttttccccactacatgttaagatgtacgtatttaatgacaatgctgtttgttgtatgagaacttgagacagaagatttagtaggattatccagtgacagtcagtacagggtgcgattaagctgtccttctggctcttggcctggtatatgtttgtctctggccatgcagttacagaatagggcaggtggcatgtttatatatgcctttgatttcacagaagttggtgagctttcctaagtggagaattttagagctagataggattgttgtgggagagggggcagggaatggagagttgattcttcactcttctgtggtgcagttgaatttacatgtagctggaactgattttccaagggattatgatggcaatgagcttagaagattggttgggttttagcacttcagaattggatcccttgccggaacccttgctaagagggagtggacttgtatttggtacagagaccaaaaaaaaaaaaaaaaaaagggsggccccccccaagggggccccaa

SEQ ID NO: 2208 - DNA, 2015 bp, Homo sapiens
  misc_feature (3)..(3): n equals a,t,g, or c
  misc_feature (9)..(9): n equals a,t,g, or c
  misc_feature (1981)..(1981): n equals a,t,g, or c
  misc_feature (1990)..(1990): n equals a,t,g, or c
  misc_feature (2001)..(2002): n equals a,t,g, or c
ccnggaatnccgggtcgacccacgcgtccggcctgcgctgccagcagccaggagccaggagccaagagcagagcgccagcatgaacttgggggtcagcatgctgaggatcctcttcctcctggatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacrcctgggggcctcagtgacaccatcccgctaaagaagagagccccaaggcgaaaccacaatttctccaaaagagatgcacaggtgattgagctgtaggtgagcagtgacgtgaagaggggttctagccccgtggaaaacagcccatggttaacatctcaggatgtcctgcattcaaacacccaaggctggtaatgaactttcacatggactgaatattggaggcaaataatagaaggaatagaatatacagtgcctctgtcctgaaggaaaatatcatgcctcttctggaagaaacggactgcacagaggaaggattgagcaatttagcctgcagtggaagaaggtggacaccaaaagcttcaccctgtgttggagctgttcatgcttccatgaggccatggtgtccatgtccgtggaacctaccacagaaaatggctcatgaaaaggggaatccgacccaacacacagcttcctacacactgccatcttatcaacagttaggcactactttgtagaacgattagcttcaccctcttagctgccaggagatcccttcttaaagatggactatgtgaagattcgggagtcctgaaacatggggactccgggatggtctctagccctatcgatgatgaacactggccttctggaggggaaatggcagtctgggctggcgtggtaggaagggctttggtgttcatggaatgggcctgctgctctcagaccttcaaaggatggaaccaacgaaggaccaaatgagaaagcagatgcttgccttgcagagggccatgaatgtcagttattatttttctccttatacaattattttgtggttattattacaatgtacatggctgttgcatagaagacatgactggtggaggctgaggaaagccatgacattctacaattgccatcaggctaaggccccgtgagcatttctctcccttgtaatattaaccctgtatttctgggatcacatcacggaatattctttgcctttccactttccaggaaatctctcggactgggctaccctccttgtgtgtgatgaaagatgagctatatttcagaacaaagtgctgtgttgtcatratttgcctggactcccagggcgtctcttacccaacttgataacgatgctgttcattagcagcctttgttaactgataaccaagagcggtaatgtgatactcataagcaattttctgtgtgtaggataaaataaaccatcttgtatgggaaaaaaaaaaaaaaaaaaaaaaaaaaaaaagggcggccgctctagaggatccaagcttacgtacgcgtgcatgcgacgtcatagctcttctatagtgkcacctaaattcaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccgggtttccccgtcaagctttaaatcgggggcttccnttaagggtnccaattaaggnnttaccgggacctt

SEQ ID NO: 2209 - DNA, 945 bp, Homo sapiens
  misc_feature (908)..(908): n equals a,t,g, or c
gaacaaagatgaattgagcattaaaggatggtagcttcttgaactacctctgtgtcagcaaaggggatatgggagttagagtttgggaactaccagcccaacctactgggctccacctgttatgtttctgcacaaggacaatgcttttagcactgaagctcccaaagacaaagcattcctttcctgacccatatacctctatcctttcattcattcatccagcatttactgagaacttaactctgtgccaagtctcagtatttctaagcagtagcaatactgagatgaaccaaatgttccatggagtttcattcaggtaaggttagtgaaaatgtgcaaatatttgtagtaggatgagaagaaatggagttgaggatctcagaagacagagtgaataaacccaagtgggaaactgtcatggaagacatgctgttttaactgggtctcgaagtatgaaaatgaataggccttgaatgcagyggttgtagaaggggtaccttctaatggtagagatggtataggaaaagagctgttgaaattatcaaagagataacaaatgggcgagagaaagaagcgktttccagttcaggaagatgagacgttatggagataggaatgaaayttatatatttatgaaaggcatgggggccgggcacartggctcatgcctgtaatcccagcactttgggaggccaaggagggaggattacctgaggtcaggagttcaagaccagcctggctaaggtggtgaaactttgtctctactaaaaatacaaaaattagccgggtgtggtgacatgcgcctgtaattccagctactcaggaggctgaggcaggagaatcacttgaacccaggaagtggaggttgcagtgagctgagattgtgccactacactccagcctgggcnacaagagcgaaactctgtctcaaaaaaaaggaaaaaa

SEQ ID NO: 2210 - DNA, 1383 bp, Homo sapiens
  misc_feature (556)..(556): n equals a,t,g, or c
  misc_feature (562)..(562): n equals a,t,g, or c
ggtgcaaagaacatagaatattttgaaaaacataagactgaaaatacattctgagctcacctttgcttgatagtttggctgaacataaaaatctagtttggaaatcttttttgcctagaaattttatgacattttccccattgtcttctaccttctggtggtcttccagatttcactgtgaaatgctgtggtttgtatctttacttgtcacttttactgcacactcagttgaatactctcaatattaaagctcatgccctccagtttgggcatattttgatgaatattttgtgaaaattccttgccttttccaacttctagaagctgcctctacactttgattctttgggctctttctttttttctccaccttcaaagccagcagcatagcacttccaaatttctctctgcttctgccctagtactaatattaagtgaggtctccttgtttcaaagaaaatggatgtcaataaagcactgatgcatcagcaaatagttttaaactccctggakgwatatctagtcttccagaatacctctcttctctactagagtntagatntattcatttactcatcaytcmatcatttaamaaacattttctaagaaactgctttgcctttgggactgccctaggywctggaatataatagtgagcatgacattgtttgaacttttaaagcagcttacagttaaataggtgaaacaaaccaatatacaaggacttgccatatataacaaatacttttgtagagctaagtatagaatgtaaaagaaaggaaatagctcagtcttggagggggaaaggagatttctcagtgacctgggacacttgaagaataagtaggagtcatccaaacaaagaacaggcaaagctattgatatagcatgtacaaagacccagaagtgaaagaaggtatagtattttcagagaaattactcatgtaatctgagacttagacaagtagagacagagatgaatctggagaggcaaagtaatgaaggaccttatgaattgggtgaccatagaatatactatccaaacctatacacttttgaaaatgaaagagatacccgggtgcagtggctcatgcctgtaatcccagcactttgggaggccaagcaagacaggccgatcatctgaggtcaggagtttgagaccagcctgaccaacatggtgaaaccccatcactactaacattacaaaattagccaggcatggtagctcacacctgtattcccagctactcaggaggctgaggtagtagaatcgcttgaacccgggaagtggaagttgtcagtgagccaagattgtgccattgcactctagcctgggtggcagagcgaaactctgtctcaaaaaaaaaaaaaaaaagggcggcc

SEQ ID NO: 2211 - DNA, 764 bp, Homo sapiens
ggagctgcaggatcttcacagttcccccagccccttcctgatgttcacacatgtcacatgttctgcccatctcagatggatctggagcctttctggttctgtttaatggcagccctatttatcttttattgcctccttctctattttttgcacatattcaaagatggggtgagtaggttaccctccactgaatacaaatacaaaagcttgagtgtactggtgttctgcaagaagcatgactgttctttctgaactgagcttacttccctgaacaccacgcagggggcatctgcacctgaaactgcagggcattcttgggatcccacgtttggattgacagtgccaacctgggaggccagtcccttttccatcatcaccttttccttcttgtcagatatgtcataaccccaaacaggcccccatgatttgataaattgctaataatgttcatgccaggtatttggtgacttaaaagtgttcacgggctgggcgcagtgtctcatgcctataatcccagcactttgagaggctgagacgggtggatcatctgaggccaggagtatgagaccagcctggccaacaaggcaaaaccccatctctactaaaaatacaaaaattagccgggcatggtggcgggcgcctgtaattcagctactcgggaggcagaggcggaggttgcagtgagccgagatagcgycgctgcactccagcctgggcaacagagagactctgcctaaaaaaaaaaaaaaaaaaaaagggcggcc

SEQ ID NO: 2212 - DNA, 3460 bp, Homo sapiens
acgcgtccgatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcatgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattcttggtggcctctgcacccaaattgcatctggaaagaactagggtctcattcagaatgtccaaaaggaaattcttaagagcttaaattcagatttgtgtctcattaatgcagtgaacaattcaaaaccacacagattccttggcaggaaggataatggaataacagtgttgatgagacctttttagcttcaaggtttcggagtctaaacaaatggatgattcatttggaatgaaactcacaatgcaagtagaaggacctctccaaatcaggccagttgggttatcctggcttggaatctggtgtgaaaccataggtcttaacactctggagcagcacattgctgtggatatgtccaggagaccttagatatggcttaaaggctttcaagatgaggacagaaattgcttacaattgctcagtttctcaacagaaagactcataagagtgccagcatggggtacatggagtgaagctgggtgggaagcatcatctgcacagtccctgtcctagtgcaggacttttctctgtatgttttcataccatgggatttttggatatcagtgtattttggttcttgaaatagcctaatagctgctcacacattgggtaggaatattataccaatgtcatccccaaaggaagggtgagctgaatggaaattaagcccagtcattttatttgatctattagctctgttatcagtgcatgatcacccagatcaccctcctcagcccacacagtgctgaaccatcttccctcctgttctccatggctattaatagtatagctaaatttagagtgcagagccagatataagtattttggaattatctcccagtttgtggtagaagctgactggaatacaggttgagtatctcttatccaaaatgctagggaccagaaaggtttcagattttttcagattttggaatacttaacagttgagcaccccaaatctgaaaggcttctgaacgtcatgtcagcactcaaaaaagtggattttggagcacttcaaatttcggatttttggatttgggatgctcatcctgtgtaggagaggctactcgattccatttaatgactgtcctagtcataatcatccaaagataaaagccaggtagatgttgaaagctctttccagggctgaaaaagtgttcttacgttctctgcatgtgactagcatcactgtggaaattaatgctctgttcttcactagaatgtagtaagtggttaaactgagctatcccccacctgatgactattggcatccatttgcaaggccaatggcctggattaagggttaggattatttgtagctagaaggtaattttatttctgtgaaactaattggctcatatttgaggttaggtgtggccttgaccttaccagtacatttatacccactaccagttgactagcccagataattgttaaatggtgcttcttttctgcttctcagtagacttccatgccattacaaaggaaatttgaattacctagtgtttgtatattccatgataactatgtataacttctgttacacagcttatgtattgttaacatttaagtgtaaaccatgccacagctaacacttaaaaatgaaaactaattagttcttgcttagggaaaatgccaggtatgaagtatggcatatacttgacactgtcctgtgtaaccctttactttgctcaggctttcaagattgagtcttttttcccccaaattaggttaacatgcatttgaccccaacctgtggggtttgagtaagctggaaatctgtgacggtaggctttctagtgtcacgaggtggtggtgactgaaggaaaagctgggatcacaggttccttctgatggagaggaaggtttatttctatgcccctcccaccaccctccacctagagctcacccaagcctgctccagtcccaggggcaggccattctgcaaaagcaggacctcacagaaacaagggctgggttgaggtcacccccttcagagttggttcctggccagatgggtaagaggcatttgtaattttaaaaatgtgaaacttgggtttggtgttttcttctaagtgcctaaataagcaagccaggctgttgatattttagccagagaaatcggcaagccaagattaacccgaatctgaagtttagaatcttgagtttgcatctgcatcatatcatgctgttttgatgaggaaacatttgccactgaggagttggagggagggcaagacgacagtgttaagtcagatcatttaatggtttcccctaagccctggaaaaatatttgaaagaatggcagcaaaaaggttaagaaagcaagccagatttactgcacaatatgcagtacccagtactactttaaatcccaagagaacagtgtgatgtctaatatatacaggtctatgaaaatactgtggaataagcccaggaaggttagatgtgtttgcaaataagttgcccaaagggtccccctctaagtaaaacaaatattcagaccacaggctttaatgtaaactgtcaaaaagtgggatgtggaggatttttgttaagtgtcaatcgaagttaaaaagcaagggtttttggccaggcgtggtgctcacgcctgtaatcccagcactttgggaggccgaggccggcaaatcacctaaggtcaggagttcgagaccagcctggccaacatggtgaaaccccgtctctactaaaaatacaaaaaaattagcccggtgtggtggcaagtgcctgtagtcccagctacttgggaggctgaggcaggagaactgcttgaacccgggaggtagaggttgcagtgagccacgatcatgccactgcactccagcctgggcaacagagcaagactccatctcaaaaaaaaaaaaaaaaagggcggccgctct

SEQ ID NO: 2213 - DNA, 1006 bp, Homo sapiens
ccacgcgtccggcaataatgacccattgtggtttttaacttatctcatgaaaagacttaggtttgttctcagggtatttcagatgactgcctttataactggggcacatacgattactaactatagtgataggcgtttatacatttcccctttgagccatttctttatgaacagtggttcttctgctcaaagtgttctgtctcattcttatgtttctcaaatcttctttaaaaatgtaagcaaatatttttaaagaatttttatgttttccaaaattaggattttagactttagggattttgatctttggggatttcaacattcgggattatggtgttcagtgtgtattttggggggattatgatcagcatcccatacagtggaatatcatttggcaataaaaaggaattaaatattgattcatgctacaacatggtgaacctaaaaaacattatgttcagtgaaagaagccaaacctaaaaggcctacgtactgtgtggttaaatggtaaaaatggtgaatttatcacaatcaaaaccaataaacctctacaggaaaaaataaggacaaagaaaggctgttccctattaatggagactaaagagacatgacaactaaatgcagtttatgattgtggattacatccttgatcagggtgaaaatagctataaaggaaattattgggacaatttgctaaaatttgaaaatggactggatttggctggtcgcagtggcttacatctgtaatcccagaactttgggaggccaaggtgggtggattacctgaggccaggagttcaagaccagcctggccaacatggcaaaacccgtctctactaaaaatacaaaaattagatgggcgtggtggtgtgcatctgtaatctcagctactcgggaggctgaggcttgaacccgggaggcagaggttgcagtgagctgagatcacgctactgcattccagcctgggtgacagagcgagactccatctcaaaaaaaaaaaaaaaaa

SEQ ID NO: 2214 - DNA, 616 bp, Homo sapiens
tcgacccacgcgtccggtcaaaatagtggaaaattagtagaaataacatattttatatccaatttagtctccaaaatcccaacatgcactcttctgtatacgtttttcagtatgcttgactggaacggccaattctacagtagtcttggaagcaacatactgcagattaaataccttagtagcctatgttcttgaatgcggacataaaggagcaatgcttttcctatcttaaaaaaacagtttatatgaatgaaacttctgttctgtttaagatattatatgttgttgagtgtagttgtcaaagcaactagcacgattccaagtaatatagaaatcaccagcttgagttgggtctgccataacagcacctaaaacgtatccactaaattagtattaaatggacaagtaaaccaaactcagagggttgaaatgaagacttgtaatacccagtgaaaaaaaattattgaaactaccatctaaaattaattggaagcttaatattacctctaggaaagagtgtgggaaatgaggaaagggcaaaaggtaatgtgttccagtttgttctgttccataatcccaggaaatagataaacaccaggcaaaaaaaaaaaaaaaa

SEQ ID NO: 2215 - DNA, 938 bp, Homo sapiens
  misc_feature (923)..(923): n equals a,t,g, or c
  misc_feature (927)..(927): n equals a,t,g, or c
ccacgcgtccgaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgtctgatcctgaaagaggacaaactacattgcctttcagacctgtgactcaagaagaagatgatgaccaaaggtgatttgtaacttaacatgccttgtcctgatgttgaaggatttgtgaagggaaaaaaaattctggactctttgatataataaaatgagactggaggcattctgaaatgaaagaaactcctttatatatccaaccacaatcaaacatataaataagcctggaaaaccaactacaaccagcaatttaagattactattactttaagaaaatcaatttcatagtattggttttaaatctttttaagtttttttaatacgatctatttttataggttctttttcagaagtaaaattttgtacatatatacatgtacatatctgtttagtttgggttcatttctataacattttgtaagaaaataaaagtttgagcacctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggcggccgctctagaggatccangctnacgtacgcgtg

SEQ ID NO: 2216 - DNA, 1683 bp, Homo sapiens
tgctctttctggttccgctgctgtgggccccggctgcggtccgggccggcccagatgaagaccttagccaccggaacaaagaaccgccggcgccggccagcagctgcagccgcagcctgtgstgtgcagggccccgagccggcccgggtcgagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccaaaaaaaaaaaaaaacaaaaaaaaaaaaaaaaaaagggcggcc

SEQ ID NO: 2217 - DNA, 1190 bp, Homo sapiens
gccggagacgccggaaccaggatcgaccccagctgwccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacaygattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggyggcggcggcccaggaacctctgcagctaaagaacgggrcagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccrcccttcttccctctgggcaactggacagatctggsagccagcagctggatgctgtggctggccagagacacctccaggctgtrgcctgggggctggggggagccccaggctgaaaagggtccaattaaaacaaatggagccaaaaaaaaaaaaaaaaaaaaaaaaaaaaaaaaaaaaaaaaaactcgag

SEQ ID NO: 2218 - DNA, 953 bp, Homo sapiens
aattcggcacgagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaaagctgacctcagttttcttacaagaacccagttagctgatgttttattgtaattgtcttaatttgctaagaacaaggtaataagtaaatttttaaaaagcctttctgctgggttggattaaaaaaaaaaaaaaaaaaa

SEQ ID NO: 2219 - DNA, 1364 bp, Homo sapiens
cggcacgaggcgaagaagaatctgaggaaacctgctgctttcacagaggaaggcatttgctggctttcccaaggcaagaacaatgaaaacaaagtcatgaggagttctctctacctcaaatgaaggccgcagctcctgctcaagctattttggcagtctgagagaacagtacattctgaaccacattgacgcagggagcatgggtatctggacctcaggcactgatatcttcctaagtctttgggagatttacgtgtctccaagaagccccggatggatggactttatccagcatttgggagtttgctgtttggttgctcttatttcagtgggcctcctgtctgtggccgcctgctggtttctgccatcaatcatagcggccgctgcctcctggattatcacgtgtgttctgctgtgttgctccaagcatgcacgatgttttattcttcttgtctttctctcttgtggcctgcgtgaaggcaggaatgctttgattgcagctggcacagggatcgtcatcttgggacacgtagaaaatatttttcacaactttaaaggtctcctagatggtatgacttgcaacctaagggcaaagagcttttccatacattttccacttttgaaaaaatatattgaggcaattcagtggatttatggccttgccactccactaagtgtatttgatgaccttgtttcttggaaccagaccctggcagtctctcttttcagtcccagccatgtcctggaggcacagctaaatgacagcaaaggggaagtcctgagcgtcttgtaccagatggcaacaaccacagaggtgttgtcctccctgggtcagaagctacttgcctttgcagggctttcgctcgtcctgcttggcactggcctcttcatgaagcgatttttgggcccttgtggttggaagtatgaaaacatctacatcaccagacaatttgttcagtttgatgaaagggagagacatcaacagaggccctgtgtgctcccgctgaataaggaggaaaggaggaagtatgtcatcatcccgactttctggccgactcctaaagaaaggaaaaacctggggctgtttttcctccccatacttatccatctctgcatctgggtgctgwttgcagctgtagattatctgctgtatcggctcattttctcagtgagcaagcagtttcaaagcttgccagggtttgaggttcacttgaaactgcacggagagaaacaaggaactcaagatattatccatgattcttcctttaatatatctgtgtttgaacccaactgtatcccaaaaccctggcaagctttgaaactgcttgctcactgagaaaatgagccgatacagcagataatct

SEQ ID NO: 2220 - DNA, 620 bp, Homo sapiens
ggcacgagcaccaaactgccatattgccgtgagaatgtgtgtctggcttatggtagtgaatggtcagtttatgcagtgggctcccaagctcatgtctccttcttggatccacggcagccatcatacaacgtcaagtctgtctgttccagggagcgaggcagtggaatccggtcagtgagtttctacgagcacatcatcactgtgggaacagggcagggctccctgctgttctatgacatccgagctcagagatttctggaagagaggctctcagcttgttatgggtccaagcccagactagcaggggagaatctgaaactaaccactggcaaaggctggctgaatcatgatgaaacctggaggaattacttttcagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttcactaacttccaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2221 - DNA, 1466 bp, Homo sapiens
acctgcaggtaccggtccggaattcccgggtcgacccacgcgtccgagccgtccgcgctccgaacggcgcctcccgccccaccatgggcaacagcgcgagccgcaacgacttcgagtgggtctacaccgaccagccgcacacgcagcggcgcgcgcggccccctgccaagtacccggccatcaaggccctgatgcggccagacccgcgcctcaagtgggcggtgctggtgctggtgctggtgcagatgctggcctgctggctggtgcgcgggctggcctggcgctggctgctgttctgggcctacgcctttggtggctgcgtgaaccactcgctgacgctggccatccacgacatctcgcacaacgcggccttcggcacgggccgtgcggcacgcaaccgctggctggccgtgttcgccaacctgcccgtgggtgtgccctacgccgcctccttcaagaagtaccacgtggaccaccaccgctacctgggcggcgacgggctggacgtggacgtgcccacgcgtctggagggctggttcttctgcacgcccgcccgcaagctgctctggctggtgctgcagcccttcttctactcactacggccgctctgcgtccaccccaaggccgtgacccgcatggaggtgctcaacacgctggtgcagctggcggccgacctggccatctttgccctttgggggctcaagcccgtggtctacctgctggccagctccttcctgggcctgggcctgcaccccatctcgggccacttcgtggccgagcactacatgttcctcaagggccacgagacctactcctactatgggcctctcaactggatcaccttcaatgtgggctaccacgtggagcaccacgacttccccagcatcccgggctacaacctgccgctggtgcggaagatcgcgcccgagtactacgaccacctgccgcagcaccactcctgggtgaaggtgctctgggattttgtgtttgaggactccctggggccctatgccagggtgaagcgggtgtacaggctggcaaaagatggtctgtgagcccgggctgcctcctggtggtggccattgtcccccatcggcccctcagccttgcaccccagcactgagaagctacatttccttcctgtgctctggactgctgcccttgtccccgaggagtgtcccgcgcagccacacctggcaacagcagtgtgggctgcagggctccgtctgcacgtggacttgccctggaccttgagtgtggccctccctttctgggcctccccaggtgaggcctggccctgccccaccatgacctgggtgctctgagcccacggttcccacggagctgacttctccggggtgcctgtgccctacattaaacccggcgtttgtttcacaaaaaaaaaaaaaaaaaaaaaaaaaaaaaaaaaaaaaaaaaaaaaaaaaaaaaaaaaaaaaaaaaaaaaa

SEQ ID NO: 2222 - DNA, 1881 bp, Homo sapiens
ggcacgaggctaccggggacttctggagtccgagaagtcaacggcgcggttgctgcggccgccgcgctccccggcccgaggcgatggagaacggagcggtgtacagccccactacggaggaggacccgggccccgccagaggcccccggagcggcctcgctgcctactttttcatgggccggctcccattgctccggcgcgttctcaagggcttgcagctgttgctgtctctgctggccttcatctgtgaagaagttgtatcacaatgtactttatgtggaggactttatttttttgagtttgtaagctgcagtgcctttcttctgagtctccttatactgattgtgtattgcactccattttatgagagagttgataccacaaaagtaaaatcatcggatttttatattactttgggaacaggatgtgtgtttttgttggcatccatcatttttgtttccacacatgacaggacttcagctgagattgctgcaattgtgtttggatttatagcaagttttatgttcctacttgactttatcactatgctgtatgaaaaacgacaggagtcccagctgagaaaacctgaaaataccactagggctgaagccctcactgagccacttatgcctaaagactctggggagcagatgttacctaaggtagtgaccctgcattgtggtgcctgagccctggcagaagctcttgtaaaatttgttaattgtttaaaccacttcttttggagagcaaggggaaggtcaagaaggcagttttatcaatattgtgtcagtcaccacaaagtaggccagataagttaaaaaaaattttttttaaataataattgaaacttatctcaaatggagattttggtgggaggaggagaaaacaattgtttttaaatcacacagctcaacggttgataaatgattctgtcattctgttacaggtcattcttttactaggcttagcttccaaattatgctttatagctgtataaacatcgtgattatattcatctacttagaaattgttttatttttaaattaatttgcttagctgtttgttttgatgcttagattatgttctgttaatgggaatttaacatatttaagaaaccaatatttaaaatgttggtctaggtttttttccttaacatatattaccaggctttactgtatttcactcagccttaaatgttataatatttttggataacggttattaattctttgagaccttcgtatagcctataaaatgtatgggagatgttggtattttatgtgtataaaagcaacaatatcagcaacttcgtgtttatactgcaccttggttgttgatgtcaagtaaaaaaaagattgttttgtaacacataaaaaaatggaagaaactgataccacacctaaggaccaaagataagaaagactttttgcccaagacagtgaaagtaattataaaaacaagctttgaccacttaccaagtatctgaagagatgagttcatactatgatttagaaagtggttcaattcccctgttggcatatgattatttttactaaaattaatacagctctgtgggtcttccttagtgttttctttgaagccaatctgttttttttaggacaccagcctttggtttttcatctgttcgagatgcctcttctctgtctccttatcagatagaaatggagtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaaaaaaa

SEQ ID NO: 2223 - DNA, 1735 bp, Homo sapiens
  misc_feature (1002)..(1002): n equals a,t,g, or c
tcgacccacgcgtccggcgcggatcagcttccagcccagtcggcccggcccgggggcmatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagaggtgcccggctcccaccccttcccagccccagccctggagacagcagcccctagactactgagggacagcgacagcatgaaggctccgggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaagccgctggtccgcgagccctgccgcagctgtgccgtggtgtccagctccggccaaatgctgggctcaggcctgggtgctgagatcgacagtgccgagtgcgtgttccgcatgaaccaggcgcccaccgtgggctttgaggcggatgtgggccagcgcagcaccctgcgtgtcgtctcacacacaagcgtgccgctgctgctgcgcaactattcacactacttccagaaggcccgagacacgctctacatggtgtggggccagggcaggcacatggaccgggtgctcggcggccgcacctaccgcacgctgctgcagctcaccaggatgtaccccggcctgcaggtgtacaccttcacggagcgcatgatggcctactgcgaccagatcttccaggacgagacgggcaagaaccggaggcagtcgggctccttcctcagcaccggctggttcaccatgatcctcgcgctggagctgtgtgaggagatcgtggtctatgggatggtcagcgacanctactgcagggagaagagccacccctcagtgccttaccactactttgagaagggccggctagatgagtgtcagatgtacctggcacacgagcaggcgccccgaagcgcccaccgcttcatcactgagaaggcggtcttctcccgctgggccaagaagaggcccatcgtgttcgcccatccgtcctggaggactgagtagcttccgtcgtcctgccagccgccatgccgttgcgaggcctccgggatgtcccatcccaagccatcacactccacaaaaacatttaatttatggatcctgcctcctgccacgtgctgggtggacctaaggttccttcccacccccattstggcgacayttggagccatctcaggcctccactccctgagtaattcatggcatttgggggctcaccccacctcccaggtctgtcaagtggcctttgtccctgggctgatggcccccaactcaccagcatcatgaccttgtgccagtcctggtcctccctccccagccgcccctaccaccttttggtgccacacttctcaggctggccgccctggttggggcagccgagagcctggggttcattggtgaaggggccttggagttgtgactgccggggccgtatcaggaacgtacgggtaaacgtgtgttttctggaaaaaaaaaaaaaaaaaaaaaaaaaaaaaaaaaaaaaaaaaaaaaaaaaaaaaaaaaaaaaaaaaactcgag

SEQ ID NO: 2224 - DNA, 1358 bp, Homo sapiens
ggcagagggaacaaacaaacaaaaaaggcaaaattggagctgtccaggccaggacaccccgatgtccaggggcttccatacgaacaggcacatgggctgggaagtacatgaggcccctgggtagaagggtctgtcagttctctcctcccttgccctctggragggtcctcctaacatagcttccaggaggtgggaggagcagttactgtcagcaggtgtcagccaggtgtcagcttctcctggggatctctagatgtctgcttgtgatttttggcaagtatatgcaaatgagcctcctctcctgccctgagacaagtatctgcagtgtgaacctggcagcctcagacccaaggggctcagaggaaacttctctggtttctagagctctgtgctccttcagagaagtcttccttccttccagtcagtgtccctgtgaagctgggatactcatttcctgtgtaccgggcaaacaccggattgctgattttgagaaatgcctctcgatggacctgtaacctgctggagtctgggatggtagctgtgggctggacttggctgatgggatgacccggtggctagtgcagcatcacacaagcctggttcaagtcttggctgtgtcatttcctgctgagggaccaggcactgaatttcctacctcttagggtcattacctatgaggttaaagctacctcatgggattgttatacgccactaatgttgaggcagacacctcttggcagggtgactgctcatcttagaccctccccttttctgcgaatttgggccccttgatcctctgatgggagctgaaaggatgagaggtgggcatctagatttagggaggctgttcaggctttgcaggtcccttacctgaacacatagaaaccctggagctgtgactgtgtccatgtgtgtgtgtttgtctgtgtgtgttgcgggggatgggcacctgcatgaatgtggtagagaaaatggctctgctcagagggaagatacgcatagcaaggcagggaccagaggaatcacaggcgcctggagagcagccgggcaccgcctccagggacctgccggcttccctcagtcctccaggggcccagcactcttcctttaggccctgtgagcgtcccttgtcaggatacattctctcattttgctgaagctgatttgattgggtgtctgtttctcgcagccaaaagagctctgaatgaggaaagtgcttctgtgctaactccccgcgtctcctgaatttcagtcattcatgtacccgcctcgaaatttttgcaatatctgtgtaccaactgtccatttacttaataaagaagttttctttaaattaaaaaaaaaaaaaaaaaactcga

SEQ ID NO: 2225 - DNA, 1466 bp, Homo sapiens
ggcacaggctgggactttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaaaaaaaaaaaaaaaaaaaaaaaaaaaaaaaaaaaaaaaaaaaaaaaaaaaaaaactcga

SEQ ID NO: 2226 - DNA, 785 bp, Homo sapiens
  misc_feature (704)..(704): n equals a,t,g, or c
  misc_feature (726)..(726): n equals a,t,g, or c
  misc_feature (751)..(751): n equals a,t,g, or c
  misc_feature (775)..(775): n equals a,t,g, or c
  misc_feature (782)..(782): n equals a,t,g, or c
ggaagtgcccaaggtcacacagctgggatgtggcagagctggggttccagctcctgttcccattgctggacagctgccacatctggcacccaatttaggaccccgcggggaggcccaagccccgggggtggcgggggatcctagaggaaagtggcaaggccaggaccctggagcagagccagtggaatgtcaccatcgcccaggtggggatttttgtgtgttttgttcactgctgtacacccagcccccagcacagcgcctgtccaggacaagtgcccagtaaacacttgggaagcaatgcaagcgtcctcccagcagctcctgcaaacagacccccgacccaagcccttccttctgcctccactgccaccactgctgctcatctctgctggcacagaagtctcttccctggtcttccagaaatcccctctccacactcagccagagggagctattaaaactgcgggccagcccacatcagtccacagcaaagtcctctctaagggatctytgttgcttggagaataaaccctcggattccttccttggctctcggggcctcctctctgacctccctctgtctccttctcccagcctttcctcctcactcaacccttcagccatgcttggcttccttcctttgctccttgaaacaagccctgaaggcccaacacttggcccggggcccccttttgcacttggcntggtttcccttcttgccttggnagccactttcttcctaagggcattnccaccaggggctttccctttcccnacaaaanttt

SEQ ID NO: 2227 - DNA, 2172 bp, Homo sapiens
ggcacgaggtccggtcccaaaggtgggaacgcgtccgccccggcccgcaccatggcacggttcggcttgcccgcgcttctctgcaccctggcagtgctcagcgccgcgctgctggctgccgagctcaagtcgaaaagttgctcggaagtgcgacgtctttacgtgtccaaaggcttcaacaagaacgatgcccccctccacgagatcaacggtgatcatttgaagatctgtccccagggttctacctgctgctctcaagagatggaggagaagtacagcctgcaaagtaaagatgatttcaaaagtgtggtcagcgaacagtgcaatcatttgcaagctgtctttgcttcacgttacaagaagtttgatgaattcttcaaagaactacttgaaaatgcagagaaatccctgaatgatatgtttgtgaagacatatggccatttatacatgcaaaattctgagctatttaaagatctcttcgtagagttgaaacgttactacgtggtgggaaatgtgaacctggaagaaatgctaaatgacttctgggctcgcctcctggagcggatgttccgcctggtgaactcccagtaccactttacagatgagtatctggaatgtgtgagcaagtatacggagcagctgaagcccttcggagatgtccctcgcaaattgaagctccaggttactcgtgcttttgtagcagcccgtactttcgctcaaggcttagcggttgcgggagatgtcgtgagcaaggtctccgtggtaaaccccacagcccagtgtacccatgccctgttgaagatgatctactgctcccactgccggggtctcgtgactgtgaagccatgttacaactactgctcaaacatcatgagaggctgtttggccaaccaaggggatctcgattttgaatggaacaatttcatagatgctatgctgatggtggcagagaggctagagggtcctttcaacattgaatcggtcatggatcccatcgatgtgaagatttctgatgctattatgaacatgcaggataatagtgttcaagtgtctcagaaggttttccagggatgtggaccccccaagcccctcccagctggacgaatttctcgttccatctctgaaagtgccttcagtgctcgcttcagaccacatcaccccgaggaacgcccaaccacagcagctggcactagtttggaccgactggttactgatgtcaaggagaaactgaaacaggccaagaaattctggtcctcccttccgagcaacgtttgcaacgatgagaggatggctgcaggaaacggcaatgaggatgactgttggaatgggaaaggcaaaagcaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgactttgttttctcattcagttttgggaggaaaagggactgtgcattgagttggttcctgctcccccaaaccatgttaaacgtggctaacagtgtaggtacagaactatagttagttgtgcatttgtgattttatcactctattatttgtttgtatgtttttttctcatttcgtttgtgggtttttttttccaactgtgatctcgccttgtttcttacaagcaaaccagggtcccttcttggcacgtaacatgtacgtatttctgaaatattaaatagctgtacagaaaaaaaaaaaaaaaaaaaa

SEQ ID NO: 2228 - DNA, 965 bp, Homo sapiens
caccaccatctgtacccacaggggagttaggatcaggcctccaggtgggagccccasgagcagaggaagaggtggaagagtcctcaccactgcaagagccaccaagccaggcagcaggcaccacccctggtccagaccctaaggcctatcagcttctatcagcccgcagtgcctgcctgctgggcctgttggcsgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaaaaaaaaaaaaaaaaaraattactcggtc

SEQ ID NO: 2229 - DNA, 791 bp, Homo sapiens
gaattcggcacgagcgttcctgtgctttcccttcctggggatctggctaaaatgcgggttctgattctgtaggtctggggtttccagagtccgcggttttgctaagaagccgcagtgatgttgacgcggctggtcctcagtgcacacctgagtagcacgacctctccgccctggacgcacgctgccatcagctgggagctggacaacgtgctgatgcctagtcccagaatctggccccaggtgactccaacaggcaggtctgcctctgtcaggagtgagggtaacacctcctcactctggaatttctcagctgggcaggatgtgcatgccatagtaaccagaacctgtgagtctgtgctgagctctgccgtctacacccacggctgtggctgtgtgaggtctgccacaaacattacctgtcagtcctcaggacaacaaaggcaggcggcccggcaggaagaggagaactcaatctgcaaggcccatgatagtagagagggccgcctgggctaccccctcagtgcccatcagcctggttccggtggtcctaactagccctgtctccttgccaatagccctgtgctccccagccccctcccccatgcagacggctgctatgacatccctgttccttaaagtgcggggttcctcgctgccttctcctccctaactggcaccctgtgcaaacctgctgcagagaacagtgtcttgggcagtgcgatagtcctccagttcaccaacagtaaaaatggtctcaatggggagagaaaaaaaaaaaaaaaaaactcgta

SEQ ID NO: 2230 - DNA, 848 bp, Homo sapiens
cggccgtaacgatgatcggagacatcctgctgttcgggacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgagaaaactcaagcagattgcctttccatctagcactggggccataactctgaatactactgttaacgaattgtgagatttgctgtaaatggatttaggaaaagacacgacgggagaatctggtgttcttggcctctgtgggtccatccctgtatgcttcccccagaaagagagaggacaaaaagttgtctgtcctgagtgattgagactccgaatgtggggttgctgtccagtctgcgtgccaccccagtggctgtttgcgaagatgcttccaggacataggagatctggggaggatggcatttcaccctcatcacaaggaccgtgatgtattcccaggaagactgttgccaaggtatcctacctggcagagaggatctgagagcatgtatgagacttgcctaggaacaaagaaggcttgtgaggagatcaaggaacttacatgaaattgtaggaacggccaggggcagtggctcaggcctgtaatcccagtactttgggaggccaaggtgggatctaattgatacaataggtcgttgactccctcctagtagagctatctaggtttgtctggaaagtttccgaccctggcttataggcaccacacctcatgtactcctca

SEQ ID NO: 2231 - DNA, 1404 bp, Homo sapiens
  misc_feature (36)..(36): n equals a,t,g, or c
gtggatccccgggctgcaggaattcggcaacggcgnccgctccccgctcctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaactcaaaaaaaaaaaaaaaaaactcgta

SEQ ID NO: 2232 - DNA, 806 bp, Homo sapiens
gctccgggccgcgctgcccgcgctcctgctgccgttgctgggcctcgccgctgctgccgtcgcggactgtccttcatctacttggattcagttccaagacagttgttacatttttctccaagaagccatcaaagtagaaagcatagaggatgtcagaaatcagtgtactgaccatggagcggacatgataagcatacataatgaagaagaaaatgcttttatactggatactttgaaaaagcaatggaaaggcccagatgatatcctactaggcatgttttatgacacagatgatgcgagtttcaagtggtttgataattcaaatatgacatttgataagtggacagaccaagatgatgatgaggatttagttgacacctgtgcttttctgcacatcaagacaggtgaatggaaaaaaggaaattgtgaagtttcttctgtggaaggaacactatgcaaaacagctatcccatacaaaaggaaatatttatcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaagtttttggtaatcttgcactaagacatcaacaaaatgccctggcagagataacttgggaaagattttaatataaaacttgacattggaaaaaaaaaaaaaaaaaaaaaa

SEQ ID NO: 2233 - DNA, 1563 bp, Homo sapiens
ggcacgagaagaaactcacctgccccatcccagtgcattctgaacatttcttatttttatcttcttaccaaccttctctcttaaaatcagcttcattaaaatggatttttctagagtaaccaccagatcacctcccccactctcagtccgttttccagtcaaaccatttgttacttgattcagttccaaatataatgtgtgtctgctactgttaagtcattgccttatagtcaacctcaagggtagtcataaactccaagagtttcacgtgtctgactatattcttaggagattgatgggttacatttttctcctcgatagtggtcatgggggaaatgtgttaatttttcactttagatgtttgtgaaatgttggggagagtgaggggtttgttcttaagtggtgggccattgacccaaagtatttttaattccttttttaggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcctttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtggagaatgtgtagtgttaatgttggagattttaagacatcttgaatttgtactgtaccttttatctgagaggttcaagcttcacttgtgtttttatttgtgtttatctatcatattcaaagagaagtagggagagtccgtgcccgaggtcctcaattctaagatcagaggatgtccagaacagcagcagataggggcaggtttgctttaccccatatccctctcctggttcacttttgagagatgaatactttgggccagtaaaggtgaacaaaatatgtattttcatcactctgtactaaaaggacaggaatgttattaattaaaacactaaagcagaaatcctacattgctattaaaattaaactttgattaccacaataaaaacagtagcaagttaaaaaaaaaaaaaaaaaa

SEQ ID NO: 2234 - DNA, 1503 bp, Homo sapiens
ggcacgagatgagccactgcacctggcctctagactacagttttttatttatgagttgcgcctccatctgtgggcagcacggagcctctgtaggcaacacagggaggaagcaggtgcagatctggctgggcctgcttgcctggcaattgggaaagccaccccttttatggctcctcccccgtcttttcatgactgttgcagctcaccagctgcagctgtagagtagagcttcttcctctagaagggagctttcctccctctgctaggacttgggggaggcttatggaccctcactttgggagctatgagccagggctgtgccaagcatctcatgagctcaagtgcctgccactgcttgacctgcttggtctactggcattgtgattgggtcaggcccagtgactctgagttggctggaagacactcagatttagtgaggactcattatagccaccacttcggtctagcctgggcctggagggacggatgtgggcataccctgagtttagacaggtagccccggcccctttcagagtttctctgtgagtccccttagagctttgtttcaaaggctgggaagctgttctgtcctgccttggcagtccaggactgggtgtgtggtgcggggaggtggaagtccgtgcacccctaggggctttccttgcctcaggggtcccccagccaggccacagcaggcagagctgaggccctacagtcagtctgagaggcctccctgctttcagatacagggtggggtgatgggtgaccatggatcctgaacaggccagaggcccctgttcccaagttgcagcttttacttcctggaggcctccctgactgccgggtgtttgtgttgttcacattcctgtgtatagggactccgcctccatctgcagcctcccctcgtgccctgtctccagcacgcctggctgcccaggtcagcgcacatgcaagtgggtggaatgaggccacggctggctgaacgctggtctgagcttaggaaaagaaaaactggtacacagttcagtgtcataaaagggaaagcagaacatgtcatctccgagttgccaacctgctgactcactttagactaggtcagtgcccacaggcctgatcagcacttggaggatggtagagtttacaggcaaggaagcatcataaatcaccctgtgggtatgtgccgccttactccctggtgaggaaagcaaaaaaaacaaaacatagcttggatgtgtggttcccagatgtagcaaaaataaagagaaacaataaaagccaaggcaagcaaactgggcaacatagcaagaccccatctgtataaaaagtggaaacatttttagcccaggcgtggtgggacgtgcttgtagttccagctatgcaggaggctgacataggaggatcacttgaacccaggaggtggaggttgtagtgagccaagactgtaccactgcactccagcctgggtgacagaatgagaccctacttcaaaaaaaaaaaaaaaaa

SEQ ID NO: 2235 - DNA, 586 bp, Homo sapiens
gaattcggcacgaggtggctatcagatttggggttctactctatgagacttttaagtcattatgcaatttctttattttwatttttttgacaagaagtctggagcatgattacattatgcattttcttactctttaaagtatttgtggggataatccttcattatttgattggcaaaaatatatatgtttatagtgtgtaacatggtgattggatatatgtacacattgtggaacagctaaatcaagctaataacaaatcagttacctcacatacttattttgtggtgaaaacatgtaaaatccactctcttagcaattttcaagcatccaatacattgttawtaactgtagtcaccatgttatacaatagatctcttgaacttattcttcctgtctaactaaaattttgtattccttgatcaacatctacccaatccctcactgttctccagcctkgataactaccattctactctctgcttctatgaatttgactttttttttttttagattccacatatgtgagatcgcgcagtatttgtctttctgtgcctggcttatttcacttaatataaagtccctcga

SEQ ID NO: 2236 - DNA, 230 bp, Homo sapiens
  misc_feature (1)..(1): n equals a,t,g, or c
ntgatgacttcactcccaattctggcatttggggctgtctattggccagaccttgcttcacatagtttctcaccctcaaggagtctagcccagactccccatatgtcagttctcagggtagcatttcaagagggataaggtaaacgtttctggcctgttgtggtgtaggctgtgaattaccataacatcacttctttgagattttcttggtcaatgcaaatcacatgaca

SEQ ID NO: 2237 - DNA, 503 bp, Homo sapiens
gaattcggcacgagggtagacctactttgcaagaaacattaaatgtagtgctttagagaaaaagacgataatatagatcagaaactcatatcaacataacaaaaggaggaacatcaagaatgaatatgtaaaggtaaaatacattttttatttgtcttattcctaactgatctaacaataacttttttcaaaatagtaataacaactatgcattcaattagatataaatgtatattattttgtatgtttatgcacaagtgaaatgaattactagcaataatataagagataagagaaaattttgttattatagggtattcatgccattagtgaactagtatagcatatttgaaagtagtcttggattccttgtaatgcatattgcaaattatagggcaaccactaaaaagattaaaaaaaaaaactcgagggggggccggtacccaattcgccctatagtgagtcgtattacaattcactggccgtcgttttaccacgtcgtg

SEQ ID NO: 2238 - DNA, 585 bp, Homo sapiens
  misc_feature (1)..(1): n equals a,t,g, or c
nctgtgtaagacaaaattaatagctgtatctggagtactctaaatgtggatttatacactaacctatatattgatcaattcctctatgcttgctttggttttgagcaaattatatttaaataagtttgttgctaggaatgtcttaaaaagctactcaccctttttgttagaagtaagtaaaatgattatgtcaggacctgccattaacttggtatagtacgaatatatcctcagaatactgataaaatggtatgtcttgaaacaaatcacaaactgtcaatatgttggtgatgaatttcttctgttttcatttggatcagtaggtggggcagttcaccaagtgtgagatcgacatttaatgttttcatgaaatgcaaacccatcagtggctaatttgttaaaaaatagatgttgggcttttcttaaggctaaattgttcccatttgttttagagaacaactcacttagcctatgagtttatgcaatttggcagaaagtgaaaacatatttggaagtattgaaagtcactcattgttgatcttttatattggaatgccaaggttgcatcatcagagtgtcgttatg

SEQ ID NO: 2239 - DNA, 751 bp, Homo sapiens
  misc_feature (663)..(663): n equals a,t,g, or c
  misc_feature (702)..(702): n equals a,t,g, or c
  misc_feature (705)..(705): n equals a,t,g, or c
cggcacgagctttttctggtattccaataaattgtaggttcagttttttttatgaagtcccatatttcttggaggctttgttcattgcttttaattcttttttctctaatcttgtctgcatgctttatttcggcaaggtggtcttcaaactctgatatctttttttctgcttggtcgattcagctattgatacttgtgtatgcttcatgaagtccccatgctgtgtttttcagctccatcaggtcttttatgttcctctctaaactggctattctacttagcaattcctctaaccttttgtcaaggttcttggcttctttgtgttgggttaggacatgatcctttagctcagcatagtttttcattacccatcttctgaagcctacttctgacgttgcgatcatttggaggagaagaggcactctggtcttttgggttttcaaaattttttcattgtttctttctcatctttgtgcatttgtctagtttcggtctttgaggccgctgaccctgggatggggtttttctgggggctttttgttgttcttgatgctgttgttgttgctttctgcttgtttgtttttctttcaatggtcgggtccctcttgtgtagggctgctgaagtttgctgggggttcacttcaggtcctattcatctgattnactcgcatgcctggagatgtcacttaagaagcccggatnacngcatagacaggtgcctgctccttcttctgtgatctctgacctcgag

SEQ ID NO: 2240 - DNA, 628 bp, Homo sapiens
cggcacgagtatatatatattttttaatatatatataaaaagacttttagatagaattctcatattctgatgacctatcacgttgtttgtgcatttttaatcgtggtgctaaagaaacagtttatactagctctgcagactatttcaacatcactcaggagcaaacaaattcttatggttttaagcagtactattattgcagattcaaccttttattattaatacttaaaaacagggaaaaggttataagatgtggagctcattggagagtaaaattaaaccaacaaaaaggatatgacaaagtacaarggaaaacaaaaccaaaaaacttcatgtatcccaaaaaattaattttgccgataaatgctttaaaagtgggcaaaaaaggaggtttctcagtagaattattcgcaactaaaggcaaatggaaaactctcacatagcatttaataaggttttacatgcaatatatcccactatcccaagaaatatctgcagttcaaagctgctttttaaattaatgcttcctagtgtttgctgtttataaatcctaaatattaaagggtgagttccttaataatactattctaataagtactaagacttttctaaaaaaaaaaaaaaaaaa

SEQ ID NO: 2241 - DNA, 533 bp, Homo sapiens
  misc_feature (305)..(305): n equals a,t,g, or c
gaattcggcacgaggaccctatcttacaaaaaagaagaagaagaagaaaaccatgacaggtgtctttaagctgcccttgctgttctgggttcatgaagcatctgtgggaggttgcccatatgtaaaattagttgagtttgaagaaatgttaacgttatatggtattcttttaattttgttttaaaaataatttttctcattcaaatcctgaattagaagttgtttggtataaatattgaaaattgttgaggggagaatttattcaaagtttaatcatttgctttatctatgttatacttagctantagttactggaagtgtcaagttttatttttagatcttaactagagtctaaagtaattactaaaagctagttttcaaataatatgtaagagtaaagtcctgagttaaaagatttagcatactgaattaacttagttgactgatgctgtacttacatgggcctcctatttcttgtggccaagatagcatcaacagaaaaaaaamaaaaaaaaactcgagggggggcccgg

SEQ ID NO: 2242 - DNA, 1563 bp, Homo sapiens
cggcacgaggagaaaaggactcagaccttccagattggctccagaaggcagctgctgtcagtgattttccttacagaccattgcagccacctaccttgcgccatggtcccgagacagcatggcgtcttcccccacacggacctgcaggtggcctcttaggagctttctcgctgaaggaggtcatccctcttagtcacatctgagcagcactcacttaggcctcggccccgagggtcatgcgggggcacctggccgggttcccggctctgtctggtctggcatctgtctgcctttgggctaccttttcggcacagctccctgggcctgtggctgctacaagctggactccagctcccctgggctgcagtgctgctcgcagtggtccagaaaagaggctgggcacagcggctcctggctcagcagcatccttggcgcaggctggcccaggagctccgtgcagggtgctgccagttgacccagccccggctgcactcaatgtccgagaaccgggctggctggggggcctctttgacggagctttactccaagtcttgctgaatttcctgaggaaaagcactgatgttctcatggacacaagggaggcagaatctcttgaagtagaataaactgcactcctttccagtcttcctttctcagcttctcctggaccgccagctcctccatgcgcctcagacactcccaacgccgcactgcgggggttcctcccgccctggcccatctcatcccccttggctgttgatacagctcccctgtgtgcatgtcgccctgtggcagatgctcagggacttctcagactccaggatcactccgagtacactgaccacacagcctgctgcacaaactgcagcgccagctaaggaccaggaatctgacattgtcggaggtgaagggatcctttgtgacatagctttcctccaggaggaccatccactgggtgtcgggggagcttctgccccaagtagcaggagggagctgtcaaggcgtggagttcacactcaaacactcccagaggacggcactctgcatgggacgccatccagctcctttgactgtggaatcaagtacattatcagctggcccctggctcctggctgtgacctcccttcgcttgaactgagccttgtgtgtaagggcgtatcaagttgtatgggcttcgccgctgggtgaccccaaatgcaactccaggaagcatgggttaccaatgactaaggttaacgatcagctgggcgcggtgctgacgcctgtaatcccagcactttgggaggtcgaggcgaatggatcacgaggtcaggagttcaagaccagcctggccaacatggtgaaacccccatctctactaaaaatacaaaaattagccgggcgtggtggcgggcgcctgtagtcccagctactcaagaggctgaggcaggagaatcgcgtgaactcgggaggcgcagcttgcagtgagctgagatctcgcccgctgcactccagcctgggcggcagagcgagactccgtctcaaaaaaaaaaaaaaaaaaaaaaaaaactcgagggggggccc

SEQ ID NO: 2243 - DNA, 1405 bp, Homo sapiens
  misc_feature (10)..(10): n equals a,t,g, or c
  misc_feature (1391)..(1391): n equals a,t,g, or c
ttttgagtgnaattgtgagcggataacaatttcacacaggaaacagctatgaccatgattacgccaagctcgaaattaaccctcactaaagggaacaaaagctggagctccaccgcggtggcggccgctctagaactagtggatcccccgggctgcaggaattcggcacgagaagggagctgtggggcagcggccaggaccttaaaggcacagaagaggaagcttggatttccaattccaaaggacatgaggaaaattcacacacctttatttaacctgctccaggtgaggctgggctttgtgtattttccttgttttacttttccttgtgttcaggctgttgtagaaacaggtacacaggggctctgtgtggcgccctgttctagttgccttcaggaagcatgtggtgccctggtttccttggcttcgtgtccccctttcctcctgccacccctgactctgccccccaccttgtccctcagaacatcttcctggaagggcctggccagggcttgtgtccttgctagtctctggggaggaagactctgtggcttgaaaggctgtcggcttaagttgcaaggtgtaggtgcctgggagggcatgtgcacggccctcttgactgatccattcatgttttccttttttgactccgttctatgttgtcctgatggaggggtaagcccctgccttctgcctttcctgccttggactcttgcaattgggccagatgagagggtccatgtggtctgagaattcaagcaatgcaggccaggcatggtggctcacacctgtgatcccaggacttttggaggctaaggtgggcaggccaggagtttgagaccaggtggccaaaatggtgaagccctgtctctgcagaaaatacaaaagttagtcgggcttggtggtgcatgcctgtaatcctagttatttgggaggctgaagcaagagaatcccttgaacccagaaggagcaggttgcagtgaggagcaggttgcaatgaggaggaggttgcagtgaggaggaggttgtagtgaggagcaggttgcagtgaggaggaggttgyagtgaggaggaggtcgcagtaaggaggaggttgcagtgaggaggaggtcgcagtgaggaggaggttgcagtgaggaggaggtcgcagtgaggagcaggttgcagtgaggaggaggttgtagtgaggagcaggttgcaatgagtaggaggttgcagtgaggaggaggttgcagtgaggaggaggtcgcagtgaggaggtcgcagtgagaaggaggttgcactgaggaggaggttgtagtgaggaggaggttgcggtgaggaggaggttgcagtgagccsagattgtgtccctggactccagactgtgcaatagagcgagactatgtgtncaaaaaaaaaaaaa

SEQ ID NO: 2244 - DNA, 770 bp, Homo sapiens
gaattcggcacgagtccatttctggcagtgactttgaaaagttctgctgcgttacacaaatacgaaaatcacatatttttggccttgttcctctgagaacaaaaacatgtaataagagatacctgctttcatcttttgcaatgaatagaatactctcctacttagaaacaggctttttctccttgccactttattttttccttacctatgaattgcatgtgcctttgatgaaaacaatgaactggacatgtacaacggtacatgtaatagactgaatgcaacttagaagtggccactcttccagtgtacataggcttggaaatgaactaatccaaacctgagtaatttgtttatagtacctcctttcacttttgtttattggtatctacagtctctcattctttttctttaataatatctctttatatagaattttatattcagccatgactctattatttcaatagtcacattaccacttcgaggattgataccatgaaaaaaggttatctagtagttttgagtgaagatacgaggcacaccttcaataccaataagaaggtatacaacaaaggtctaatgaagaaaaatatctcattttgaaggtagcacatagctttcaactgactgggcctgttatggtctttgctgtgtttgttatcacagtatctaatagtgaagtggtaattactttctttagtagaaattccaagatctaaattggtacacatataaatatttgacaacaaaaaaaaaaaaaaaaaactcga

SEQ ID NO: 2245 - DNA, 2197 bp, Homo sapiens
ggcacgagcggaggcgcgcgggccagcctgggccccagcccacaccttcaccagggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccacccccttttcccccgatccaaggatgtatgcatggaggtcgtatctatccagtcttgggaacgtactgggacaactgtaaccgttgcacctgccaggagaacaggcagtggcagtgtgaccaagaaccatgcctggtggatccagacatgatcaaagccatcaaccagggcaactatggctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcagatcccaggcctctggcgcccccactcaagactaccaaagccaggacacctcaagtctccagccccactaccccaccccactcctgtattcttttttttttttttttagacagggtcttgctccgttgcccaggttggagtgcagtggcccatcagggctcactgtaacctccgactcctgggttcaagtgaccctcccacctcagcctctcaagtagctgggactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgttttaaaataaaaccaaagtattgataaaaaaaaaaaaaaaaaaa

SEQ ID NO: 2246 - DNA, 1135 bp, Homo sapiens
  misc_feature (1092)..(1092): n equals a,t,g, or c
  misc_feature (1107)..(1107): n equals a,t,g, or c
  misc_feature (1109)..(1109): n equals a,t,g, or c
aatggaaactgttatcttacacacagcactgatgctaaagaaaagaattgtggtgtatcaccccaagatagaagcggtccaggagttcaccaggactctgcctgccctgcagatgtgcacaggttacgtcgctggatttgtagacttggaggtgagcaacagaccagacctctatratgtgtttgtraatctggcagagagtgagattaccattgctccccttgcaaaagaggccatggcaatgggcaaactgcacaaagaaatgggtcagctaattgttcagtctgcagaagatccagagaaatcagagagccacgttatacaggatattgctctaaaaacaagagaaatctttaccaacctagcaccattttcagaagtttcggctgatggagaaaagagagtccttaatttggaggcgctaaagcaaaaacgrtttccaccagcaacagaaaacttcctttatcatctagcagcagccgaacaaatgctgaaaatctgactgtgtgacagaacgtatcactgatgactgatagaaagccctctttcactctgattacccactcactacatgaagtcctgaaaataacagagaaactgttatatctttttaatgatttatttgcaagtattgagatttgacctgaaaaacaatgaaacacatgaacacacttccgattttctcctcgctgattagcttcctgcctgctgtcagtgctggacgaagtgctataactactttatgtaacattacagaacagctagaggtcctggggtaagagaaaaaaagcacatcacaacaaatgtgaaagccttcattattacacgttccagtttgtctcgctgtgtaggcataagctaatggtttattttcagaaagctgcctgaaacgttgctttgtattcttctaggaagaactttaattcctcctgaggaactctactttctgagccaaactgctaattttctgcggaactgtctagaagatcattcaagagaccctgcagttgcactttctcgtaaaagttaaaaaaaaaaaaaaaaaaaaaggttttttcccggcctttgaacattttgcyttatgagagtggncccatagatcttttntngaaagacaccaaaggagcaaaatatc

SEQ ID NO: 2247 - DNA, 1929 bp, Homo sapiens
ggcacgagagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaaaaactctacagcatatttccgaggatcaaggacaagtccagaacgagatcctctcattcttctgtctcggaaaaacccaaaacttgttgatgcagaatacaccaaaaaccaggcctggaaatctatgaaagataccttaggaaagccagctgctaaggatgtccatcttgtggatcactgcaaatacaagtatctgtttaattttcgaggcgtagctgcaagtttccggtttaaacacctcttcctgtgtggctcacttgttttccatgttggtgatgagtggctagaattcttctatccacagctgaagccatgggttcactatatcccagtcaaaacagatctctccaatgtccaagagctgttacaatttgtaaaagcaaatgatgatgtagctcaagagattgctgaaaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcataggaccatagtcctctttgtggcaacagatctcagatatcctacggtgagaagcttaccataagcttggcacctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactctgttactcaggaggtttctataatgccacatagaaagaggccaattgcatgagtaattattgcaattggatttcaggttccctttttgtgccttcatgccctacttcttaatgcctctctaaagccaaaaaaaaaaaaaaaaaa

SEQ ID NO: 2248 - DNA, 2086 bp, Homo sapiens
cgaggaatggagccggtagctgctgcggcgagtsccgcggctcctccgtagacccgcggagcaccttcgtgttgagtaacctggcggaggtggtggagcgtgtgctcaccttcctgcccgccaaggcgttgctgcgggtggcctgaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgaytccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagaaccctctggatattgatgcctcgggtgtggttggactgtcatttagtggacaccgaatccagagtgccactgtgctcctcaacgaggacgtcagtgatgagaagactgctgaggctgcgatgcagcgcctcaaagcggccaacattccagagcataacaccattggcttcatgtttgcatgcgttggcaggggctttcagtattacagagccaaggggaatgttgaggctgatgcatttagaaagttttttcctagtgttcccttattcggcttctttggaaatggagaaattggatgtgatcggatagtcactgggaactttatattgaggaaatgtaatgaggtaaaagatgatgatctgtttcatagctatacaacaataatggcactcatacatctggggtcatctaaataataattaaagtggctttcataatatgtaacttttgggttctgcctttttcagaaaatggaaacttgggccatgtgtatttcaaacaaaaataactttagatatatcttttttgtagcyttgattgatgctctaagatcacatgagggtagtatttaatatattagatgaaggacaactttggacataacactgactaggagttgagagcttttgcatcaggcagaagcaaactgattatagttgtgttgcaccagatcatgtagctgctgtgtaacatgaccttaaatagtcttcctgcataggaagagcaaaagggtattcatcaataggatatagatttaagacattccctgactaccccttgcgttgttaggtgatgtcttttagcagaatcatgaagaccttttttctcccttaataaaggagaaaaatatactgatggctggagaaatttttctctgcctttcagttttatgaattttttcagaagtaacaatattattattgactttttacttatttgataaaaattaaagaactatttttgttttggtcagataaattgacaagactaatcagtattttattataagtaaaagatttttcttctttccttaaaaatatttttttttcacctaggtctaaatagctaactaactggtagaccagagtattacatcatcttattttggttttataccaataaaacatagcgtggaactcattcaggtaatgttttgcatttcattgcttttggatgaacaaaggaagtaaactaatcctttataaatgaaaacccagaatagttggtatgtcagctagtcattcctgtcatattcccagtagaatgattttcaagtttgaatttctgtwcaaatatctaaataagagatgtgcagagagcaccaattttccttcaatatccattctttacttttcacataatgatagaacctttgatttttcaagtgggtatgcctcctagaataaagactacatttcccgagt

SEQ ID NO: 2249 - DNA, 655 bp, Homo sapiens
tgcactggttccttctccccagcaaatactgccttcttgtttttctctgatgtggcaggtgactacaaaatccgccttggtattcttcaaatgcatatatattcctttcttgtcagctccctctcttcctagattagaaaactgcctcattttctgctcactggatgtgcagtcccagcttgtcttcctctcctccccccctgttgcaggtgttctttttttttttcttctctccccactgggcagcaaaagttgttccacagtggaaawttaggcatcctcaagtttcytcccagcttctgctgtgttttcttagagtaaattgccaatttctgtttttacaggaaatccttttttaaaaatggaatcagtgtggtccccatctactctgcaaaaattgcatttttctctattttcaaatgagatttgttcaagtttcaaaaccacgtgaaataataaatgtatagtagttttcttttccttgggcattgctwgatatgtgaaatgggtttatgaaaaataataaaatcataacgctatttgtttgactttcaatttcatgggaatttttctcagctaaactctaaatggtgattargcaaaaaaaaaaaaaaaaaacygraggggggcccggtaccaattcgccctataatga

SEQ ID NO: 2250 - DNA, 903 bp, Homo sapiens
ggcacagccttccccctgcccttcctgcctggctcactcctggccacccttcagactcctctctctgcctcctccagctggcgcctcacttggtgatggccgtgtctgttccatggcccctcccagaggkacttggtttctcctgctgtcattgcgtctcccttacggggccgcatgctgggttttcttaccatttcctgcatcctgcagagccgagggcgtggcagcaccaatcaagtgtagtaggaatgagtaggaaacaagcatccttctccatggcacagaarggagtctgtcaccttggaaagtcaytcaagagaggatccaagaaagcgtcttgccctamctacccctcctttagcaagtgaggatcttcgagggraggggagtttccaagtcaactggtgacaaagccaggatgagaagacactcccagaccactgtggctaatgacacacactgcccggccatgccatctgccagcgctggaggtggccgctcaacacaggaaggtcaaggtcatgttagcagctcccccacccagcaggggaaagggaaagacttgcactggggagcagttttatttatttttatttatttattattaattatttttagatggagtcttgctctgtcacccaggctgatgcagtggtgagattttagttcactgcaacctctacctcctgggttcgagcgattctcctgccttagcctcctgagtagctgggactataggtgtggtggtgcatgccggtaatcccagctactcgggaggctgaggcaggagaatcacttgaacctggaaggcggaggttgtggtgagccgagatcacaccattgcactccagcctggacaacaagagtgaaatccgtctcaaaaaaaaaaaaaaaaaactcgta

SEQ ID NO: 2251 - DNA, 1712 bp, Homo sapiens
ggcacgagaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatggaagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctgatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaatcctaagtagttttgaatttctttgacttgaatcttactcatcagtaagagaactcttggtgtctgtcaggttttatgtggtctgtaaagttaggggttctgttttgtttccttatttaggaaagagtactgctggtgtcgaggggttatatgttccatttaatgtgacagttttaaaggatttaagtagggaatcagagtcctttgcagagtgtgacagacgactcaataacctcatttgtttctaaacatttttctttgataaagtgcctaaatctgtgctttcgtatagagtaacatgatgtgctactgttgatgtctgattttgccgttcatgttagagcctactgtgaataagagttagaacatttatatacagatgtcatttctaagaactaaaattctttgggaaaaaccctcaaaaaaaaaaaaaaaaaa

SEQ ID NO: 2252 - DNA, 2005 bp, Homo sapiens
  misc_feature (1666)..(1666): n equals a,t,g, or c
  misc_feature (1865)..(1865): n equals a,t,g, or c
  misc_feature (1941)..(1941): n equals a,t,g, or c
  misc_feature (1947)..(1947): n equals a,t,g, or c
  misc_feature (1970)..(1970): n equals a,t,g, or c
  misc_feature (1993)..(1993): n equals a,t,g, or c
gccagctcgaaattaaccctcactaaagggaacaaaagctggagctccaccgcggtggcggccgctctagaactagtggatcccccgggctgcaggaattcggcacgagccaggaagctggtgcgtgtgcagcctcgggagcgccattccacgcacacttgcgtgccggtggccttgttatgtcgttctttttttgtctacactgtttgagtgcttttccatcattgaaagggcttcattacagtctcacattttcccttttttttgcctaatgctaatggtcagactttttaacagttttccacatgctcttctgatccttttcctctggggtgagcagtcaccactcaccaaaccctgccccacccattgggcacctgtctggatggtcccaggaccgcaggtgctgtggggcacccattggggacttccaggaaatcatttctgcaggatccgttcgcacacacgaagagcacagtgccctcgggaagggccctttccgaccacgctgccccactggggttgggtcaccgggacatacagaggctggtgctgcctggcttctcctgcctgcggtgggagctgggttttgctcccgtttggttttgttttctacctgtcaggctgggcgtctttctgagggttccctgaccggcctctgaattgattgtttgtccacgtgggcctggaagtttctcttaaagactaaatgcccctcactggggaaacgacgctgtgccatgttcacagcagacactcaccccagtgggcctccctttttctctggtcacgttggttacttcataggcctttaggttttgatctgtgtttatggaccacggcacttccttccttccacagtgcggtcagacacaggctttgtgtgtctaacgacagactgtttccagtagtttttctaatacttwmgttttaaaattttaaataattcacttgttttttggcattgaaaatatttcattcataaatagtttctagttatgatttaaataattttcccatttttgactgtagtttcccagaatcctctttagaatctcagtccttgtgtttgggtcttctccgcgtgccattacctcacctctgttttgtgccacacactctttaaaagtgtcttcccgcggggtttagagttaggaaagtcgcgcacacataggacagagccccagccgcccctcgtggcacccctcccatcccaagggtgcgtttgtcgcagctgggaacccagtgcagcaccccactcagctgctggtttcactgtctcatcattggtggttagactcaagtagtgtggggtatgtgaatctgcctttcagattctcctgatcttttaagcgaatgacacaaagtcaggttttaacaatatcgtgctaactgtgttttctcaggctgttacacctggtgcttgatatggatttgacttgtctattcttttttttttgtttttcttttttctttaattctagaaccacgttcgtttgaagtaggaatgctagtctggcataaacataaaaaataccccttctggccagcagtggtaagaacagcttcctccgtcttctcagatgtagttacttaaatttcatgaatttttattccatccatctttagttcttgataatttgatcaggataaatgttttcattgntttgkttttcctgggaaaagttggtgggtttttagaaaagacttcaggagatgcctgtacctaaattaaggcacaatggtgttaagttgataggccacattttcaccaagcaggcttagaaagacctactcgaaaaaaatatttgcggccgggtgcagtggttcatgcctgtaatcccagcactttgggaggccgaagngggtggatcacctgaggtcgggagttcgagaccagcctggccaacatggtgaaaccctgactctactaaaaatacnaaaaantagcccgggcgtggtgggcgtgncgcctgtaatccccagctactcngggaaggcttga

SEQ ID NO: 2253 - DNA, 1038 bp, Homo sapiens
  misc_feature (743)..(743): n equals a,t,g, or c
ggcacagtgaagccatctattgacaaatggaggagaatgatgaaaagttgtaagatgtttaaatattttgctattattcatgattattcctaaattttatcttttcaaactgttgctactacttcagaagattacacattttatctgtggcaagacactgaacaatttaaattttaggtgtgaatcatatttcctgtttctgtacctctattgtgcatacatattatactaattcttaacaggaaaaaatacttttttcktttttatctttgtacttttttttgaaggttttaatttgttttagagatggaataaaaaagctgtgatgatatataatcctaataataaaattacttgatcaacggttttgaaaaatacccttwaaaaataatagggcatggtggctcatacctgtaatctcgtactttgggagggcgaagtgggcggatcacctgaggctggtcttgaacttctgrgctcagacaatctgtccacctcggcctcccaaagtgctgggattacaggcatgagcccactgcacctggctgttatgtccttttgatgaatcaactctttcataattataaatgactctttttatccctggtaatgtcctttgtatagaaatcttttttttttttttaaataagaaacagagttttgctctgtcaggctggagtgcagtggtgcagttataactaactgcagtcttgaactcttggccacaagtgatcctcctgccnyggctcatacctgtaatcccagcactttgggaggccgaggtgcgcggattgtctgaagtcaggagtttgagaccagcctggccaacatggtgaaaccccatctctactaataatacaaaaattagctgggcatggtggtgggcacctgtaatcccagctactcaggaggctgaggcaggagaattgctcgaacccgggaggcggaggttgcagtgagccgagatcacaccactgcactccagcctaggtgacagagtgagactctgtctccaaaaaaaaaaaaaaaaaaactcga

SEQ ID NO: 2254 - DNA, 1520 bp, Homo sapiens
  misc_feature (799)..(799): n equals a,t,g, or c
  misc_feature (928)..(928): n equals a,t,g, or c
  misc_feature (937)..(937): n equals a,t,g, or c
  misc_feature (945)..(945): n equals a,t,g, or c
  misc_feature (974)..(974): n equals a,t,g, or c
  misc_feature (1019)..(1019): n equals a,t,g, or c
gaattcggcacgagtcacccttttcagtgagttagtcgtgacatttcttacactgtgagggggagtggtaattactttacagggaggtatggggccatggtgtttgactcttctttcaaccacttctgggttttttagtgaaaacctctatctaacactgatactttcatttctgttgtctattgagtcagttaacactgatccatttatttttcagttcccaaaatcttgctttgccattgcttctattttattgtctgggggtgtttaacacctgtttgcattttttacagtcatttagtttccagattttagtaagggacagagggaatagatggactcattcatgatgtagaaacaaatactccctgtcttgtcttacakgaaaaattattcttaaactagcctgtcttkgagaacctgatcaaagtataaaaaatactttttggcttatttcttagtgagtcamtattccatattttgaaggtgttaagaggtatggtaaaggtggtacttgaacatttccaagcaaacgtgtgatgaaatcttycatcaatgtcttagcaatggtatatgatttttttagtcttagcaattttagataagttttttttttgtcttgtttttttgagacggagtcttgctctgtcgcctaggctacagtgtagtggcgtgatctcggctcactgcagcctctgcctccgagcggggtccagcgattctcctgcatcagcctcctgggtagttgggattacaggtgcatgccaccacacccaactgatttttgtatttttagtanagacagggtttcaccatcttggcctgactggtcccgaactgatctcaggtgatctgcccacctcgggctcccaaagtgctgggattacaagcgtgagccactgcgtggcctgagcactwagggcgcaangaraagccngtactggnawtwttacactactcrgcacargacmggntttaatctttttcttgggggacaagattggaaaattgaggtctgnagcagacctgaagagaggcatccagcaactctgagattaattcatcatgatcattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaaaaaactcga

SEQ ID NO: 2255 - DNA, 875 bp, Homo sapiens
gaattcggcacgagctgggtcttctagaagacgaagatctatccaaaatcaagaagcctttgatttagatgttgctgtaaaagaaaataaagatgatctcaatcatgtggatttgaatgtgtgtacaagcttttcgggcccgggtaggagtggcatggctcttatggaagttaacctattaagtggctttatggtgccttcagaagcaatttctctgagcgagacagtgaagaaagtggaatatgatcatggaaaactcaacctctatttagattctgtaaatgaaacccagttttgtgttaatattcctgctgtgagaaactttaaagtttcaaatacccaagatgcttcagtgtccatagtggattactatgagccaaggagacaggcggtgagaagttacaactctgaagtgaagctgtcctcctgtgacctttgcagtgatgtccagggctgccgtccttgtgaggatggagcttcaggctcccatcatcamtcttcagtcatttttattttctgtttcaagcttctgtactttatggaactttggctgtgatttatttttaaaggactctgtgtaacactaacatttccagtagtcacatgtgattgttttgttttcgtagaagaatactgcttctattttgaaaaaagagttttttttctttctatggggttgcagggatggtgtacaacaggtcctagcatgtatagctgcatagatttcttcacctgatctttgtgtggaagatcagaatgaatgcagttgtgtgtctatattttcccctctcaaaatcttttagaatttttttggaggtgtttgttttctccagaataaaggtattactttagaaaaaaaaaaaaaaaaaatcgaa

SEQ ID NO: 2256 - DNA, 1311 bp, Homo sapiens
  misc_feature (1284)..(1284): n equals a,t,g, or c
  misc_feature (1296)..(1296): n equals a,t,g, or c
  misc_feature (1301)..(1301): n equals a,t,g, or c
ggcacagcttttcaacatgccttcagcactaatgactgctccaggaatgtctacattaagaagaatggctttactttacatcgaaaccccattgctcagagcactgatggtgcaaggaccaagattggtttcagtgagggccgccatgcatgggaagtgtggtgggagggccctctgggcactgtggcagtgattggaattgccacaaaacgggcccccatgcagtgccaaggttatgtggcattgctgggcagtgatgaccagagctggggctggaatctggtggacaataatctactacataatggagaagtcaatggcagttttccacagtgcaacaacgcaccaaaatatcagataggagaaagaattcgagtcatcttggacatggaagataagactttagcttttgaacgtggatatgagttcctgggggttgcttttagaggacttccaaaggtctgcttatacccagcagtttctgctgtatatggcaacacagaagtgactttggtttaccttggaaaacctttggacggatgacagtggctttyttgtgatgacagacasaatggaggagagatctgcttatgggaagtasaaccatgaagtgactgtcacacatgcatgtccaagaaacatcctgaaaacacatgaagtcgtaaactggagaagcagctctacagcagagattatctcgtgtttcctctttctactgggccagaaaaatcctcagggttgcagttggttgagtgggcagttgacatatgcatgttgcacccgatgttgtctctaagttagcaatgtgttatttccagctttaaaggtgagattgtagagatgctgtcaaagggataaggaaatagcaagatttttaagtagtgtgtttgtgaagactgatcccattttacaactgcctgttctttctccagtccttttttttccagccagcttgactattagaaaagtatgaaactggttgggttttatttaatatttttaatatattgagaagcatggtctgcctggactgcacttctctaaaagtgagatataaaattgtgcagctattttaaaagttgtatataatatgtgtgtaaaaaaaaaaactgtaaaaaagraaggacaaacaggttgttttgttctagttctaatttcttaaaaaccactacatggttacaaaattggaataacattttggggggacaactggggttaactaccaaagaaggagggatttaaagaggagatggtggttgaattgaccccatttggaataatttnaggcttacagtncccanagctgttaga

SEQ ID NO: 2257 - DNA, 839 bp, Homo sapiens
ggcacgagggctacgatcctacagtggagaatagatgagtacagcattctgccctattcattcatcattggggtccatggttatgtgcttgtgtattctgtcacctctctgcatagcttccaagtcattgagagtctgtaccaaaagctacatggaaggccatgggaaaacccgggtgccagtggttctagtggggaacaaggcagatctctctccagagagagaggtacaggcagttgaaggaaagaagctggcagagtcctggggtgcgacatttatggagtcatctgctcgagagaatcagctgactcaaggcatcttcaccaaagtcatccaggagattgcccgtgtgggagaattcctatgggcaagagcgtcgctgccatctcatgtgagcccttgggtgtggggtaactgccttgcttctgcccccggcacttgccatgttccagtggggggcagatcctcaggacttcacgggtatggttgccagctgtgttcctggcccctggacacacagtgtggcatcctcatgtttgcacactttccccaggctccagtggcctggatgtcaatgtttacaaaggggcaaggacctctcatggacactggcctctagccctctgtttttgtttgatgaattctgttataacctatggggtcaggatatgagtcctgggcattatttatccaggacccatcctcttgggtgggttttgggtgttggctgggtaaggggagccggggacttctgaaatagagctggctccctggggtgacaatgtatatatgcaaataaattgagaaatcttttgttgttgaaaaaaaaaaaaaaaaaa

SEQ ID NO: 2258 - DNA, 981 bp, Homo sapiens
tgaattggaaccagaatagacctccgagctgggaactgtggatccaaggctgcccccaccccctgggtctggcacgagatctgcactccccagagggggcaggtggtcctggagcctagcctacctgccgagagtcagaggtggctgcaggggaaccatggcagccctccttctcacactcatcctgggcaccctgcaccagcagaagggtttacatgtacaatcacccatccctagcccttctgggaggaagcatatcttacggatggcgaccttgaggctcagggaggttaaggtgccagcctgagatcacacagccagtgagaggcagagacagggcttaaactccagacgatggctccagagccccctctcttttccatgccctgggctgcctctttccccagtgcaccttgctttttggaaccagatgaccaatgtggaaagacatgaactgattcaatcagagtgtatggagaagggacttagagaccctggtatttttaaagctccctgtctctagtaaaaatacaaaaattagccaggcgtagtggcaggcgcctgtaatcccagctactccagaggctgaggcaggagaattgcttgaacctgggaagtggaggttgccgtgagccaggatcatgccactgcactccagcctgggcaacagagtgagactttgactccaaaaaaaaaaaaaaagaaatcagatactaacaactctctccttctttcttttcttcccaatttttgtttaatgtatcatttctaaattcatggtttatatttatatatgtccttaatcctcactcacattggccctacaggtagattcattgctcactgtcagttctcttgctgggattacacgtgtgagccactgggcccggcttagtttttttatttaaagataagggttttttttgttttgttttgtttttgaaacagagtgagactttgactcaaaaaaaaaaaaaaaaa

SEQ ID NO: 2259 - DNA, 1621 bp, Homo sapiens
  misc_feature (527)..(527): n equals a,t,g, or c
  misc_feature (542)..(542): n equals a,t,g, or c
  misc_feature (553)..(553): n equals a,t,g, or c
  misc_feature (701)..(701): n equals a,t,g, or c
  misc_feature (731)..(731): n equals a,t,g, or c
  misc_feature (906)..(906): n equals a,t,g, or c
ggcacaggcgcggcctgcggcttcttgggaactctagggccgcggccgggcctggctctgccggcggcctgttgggagctggatcggagcggtttggaacgacaagcccgacaaagagacttttaaaaaaccatggcagatgtggacccagatacattgctggaatggctacagatgggacasggragatsaaaaggacatgcaactaataccccttgaacagctatgcatgctgcttttgatgtctgacaacgtggatcgttgttttgaaacatgtcctcctcgcactttcttaccagccctttgcaaaatttttcttgatgaaagtgctccagacaatgtattagaggtgacagcccgtgccataacatactacctggatgtatctgcggaatgtacccgaaggattgttggggtagatggagctataaaagcactttgtaatcstttggttgtagttgaacttaacaacaggactagcagagacttagctgaacagtgtgtaaaggtattagaactgatatgtnctcctgagtccggancagtctttgangctggtggtttgaatcgtgttgcttaccttccaagcgtgaacagtggacatctagttcataaagacaccttgcactctgctatggctgtggtatcaagactctgtggcaaaatggagcctcaagattcttctttagaaatttgtgtanaatctctgtctagtttatgaaagcatgaanatcatcaggtttcagatggagctctgcgatgctttgcatcactggctgaccgatttacccgtcgtggtgttgacccagctccattagccaagcatggattaactgaggagctgttatctcgaatggctgctgctggtggtactgtttcaggaccatcatcagcatgcaaaccagntcgcagcaccacaggagctccatccaccactgcagattccaaattgagtaatcaggtgtcaacaattgtaagtctgctctcaacactttgcagaggctctccggtagtaacacatgatcttctgaggtcggagcttccagattcaattgaaagtgcattgcagggtgatgaaagatgtgtgcttgatactatgcgtttggttgactttctcttggtgctattatttgaaggacgaaaagctttgccaaagtctagtgctggatctacaggcagaatcccaggactccggagattagatagttctggggagcgctcacatcggcagcttatagattgtattcgaagtaaagataccgatgcacttatagatgcaattgacacaggagcctttgaagtaaattttatggatgatgtaggtcagactctattaaactgggcctctgcttttggaactcaggaaatggtagaatttctttgtgagagaggtgcagatgttaatagaggtcaaaggtcatcatcattacattatgctgcatgttttggaagacctcaagtagcaaagactctgttacggcatggtgcaaatccagatctgagagatgaagatgggaaaactccattagataaagctcgagaaaggggccatagtgaagtggtagctattcttcagtctccaggtgattggatgtgtccagttaataaaggagatgataag

SEQ ID NO: 2260 - DNA, 2069 bp, Homo sapiens
ggcacgagggctctactccgggcacagcatgcaggcccagttctgctgctctgctgtttgttctgctttcctccacatattggcatcaccctctggtgccaagatggctgctgcattccaggcatcacatccagactcagacccagagaagctgcccatccctacctgggtgagcctttgtaggaacgagaaaccgcatccagcagcagaaacctcacccagcagcgtcttttccggtctcattcaccagcgccgcccaccgctcaaccaatccctggccaaaagaatgggaccgcctggaaggctggaccaaacaggacctgccctctggggctggggagaggcccagatgaaggctgcaggacaggatggactcctagacctctgttaccagcagtgactacctctgtctgggtggttggaacatgtttgaattttattctaagtactgtctacaagttctgcaataaaccttgactcttcttttaataatgcaaaaggaatcgaagtgattgtttgaaagggagaggaagaaagagagaaggagggagggaagaatggagggaggcagggaaggagacagagagagtagaatccagccaccggaaaatccagaatagctggctttgcttaatccatgcctggaaataactgctgggtttgcaacaacttctctcccggagacagaccaaggaaactacaaaactgcaggaaggattgaagggccgggacagtggctcacgcctgtaatcccaaagtgctgaattaagcagctcaccatccacacggctgacctcatacatcaagccaataccgtgtggcccaagacccccaccataaatcacatcattagcatgaaccacccagagtggcccaagactcccagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctgcacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctccagcggctgtgtgcaatggggtcttttgtggaaatcaaggagcagacaggtttcatgtgtactgtcaccacgtgggatggaaccagaggcatggaagcaagacgctaaatgaagagggccataagggctgggattcccaggctccttaggaacagcttgtctttttttttttcctctccaaaaaaaatgtttaagggacggtgacaagagtgagactctgtctccaaaaaaaaaaaaaaaaaaaaaaaa

SEQ ID NO: 2261 - DNA, 2266 bp, Homo sapiens
  misc_feature (110)..(110): n equals a,t,g, or c
  misc_feature (2224)..(2224): n equals a,t,g, or c
  misc_feature (2239)..(2239): n equals a,t,g, or c
  misc_feature (2262)..(2262): n equals a,t,g, or c
caatccatatgaaatgtggtggtggattcagctgaaaccatggaatgaatgggggcgaggctggggatgtggaaactgtatcccagggatcagatctagacgactcagtngatgattgcatggggtgcaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcarggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcagtccccccaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagcycaggaccttcgtggagctgcttctccaacctgagaaactcaagacccatcctcccgctgtcactttggacaatggaaatctacattttcttttcccttttttttttttttgagacagagtctcgccttgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacctgtctcagcctcccaaagtactgggattacaggcgtgagccaccatgcctggccagaaatctatgttttcttagaacatgtggaagaaggaaaaagacaaaaaaggaagtctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacacccaaaagatatatagagtgaaaagtctccctccaatccttattctccacctgctcagttcctgtctaccctggcctagaggtaaccactattctcatccatacatccagcatttctttatggatatacaancaaatgggaatgtanagtctcacatttctctctttatnccca

SEQ ID NO: 2262 - DNA, 3578 bp, Homo sapiens
  misc_feature (1579)..(1579): n equals a,t,g, or c
ggcacgagctggaagcagcgtcttattttaccttgttctcccacttcctgaagatgctaaactcctggtggactgcagaggagagggattcagtcttctcctgatgtgtttgcctgtaggtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactccccgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgnttctgaacaacaaccttcttcggtccttacctgataatatatttggggggacggccctaaccaggctgaatctgagaaacaaccatttttctcacctgcccgtgaaaggggttctggatcagcttccggctttcatccagatagatctgcaggagaacccctgggactgtacctgtgacatcatggggctgaaagactggacagaacatgccaattcccctgtcatcattaatgaggtgacttgcgaatctcctgctaagcatgcaggggagatactaaaatttctggggagggaggctatctgtccagacagcccaaacttgtcagatggaaccgtcttgtcaatgaatcacaatacagacacacctcggtcgcttagtgtgtctcctagttcctatcctgaactacacactgaagttccactgtctgtcttaattctgggattgcttgttgttttcatcttatctgtctgttttggggctggtttattcgtctttgtcttgaaacgccgaaagggagtgccgagcgttcccaggaataccaacaacttagacgtaagctcctttcaattacagtatgggtcttacaacactgagactcacgataaaacagacggccatgtctacaactatatccccccacctgtgggtcagatgtgccaaaaccccatctacatgcagaaggaaggagacccagtagcctattaccgaaacctgcaagagttcagctatagcaacctggaggagaaaaaagaagagccagccacacctgcttacacaataagtgccactgagctgctagaaaagcaggccacaccaagagagcctgagctgctgtatcaaaatattgctgagcgagtcaaggaacttcccagcgcaggcctagtccactataacttttgtaccttacctaaaaggcagtttgccccttcctatgaatctcgacgccaaaaccaagacagaatcaataaaaccgttttatatggaactcccaggaaatgctttgtggggcagtcaaaacccaaccaccctttactgcaagctaagccgcaatcagaaccggactacctcgaagttctggaaaaacaaactgcaatcagtcagctgtgaagggaaatcatttacaaccctaaggcatcagaggatgctgctccgaactgttggaaacaaggacattagcttttgtgtttgtttttgttctccctttcccagtgttaatgggggactttgaaaatgtttgggagataggatgaagtcatgattttgcttttgcaagttttcctttaaattatttctctctcgctctcctcccctcctttttttttttttttttctttttcccttctcttcttaggaaccatcagtggacatgaatgtttctacaatgcatttcttcatagattttgtttatggttttgtttcttttttcttctttgtttttcagtgtgggagtgggaagaggagattatagtgactgaagaaagaataggcaaacttttcaaatgaaaatggatatttagtgtattttgtagaagatctccaaagatcttttgtgactacaacttcttttgtaaataatgatatatggtatttccatcgtcagttaccgagtatagccactgggtatcactactttgtgttaaagtgccttcgcactttaagtacattacttaaatgttgcttttagctttgataaattgaaaatattttaatgtgttgtatttttgaaattgaaaacactgtaaaatagattgatgtgtcagctatattaagtcaacgtacagtttgcttgagttatagaaaccagcctgtcatcaaatgattctagttctaggactttgtaggcttaactataaaatatttcctttcctctgggtttaagtgattttatttaagtcaactaaggggatttaacagtggactagaggtaataagccacctcagtcaggattaataattcattaataaaatatatttaacccaaaaaaaaaaaaaaaaaa

SEQ ID NO: 2263 - DNA, 1498 bp, Homo sapiens
  misc_feature (791)..(791): n equals a,t,g, or c
  misc_feature (895)..(895): n equals a,t,g, or c
  misc_feature (915)..(915): n equals a,t,g, or c
  misc_feature (936)..(936): n equals a,t,g, or c
  misc_feature (1017)..(1017): n equals a,t,g, or c
gcatccccatttctgttcctggaccctcttctgtcaccccatcgacaagtaaagaaatcaagaaatccaaactgattcgaagccagtcttttaataatcaagcttttcatgcaaaatatggcaacttagagaaatgtgctagtaaaagttctacaacaggatatacaacttctgtctcagggttaggaaagacttctgtgctttcactagctgatgattcattccggactcgtaatgccagtagcgttccatcttccttttctcctaatactcccttaccgagtacttcccgtgggacaggtaactcagttgaccccaagagcagtggaagtaaagatacacaaccacggaaggctaccttaaaatccagaaaatccaatccttaaatcaactgcttgatgaaggaggcaaaacaaaggcagcaggagataatgtgattggtacacaaaagctaaagcagtggctggggctttgtttttaaattttgggttttttttttgttgttgttaatgagcagaaagagagacataatgacagctgatgttaaacttttcatatttcaaattagattccctaggaggtataatatatatttcttgagtaataatgtggttacggaattccaatgttatagtgaagtgtaatgaaaaacatctctaggaatgtgctttaaccactgctgcaaaagaracaagtctgcatttatttgtgcaggaaaccaccatttaattgttctagarttttagcatttaaaaatcgtatgaaagtctacatcagctgaattgtcctancttgataagcacttggagggggacttggaaggtgagaaagatactgcattttctcatgagtctccaagcccacttgaaaagtcacactgaaaggatgcaaatanccgtctgcgattttggcggnccctccggattgtggtgacantatgttgtacccggacattcccaaatttaaatttggcagtgraaattccacaaagatttctggtaacttkgagctataatnccttaaaaataatmgattgatgattttctttatttccagagaatttattttataaatactttgtttacattttagattgtacttgtctttatttaaatgatgaatctagtctgaatcagctgttattccagctatcatgcttaagctatgtcaacagcatttatttgtactaatgctaatatttccatcaaaatttgcctgtggaatatatacagttcttaattttaaactgtcagttcttgagatataccgtgtgaagctattgtcagcttctctatttcaaaatgcaatcagcatataactatattgatattagaagatatttgttttttaaaatatattgatgtatgataaagatgatctaatttgtgaatgcatatgtatgtgtggttactttttataatgtgaaataatgaataatgaatttactcaaaataaaacataggttaatgagaaaaaaaaaaaaaaaaaaaaactcgaa

SEQ ID NO: 2264 - DNA, 1231 bp, Homo sapiens
ggaggaaggaagcaattctaaaaacaaattttcaaagctatttttacattaacattattttttctaaatgtgcatccattatagtagagttatcttttccttccttaagctcagaattaagtcaatttcctggtatgcaatgtggctttattttttttgttatttaaattgtttagccaaagtgagatcagcaactacttatttatatgtttgagggcactgtgagctgaaataacaaattttgtataacttatctaactaaaaatatttataatacttctcaataatgattctaatgaagatgtattgagtaatttattaccatcttttatgttttaagagttctgatagtacaagttaaaaaaaaatagcctacttctactcttttactgaaatcaaatagatggcatgtgatgattaacataaaaaagaacacattcaacataatatattgcgatagtggcagtctaatagaaaaatagcaactatttatttacttttatttattcgttttatttataatagatatgtacaaaatgtaaaattatttctaagaagatttttctttaaacaccaagcattacagtagatgttgtctgaatgtgtgtaattgagaataataatattgtataataatattaatatgattgtggctagaaggaatttatttgatcacataagtacagcaaattaagaataagatctcagcatatcctggctactacataaatgtagcaaagttattttgctaccttgaaaaaatacaagtggacaaaaaattgcctaatttcatggaaaaactataattttgccagttaatacatgagattctcaaattcacgaatttaaaatgtttaaataattatacttttgctgcctgaaaatatattggatcaaaatttcaagtaaatatcatcaggggatttggatggggaagagcaagaggggaagaaggaggagaggagatttagtctagcactatttccagctgatccccacccagcattgccaagctacaggacaccaattcaataggatgaagtcagtcaaatcctcttttaagtaatggttgaataaaataaaatgaggggaagaaaatcaagtactctaaatgattaaagcgtatgaataagtgaaaaatgtttgcaaaattgagaaggaaggagaatcgggaagtggttatttatggtgtctcaatatgtaagggtaaaaaaaaaaaaaaaaaactcga

SEQ ID NO: 2265 - DNA, 1093 bp, Homo sapiens
  misc_feature (2)..(2): n equals a,t,g, or c
gnaattcggcacgagtgggggtggctgccctggcccagtggaaggagcttggccaagacacagcatcctgtctagcttcctaccagtagacaaagctgtcagattacttacatggccacctctctgccgcagttgcttggaagttctaaactaagtttcatgtttaattgctttagcatgcttcaaccaggaacatttaatagcattttttctctcttctttttgtttgtaactttagtctttcatctttatcagttgtttttatacttattatacctgcaattttataagttgcctcaaattcttttttaaagcccttgagtccaaaataaaaataaatataaaccaaaagccatttttataattaaagtagtaccagagtcatcctccttaaaaatcaggtaaaatacgtgttgaatagagataagagtatttgctattacaattttaattcagtactaggcatgcttccataaactgctcaagaataaatggtaagtattctaaatccaaggagggaaaaaacaaaattgcatttttgcagacagtacttttatgtatgtataaaatgcaatgaaattaatacaaaagtaactggagataatgataataatgtgatagtgttctgcagaattataggctaggctaaaaatctcaaaagtcaagtaagttagtatttgctaaagtcatgtagctgacaatatagtgatgaaagacatatgagaaaacattgtccacatccaaaactgaacttctgtctaactaccctagtgggcctgccctccctgcacctcttattcactatgctgactaatggcatcatccacccaggtcatccaagcctaaaccttggaggtcatcttaagcaccacctccccagacctttacaactgctgaccctcagaactagtcagtcgttaaccagcttctgacattacctaaatttctcccaaacccatcccaattttgtacccaattcttctgacttaatttaagtctatcatttttgtcagaattactagatgaattcttcagtcatatgtatagatatacacgtgctccacaggttaaaaaaaaaaaaaaaaaactcgta

SEQ ID NO: 2266 - DNA, 2572 bp, Homo sapiens
  misc_feature (13)..(13): n equals a,t,g, or c
attcggcacaggntagggtgggggcagtttagttcccaatggatatttctggtttttgcagaaaaagtaggaaagggaagtgggatggtttacctctttgtcaggaaagttaggtaactattagtaaaaaacaattatacactttaaaatcctgcaattattttacagaaagcactaaaactgcatgcatgggaagatcactccatttcagatgtatttgttacacagtatcttgtttatgctgtgcttagtaggcatggttgaattcaataaaagcacacgtgaatgcattttatttaagacactatggctaataccactgtttacatataaactggcgtatctatgtgagaaactcaagtttgtgaaattctgtgcatctttgctaattgctgtgtttgatcattgacatttctgacatgccacatgggcctgcggggctgtcatcccctggggctgacaactggtactcggcccgtccttgtaatccagcagtattttttcatacatttgaaacatttagaggaaaattcagtaattgaataatgtttgtaaatattctgatcgaaaatgaaaaaattccccttaatgaaacctgaactctgcttctgattagcttatatgacttaaagcttcacttcagttcccttgaaaccattacatcttttataaaatgaaagcactaagcaatccctaaggtttttctcaacatgttgggaagccaattttattttatagcataatgtgtttattcttacttgatcatatctttttttttcaraaacacagaaaaagaaagtgcttggtcacctcctcccatagaaattcggctgatttcccccttggctagccccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgtaaatttttatgtaaacagaaggtcttcaataagtaaagtaactccatatggagtgattgtttcagtccaggcaatttttctattttatattaagacttcatacatttatatatgtaaatatggcttattaatggaatgttaaataaaatgtatacttcacagtcgtttgtgtcttggatttttgaaagggaggggatatctgtttaaatagttttatatgctcattggtctcattttctctataattaaaatactagaccagtcttaaaatggggatgattgaagtattgatatttctttttacagttactattttataatttatgcactttgattctgtgattcagatttctaatcagaaaatgtatttttttgtttttggctgttactatgttaaaattgaattatgggcatgtcattttgccatctttgtagtttcacaaattttgtgtaatctacctcaaatgaataatccaagtattggttaactataatgttggcatctcttattcggcaagcttaaaggctctttaaagtcttaattagtcaaagactaatccaggttagattgaccggttcactgctcacttgcaaccttatcaaagggtttgacaaagggaaatgtaaaataaatctgtttatggatattgagtgcatcttgtatgtgcctaatattgataggatgagatgtctgaacaaatttttataatattgctgtgaaggagcttgctattgaaccacagaaatccstyaatattcaggttttaaaactggcaaattctcacaggacctcaggcacagattattgaggttgggagagagtgagtagatgtagaaaaggagaaaaacaacacacgccctgttctctacagtacaactgtgtgcaattaagcaatggtacttgatgtaggctctaacactcatcaataaataagtgttgtaaaataatttataacaggtaatcgatagtgtgtaatgaatggactattaataattgattatctagaaacgaactgctttcgtgggcttttaatattttaatgtgaagcatatgcagtgtgctttctgcatttattttyctaccaaataatacagataatgagaaattggtgaaaatgcctacgcaaagtgttgacagtgtgaaagcagtgcgagtgcggccttttagtcaggttagtgatggatgttacgctgccttgttgaaaatttcactgactttgattttattacttttttaatgatagttatcaaacttgtatttaagctgcttgtcatttatggaatattgaacttatttaaatgaacttgttaaatgaataaagagctaaacataattcagtaaacaattcctttgcgcaagtagcacaataaacatggatgcaacgtatgtcaagttaatacttttttaaaccaacgcaatttggtgaatatagatgtgtggtacctgtttttaaaaaaaaaaaaaaaaaaaaaaaaaaaaaaaaaaactcgtag

SEQ ID NO: 2267 - DNA, 3246 bp, Homo sapiens
atttctgaattgtggcagagcttagatcctgcacccaggggtctttttttcaaacagcatcttgctcagttctgtgaacagaaggctttgttactgaaggaggtggaagaggagtttagggtgaaaaggaggaagggatggacagacccaggtgaggagaggcctggggattggggaagctgtcatctcagtgttaataatcaacttgcttctaacacactggcttatcaggggaggtcatccagtccggtcggtggagttgagagsccttgggccagggtgtttggcggcacaggggcatccgstgggatggcctggaagaattgggggarggggaacgtcttcactggggtggtgatcagtgggacagttcaggtagggcaggtgagggacccccgaggccctggagccttgtcctgggatgggtttgaagaactcatcactcatcacttgttttcttttggcttttgttgtttttgttttgttctgtttgttttgttttgtatttctttgttattttattgggaaggtaagcggaatgtgctcatagaccatcagacgcttgtcgaaggcaggtcctagtcatgtaattgcacaggacaaggaggtcagcgtgtgtgatggcagcatgctgtgccggcacatcgtggagtcctagaaactctctagtccctgcggctgttcccctcctctgctctctccctggagaggactgccagctcttaagaaacattcctggtgcggtgtctgcagtgccctttgtgggtgacttcaggcttcccgctttcgtggtgctcttcctgggattcgtttttttattaccctccctccctacttgtaggcctcagctatggcttgacgtaatcgcttttagacccaggttggcttcccttcattaagctatgatcctccaccccatttttttttttttttaatttggagtgggagggaggggggtgggcgagagaaagctcgaaaggtattattggtttttcaaaaaattagaggtgacgattctaccagggagttgactgataggagtgtgtgcagggcaggaaaggttcggaggcacccgactaccaccactcggaaagccgctagtccagatcgactagggagaggcttagatactttagtgtatttaaagagcatttcagttaactttttcagctatttttaaagtttgtgaatggagtgttattttggacattcttaaatatgaattctccaaaggcatttagccttgacttaatattaaatcctaaggattttatgtaaggtttttttgcaacctatttaattttttttaaatgcctaacttctgaggtgcataagcccgtggtttgtgtactggaactaaagcggaactcactgattcatattggatccccaggtataccttctgctggtagcatatggctggaaaaggccgtttgcctcacacattgtaacctgccttggctagaaaatgcttttaatgtctcaactctctcttttctgtgtcatgttttggtaggaaatctttaagattggcggacggaacaggtattttagtgagacacttctgagtacttgctttttcctttgacttctaaccaactaaaagagaaggaggtcttcatgttgatattttgcttggttttattttactgattttaaaaggtatatagaaaaatgtaggcctttaaaaagaaacagcatgtagttttttattttaatatgttccatagagtggataggcagacaggtactattgtaatgtattctgtatttaataatttaatatactctagaaagtagacctcatgcattcttttagcatgattttcttttaaactgcttttcattttaagggcacccgtggcggaagctggttttgcaaggactgtgtaagctgtatgcgttctagctgtatgcgttctgtagtcttttcttaggtgggtaacattttcaataacgcgcgcacagcacacaggggtgccctgagccgaaggagcaaaaaaagccaccgctcgtttctataatccagctttgcttttcacaggcgtgggatccaggatggtgtcctctgtgaggacttgaactctggggctttaattccactgtttaattttcaggtaccacagcagcaaagcacagagtgtgacctttttcatgtctgagctgattctgtttgctccacgtgcctgcttcttgctactgttcatttagtaatgggatcacctcaccatgccatgctctgggctctccctctctgtccatttctgttttgctttcctggctaaacccatctaccattcttaacactggtagctcctgtcccattccaagactcactctctcagaccttcccatctccctggctttccatgctcctctccctccacctcctggcttcaactgggtgagggccgtattcctgccactctgctccgcctcagccttgagaactccacgtgggctgggtgggaaggtgctgacgattttcacactgtgtttaccactccatcacctctcaacctttgcttcgacaggtcttcactcacgatttattcctccaggtctttgattggagagagtaactttttaattctgttgttttgcagtttggctctgtaggagtgagtggcgattcaaagatgccggcgtcccgcagtgtgcggttcgtgcccttaaccacccgcttctttgtttcccgcccctctgctttcgcaggagctcttgtgcttgagttcagtgttagtggtagcgtggctcactccacttggaggtggcggccgtctgaccgtgtgttactgctttgccgacggggcctcccggccctgatgcgtgtacactctgcgggctgcaccgggtggctctggttgggggcgaagctgtgttgactgggagagcgttggaaattgagacatggagagatgacgggagtgcgtttctctgggtttgatctccatcctgttttctcccagacacaccacacctaccttgggggaatgccgttgcctgttccacccctttgttcacttcgcgttaactgctgtggtaactttttcaggatctgtgtgaagaatggtaatgacgtagttgaaaggaaaatgtactgttgtgtgtttcatttgtgtgatttcgtaccaaaaaaatgtgtttgaactatattgtatgtaatttggaagtcgtgttaataaaaccctgcagtttccaaaaaaaaaaaaaaaaaaaaaaaaaaaaaaaaaaaaaaaaaaaaaa

SEQ ID NO: 2268 - DNA, 2341 bp, Homo sapiens
  misc_feature (161)..(161): n equals a,t,g, or c
  misc_feature (163)..(163): n equals a,t,g, or c
  misc_feature (170)..(170): n equals a,t,g, or c
  misc_feature (1229)..(1229): n equals a,t,g, or c
  misc_feature (2243)..(2243): n equals a,t,g, or c
  misc_feature (2309)..(2309): n equals a,t,g, or c
gcccagttcctcttgaaaaggcagagaatttagacagaaattcaccaactgctttcttacagaaagtaaaccaatttctgcttccagaaaaatggagtaaatgtattttgccctattccttctactaagaaaaactataaaccctgaacattatatataananatatganaactcagacctggagagaccaaggcagatgtggtagggacttmataaattgtatagtgatgaatcctctaagttttcttttctgctttataatttgcagacttttagctgaaaatgccatcaacatagaaatactaacaggcacatatgagaatttcccaacaaaagcctattattttaggcaaaggtcaaggaaatagtctaccaaggcagaaaacatttcgacaataaccactctactgtagtcaagtaccacagaaaacactattacctcaagtgaagagcttagatctttagaycttcataccagccaggctgtgacaaggtgtcccaaccctcctccagaatagtatctcagaatagcagaagttggaactttcatccccaacttgtggtaataagcccctcactctccttccacaccttgatatgactggagagcaaatggggagctggatctactctaaaagcagcaatgaagaagcaccctcctttccataccaggtggtgcttgtggaggccatgtgggaaacagtaacaagtcacttcttcctccgagacaggctatcagtggaggcccagtggtgacccagaatccaccctccagccagcagtaatgaggaacctccgctgcctaggtgtcaacagagattgagaggaaacctttatttctatcatcacctggcagtaatgcagtgtccctccctcactcccttgccttgctggagtagtgtctgaggaagctagctaagacagaaaaggtaaataagttctagagtctcataatgcctaaaatgtcctggttcatttagaaatcatttggtatacaaagaaccaggaaaaatctcaacttgaatgtaaaaggtaattagaagattccagaacaaaaatgacaaagatgttggaattattcagaaaatattttaaagcagtcatcataaaaatgcttccagtatattgsttacaacatatatgaamcaaatttaaaaattatctyagccaaaaaattaaaatatwtgaaagaactgaatggacattttagaactgaaacttacaatanccacataaaaaattcatgaaggtaagcaggaaaaaactataaacacagcctcagggacctgtagtattataactgaaggcctaatttttgtgttatcagagtcccagaaggagagaagaaatgggcaactttgagaaaggtctcaaagactgaaaacttccttaatttggcaataggcaaaaacccacrgattcctwaattcargcaamcccaaaatctcttagcactgtatcagaataccatagaatgggtggtttatwaaaacaaaaatgtgttgctcacaatactggaggctggaagaccgtgatcagaatgccagcacagatgagttctgctgaagacattttttggctatagatggacatcatctcattgtatcctcacatgttggagaaaagaaaaagatatctcttgtctccttctccctctctctctctctttttttttttataaggcctctgatctcaacrtgagggccccammctcatracktartctaaccctaattacctcccaaaggcctaacctccaaataacatcacattgaatttaggatgtctacatatgaattttgaggggacacaaactttcagtgcataaaactaaccaagacaaacacaaagaatccaaactaaggtataccatggtaaaatatctgaaaattaaaagaaagaacaaattttgaaagcagctagaggaaatagctcatctataggagagaaaacaatacaaatggaagcaggaaacatcagaaatagatgaaagccatagaaaagtggcacaacactgtctatgtgatgaaataaaataactttcaattctggtttttatatctggtatatttgtcttttaggaatggaagggctataaagacatttgatgaaagaaagctgagaggatttgtcaccagaaggtctrccttttaaarrggggctcaagarrrttctctatccaggaaaaaaaaaagaaaaagtttaaaaaagaaactttaaaacaccagatttaaagaaaacncagtggaaagggaaaaatgagtggcttcatcttccttttcctcttcagtttggtagatttatttgnccagctgaagttaaaattatgccattatcaga

SEQ ID NO: 2269 - DNA, 3625 bp, Homo sapiens
tttttttttttttttttttttttttttttaagcaaataatgtttatttttatattgatgatacacttaatatatatgtggattcaaggtacaaaattcatgtacaagagttcacacctgatgaatgtagacacattcctagagaacatttatcaatgtgaaaatttctttaatacactgacaacaaaaatcaaatattctctaatctcgttattcaataaacatcaaaacaacgtttcagttttcatcctctagtactgaagtgccctcaaggtggtaggcactgtatagcaggagaaaacattggaaagcctactgaatccgctctgcagaatcacagtgtttactctgaaattcatttagtgaagtagtggaaggctatcttttatgacaaatcacatctcatacaagagtcaaaagtgatgaactcaagaaaataaaatgtttcaagaacttctcaatttctaaaatctatggagtattaaccataacagacaaagaagaaaaaggctgctggaaaggaagaaaaaaacatcctgtttaagagaacgtatggcttaagcaatttagaacacaactgacaagacttttacaataccacaaatgttcaagtcaaatgatagtgacagtataattttccccttagtcattggtagtaaatagccccttcaaaatttattctactgktaacacatataaaaactatgaatccaaacagttttgctaacggggctgagttgatggatttttttctaaagtattaactcacaatatccaaatattaatacaaatgaacgacaagattgtttcaaagattacagtgatttgtgaatagctaaataggcaaccaaatagcttcattatttgcacgacagattagcagcacttggataagaattgttacatgaaaaatattgtgcttcagtctcttgaggagagctaatataactctataatccctatagtgttaaaattctataacatttcagttacagacaagcacaattgttaaaaagtatttcacaccactagaaaatcgagtaattatatcctccaaatgaattacttctatgatttaaacaagtgcatttctgcctaataatcagaatgtagacaataagttcagcattattttcaagggaaaaagatcaaacataacttattttaactcctatttgattatcttaacctttagtgatgattagaacttaaaaaagggaaactcaaccttccaatggaaactgctcagaggaaataataaagtgtcctgaaattacaataattcttagcacaaagtaaaaagtgatttataactgcttcatctgattcaatgattaatgaaatcactatttatactggtgctacacaacgaagataacctatatggataagttattttacttgtaaactctactatgaaaatgttaggactttgtatttgcctttcctawtatctaagatgkttctacctcaactggaagaatcatccaaaatctaaaggtttctctgattgttgaacagcaaggtttattaaaaataagcaaaaaagttggagaactagccatatggtctatgtggcaaaaggaatgcattcagataactataaaaagccacataaatcaagttctagattattgtactgaaccattagaaggtctttttaatgatacagtaacaagttaacaaaaaccattcttcaggaaatagtaataaaaattccttttttttttttttttgagaatgagtcttgctctgtcacccagactggagtgcaatggcacgatctcggctcactgcaacctccgcctcccaggttcaagcagttctcctgcctcagggcagcagagttgcagtgagccgagctcgtgccgaattcggcacgagatttttagcgggagagggcatgacagtgggtgagttgagcagagctcttggacatgaaaatggctccttagacccagagcagggcatgatcccggaaatgtgggcccctatgttggcacaggcattagaggctcttcagcctgccctgcaatgcttgaagtataaaaagctgagagtgttctcgggcagggagtctccagaaccaggagaagaagaatttggacgctggatgtttcatactactcagatgataaaggcgtggcaggtgccagatgtagagaagagaaggcgattgctagagagccttcgaggcccagcacttgatgttattcgtgtcctcaagataaacaatcctttaattactgtcgatgaatgtctgcaggctcttgaggaggtatttggggttacagataatcctagggagttgcaggtcaaatatctaaccacttaccagaaggatgaggaaaagttgtcggcttatgtactaaggctggagcctttgttacagaagctggtacagagaggagcaattgagagagatgctgtgaatcaggcccgcctagaccaagtcattgctggggcagtccacaaaacaattcgcagagagcttaatctgccagaggatggcccagcccctggtttcttgcagttattggtactaataaaggattatgaggcagctgaggaggaggaggcccttctccaggcaatattggaaggtaatttcacctgagtctcagggaaccacgaagggatatggcaaygagtagagcatgaaggtagaacagtctatatactcttgtgacacatacaatccctaccttgtgctgccaagtaactcatttttgtgcaattctcagtataagccctttgtcgtttctrtgcctatttaaagtctcctaaaggtgtaattgactaggaaggatgtagttctacactgccatttacctatttaaattcatccttgtgaatatctttgttgttgttgttgagacagagtctcgctctgtcacccaggctggagtgcagtggcgtgatcttggctcactgcatcctccgccttccaggtttaagctattctcctgcctcagttgcccgagtagctgggactacaggcatgtgccaccacgcccagctaagttttgcattatcagtagagacggggtttcaccatgttggccaggctagtttcgaactcctgacctcaagtgatccacctgcttcggcctctgaaagtgctgggattacaggcgtgagacactgcgcccagcctcatccctgtgaatttcttattgtacacaagttctttcactatctgtgtgcagtgctctgaggggacagacaaggcttgggtgtatatgccaaccagatctcattgaagtatcagcttgtttggtactaggtgcaagtgtagcatgtcacatgtgaccatgttggatcattgacaatttttaggtatgtactgacctacatttatgatgaagatcctgagcggaggttaagatattaagttattttccatatgaatcagaattatattgattctgtgcaatcaaaacaaaaggcagaatagaatgctgagattggttaagtttgcaatgaccatcttgaaccacagatttctgctatgtgtcatcaaaacatctagttctgagtaacattttcacgattgttataaaattataggtgtgaacttctaaaataaaggaatgctaataaaaaaaaaaaaaaaaaaactcgag

SEQ ID NO: 2270 - DNA, 3129 bp, Homo sapiens
cggcacgaggggagaccgaatggcggggtgaggggagctactgcgtccggctttgcaggccgttcctttcagggttgccgcagcaatggcacttcatcctggcagcagccatttgctggttgcagtgccagtttcttggtttcttttttgcattcctggaatcagtttcatcactctctcttggagttaccaagagtcgccagtcagtttcctctccgtggaaggctgagtcccaattccatagggctctgtgccagacttttagtctctgataactccgaaatccttccttctgtttcctaagctctacaggtattctagtttttctcgcaatttttcattactaggctacatcagtgtcctttttctttctttctttttctcactttttatttgtacctttagtcctccaacaattaacaattccccatgttaaattctctctgtttaaacaactaacgggctctctgtattccaactagatctcggctgatgcaaatgccgtagacaatcaatcgatcaatcaatcagcaaatccaatttccctctagccactaaagggacttaatataattgaatgattataaaattctgatcccatttatctcaagccattgaaaatatttttcgtgtgattataagatacgtaattttaaaaaatgattttctaaatcaggattcttaccagattatttcacagcttattcactcattgattgctttcctcccacccttgttagcttttgtatgcctgtcctgcattttaaaccaaggtatgaggaggataaagtaaatagtaaatggtatgatagtggccaaaactttgaatctttttccctattcatcatctttgtgcaagttggtagggaggtccactaattcagcctccccattccctgtcccttcaaagtaaatcagaagcttcaggtaaaaagcagagaagctacccaagttcttttcatttattttatcatcatactaataattttgctttctgaaatgattactcttacaagcagcaaatatattttttaggaagttagaattattgatgtcacgttttcatattcagtatcccaagtaaatatcaggtaaattcaggaaaataaatacaaccattttcttggttaattgtttttaaatttaatatatgttcatttattcttttaaatatatatttcataaatggtgactatgtattccatgacataaaaactaagtatttttagtgggaaattctttgtggaatcactgaaatgataactagtgttagcaatacttctgtttcatgagacgagtcactttatgaagattgcaaattattttttgtcccctctagagttcatttcatgggaaatttaaattttattgtcttaactttaatgttaaacatttccttcacatatggtatggccagacatgttttcttctttgctgctattttacattttagatgtagtccattcaggatcttttttttttttttttaggagtcagagcttgaagtgatgcaacactttcactctttatctctgatttacatgctaataaagacaactgatagacaatatgatatactttggccctagaagatccttaatgaggaaattctgtggcctgttttctcttctgtgctattttttgtcttctaaggcaggcatttttatcagttcagtttgttgctgtgactagttcaaacttgttcagggctttatgcctgaaataagtaatcaattagcctatatatataaatatataaccaaccattacaattatctaagaatgtcagggagttgtgaagtggaaacaaattaaagagttgcaaaattaaaagagctcgtcttccaacagaagtgtgctgacatatattaaagaataaatgaattaaagtcaccaaagaggaacaggagttaaaaagaagaccattgtttagatggagtcaggctggtgcactgccaaggaaagcaaacaggatttctgaaggcttggtatgaatttcagcttgcatcattccgctggagggggtgatttccccaatatcatgttagatccatagcttgttcttgacagagtggcagtacctttcctccactgcactctcaccactagcatagatgtaaaacacagtaagtactcagaaactacttgaagagtgcagttatcagtagagatgatcgaaacatttgtttttctagggaatatttttgcctttcttcttccagaatcctctggttataatgtgctcactgctaggtcaccagtcataaaacattatgtagaggttactggtcattatcctaatatatttatcaaaaaatctggagtatatgaaactgcctttcattgtaacattagacaaaaacatttattctatcaaatacagacttaaaactgccaccaaattggaagaatatgatcttaaatttaaaaaaaccccatatacttaaacacaataatctatctttatctaccttcctaaacattaatgcatgagacttctcttaatatcatgaatatgcactatgatttttatgttacatctttttcttgtttccatttatgctagtgaaatttattagtatccttcattgaaacactattattttccatggaggaaaatattttatttcctttatgaaaagggtgctttacttctgaaatacagaattcattttgtttcggattctgtttgtttgttttcacatcaacttcattctaaatgttcattcaaaattatttttcagacttgagttcaggtgaaaatgttaatggaattaaaaagtagttagtcaaatgaaatttcaatatataagtcaaatttgaagaaaactgaattaataaaggattctaagtttataaagaaatcaaaattatgctttcaaaaatattatgtaactggagaaagtaattttattttgagatctctcatgattctttaatatatattttttcttattagtatgcaaccttttggtaacatatataggagacagttaattttggtaagactacataattcatacattcttcatcttgacatacatgatcaaatactttataacgtccactagccttgctcttgtccactgcaatggaaaaaaaaaaaaaaaaactcgagggggggcccgg

SEQ ID NO: 2271 - DNA, 532 bp, Homo sapiens
ctttgttctctttcttctacaccagcagtttttatttgcctgtttcccagagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatgtaggtttaatttcttgtggtatttgaggggaagttatgggagcactcttgaggtcaggaagtagcctcttgaggcccctttcccarggtgtggtagcagccagctcctgattgctccgagctgtacatactcagtggcagatttcctgggaagaagctagttgagtcagaasccagcatttcatctggagtttgscgtaacatttttagagtcctaaagaraattccatatttgctgttttctaatctcatacccacaatgctacttatttaataacaactgtttgactttaaaaaaaaaa

SEQ ID NO: 2272 - DNA, 728 bp, Homo sapiens
  misc_feature (526)..(526): n equals a,t,g, or c
  misc_feature (604)..(604): n equals a,t,g, or c
  misc_feature (668)..(668): n equals a,t,g, or c
aactcctgacctcaggtgatccgcccacctcggcctcccaaagtgttgggattacaggcatgagacaccgcgcccggcgtttttttttttttttttttctttcaggaatttgggctgggcatggtggctcatgcctgtgatcccagagctttgggaagccgaggcaggaggattgcttgagcccaccagttcaagaccagcctgggcaacatagtgagacactgtatctacaaaaaattaaaaaattagccaggcggctggacaaggtggctcacgcctgtaattctagcactttgggaggccaaggtgggcagatcacctgagatcgagagttcaagaccagcctgaccaacatggagaaaccctgtctctactaaaaatacaaaattagctgggcgtggtggcgcatgcctgtaatcccagctacttgggaggctgaggcaggagaatcacttgaacccgggatgcagaagttgcggtgagccaagatcatgccgttgcactccagcctgggtaacaagagtgnaactccatttcaaaggaaaaaaaaaaaattagccaggcatggtggcacagctatagtcccagctactcagtaggctgnagtgggaggactgcttaagcctggggtgccaaggatgcagtgagctgtgatcacgccactgtantccagcctgggtgacagagtgagactttgtccaaaaaaaaaaaaggaaaaaagaggaaaa

SEQ ID NO: 2273 - DNA, 798 bp, Homo sapiens
  misc_feature (341)..(341): n equals a,t,g, or c
acccacgcggtccgggactattttcgtaakaatatttttctgcaaactgatgtagttagtagatgtcattatactaatgaaaggacattagctattttattataaagtatgcaccagcactttgcagattcagtgaaactctaaaaatgtctttatctagcaacataatagaaaatactatgatagacatccaaccataaacaaattagaacaggcaacacaaatgcctttttcagtttagtgaaatagcgtacagttgcttagttgatggtgacgtggtaacatacatatgccgatctgtgagcatttcatttggcctctactagctttcatacctcaanttttgagttcaggtctcagagtttttctttcatttacacagcaaaaccaccaggaaagagactttaaaagagactatcaggcatgacaagatactagtgaatcaaaaacgtacttaaaaaataaagcaaacgaggccaggcacggtggctcaggcctgtaatcccggcactttgggaggctgaggcgggtggatcacgagatcaggagatcgagaccatcctggctaacatggtgaaaccctgtctctactaaaaatccaaaaaattggccaggcgtggtggtgggcacctgtagtcacagctccggtggtgtgaacccgggaggcggagcttacagtgagcgctacagatagcgctactgcactcctgcctgggcgacatagcgagactccgtctcaaaaaaaataataataaaaaaaaaaaaaaaaaaaaaaaaaaaaaaaaaaaaagggcggcc

SEQ ID NO: 2274 - DNA, 1367 bp, Homo sapiens
  misc_feature (15)..(15): n equals a,t,g, or c
  misc_feature (28)..(28): n equals a,t,g, or c
  misc_feature (480)..(480): n equals a,t,g, or c
  misc_feature (796)..(796): n equals a,t,g, or c
  misc_feature (896)..(896): n equals a,t,g, or c
  misc_feature (1243)..(1243): n equals a,t,g, or c
atgtatagatcatanaggcaaacggtanctgacagtaccggtccgaattcccggtcgacccacgcgtccgtgtttctactctttgactattatgaataatgctgctaagaacattaatgtacaagtttctgtgtggacatatgctttcatttctcttattttcattttattccacctaggagtggaattgctgggttgtatggtagtgttatgtttaactgtttgagaaaccaccaaattatttttgttttctttttaagatgaggtctcgctatgttgcccaggctggtcttgaactcctggcctcaagtgatcctcccacctcagcatcccaaagcgctgggattacaggcatgaggcatgccaccattacacacccggccagccaccaaattattttccaaagcagctacaccaccttacattcccaccagcagtgtatgagcatcccatctctctacacctcracagtaattttgngtctgtctaatttactatagccattctagtgggtaagaactcacacacacttctgcttcttcttggcaatgcatccatgtggagccatgctggggctttccaggactggctgactttcacctccacttgtagaaagaaggacatatctggcaatactgtagccccagagcttggtccagggcctagaactaaggatgcacccctgaatggctcctggatggataatgggctgggtgagggaggtacatggtgagggggatactggtttcagtgcaattggagctcagtgatatctgaraartctgggggctgggangggagatgtgcatatctaaggacaccacccaccgtatgatagggtwtagaagargcagggtaacctgtgtaraaatcagctcccarcctcctgctcggancttaccctcaaggaatgcagaacccctgtgtatccctttctcctcctgatatagtttagatatttatccccaccaaatcttcatgttgaattgtaatcccagtgttggagatggggcctggtgggaggagttttggtcatgggggtggacccctcatggcttggtgctgtcctcactgtagtaagttctcacaagatctaattgtttaggtgtgtgccacctaccccctcccactctctctctcttttgctcctgcttttgctatatgaggtacctgatcctgcttcaccgtccaccatgactgtaagcttcttgaggcctccccagaagccaagcagatgccagcnccatgcttgtacagcctgcagaaccatgaaccaattaaacctcttttctttataaaaaaaaaaaaaaaaaaaaaaaaaaaaaaaaaaaaaaaaaaaaaaaaaaaaaaaaaaaaaaagggcggcc

SEQ ID NO: 2275 - DNA, 921 bp, Homo sapiens
ccacgcgtccgaccatgccaaatttcttgtggttccctaaatgcgccatgtttgaagatactctgaggacattgtatatacttttgttctacctgagatacatttgcttactttctccacatattgccctcatgacacttatccttattgatggatttcttcaatgctactattgtgccttacatgtgccttgtattatagcatttttatagcatttctcacccaattgtggctatttgtttacatgtctgtctccttggtggaactgtgaactctgtcataacagatgccattttatgtcagttagacttctttggttgccagtaagagaagctgactctaatctaaaccaaaaggaattcattggacggatgtgggttggctcacaaaatcaaagggacaactgcggaccgatcttggaatgatgctctgacaccagaacagctctgtgaattcagataggggtagtgaattgaccatttcatcaaatgctgcagcaagctaggtggtttccccaaaggaaattgaggagtgttacaagaagaccattaggggaacggttatctggtggctgataataacaaatttccatggcagtctctttgctctctgttggaagaggtactccaccatgggccttgagcatctctacacatccttgctaagcgtgtcaaatttcaagtcctaactgtcctctgtctctggaggaggagacaggtttggttactgtttgttgtaaaaattactgagcccttcaccatgggtgcctcagctgtatgcaaagccccttgtattgctgggggacagagcaactggtactgccatgctggtgctctggctgtttgctgttggcaataaactattctgttttggttcaaaaaaaaaaaaaaaaaaaaaaaaaaaaaaaaaaaaaaaaaaaaa

SEQ ID NO: 2276 - DNA, 843 bp, Homo sapiens
  misc_feature (14)..(14): n equals a,t,g, or c
cccacgcggtccgnatcgtccttccctcacttcagagggtggccagagctgaatacccagagagggacaagtaagggtccagttccaaaacatcatgaggatgtatcatcccacgtgtctcacctgacagttacagaggaaacccgcacccagaatgcacgtgctgtcttatgggaacactcagcgcagagtgctcaggtccggccacactcgggctgtgcttggtcgtgccatggaattcctcaggactttctcagcctccctaatggcagaagcccctttacagcaagacatttaccgtttgtctgaaaatagccgaactgagcttttcttcaggctatatgagaagtctctagacagtgggcaccgtcagaaagcccagagccttgtgatagctcccaccctgcctggctcagatcttcccattttttttcctctggcactaacctcaccttttgtttttttgtgtttgtgtttgtttttgtttttgcagagttggattacagaaactcctatgaaattgaatatatggagaaaattggctcctccttacctgtaagttcgtctgcctcgggccacttaggggactcgctttcctgccttcaggggcctcctcccctgtgcagagtgtctctgggagctcagaccccaaatcgagtgttttctgtgtacacagcttcccgggtgcacagcaatgatggactggggctggggggttgaggtttgtactcaatccacttcgtttgacattttcagggagaaaatgatagaatacaattagacgtcctgcagaattactttcctagactgagaaagagctagagatttctttaaaaaaaaaaa

SEQ ID NO: 2277 - DNA, 2308 bp, Homo sapiens
aattcccgggtcgacctgctggtgagccgcttgcgccaacgcttgctggatgacgcccgcgaaccggcctatatcaagaccgtgcgcagcgagggttatgtgttttcactgccggtgcaaatcctcggggccgagcaatgaggccatggcggtttggctggccgcgcacactggcgtcccaactgtcgctgatttttctgatcagcctggtgtgtgcccatgggttgtcattcagtgcgcagttctacgagcgctatatcagtgcgcgcacggtgatgctcggcaacctggaaaacgacgtgtccacctcggtggccatcctcgaccgcctgcccgccaacgaacgcgccagttggctggcgcgtctcgaccggcagaattaccggtacttgctcaacgccggcgaggccggtgaaccgatgactagcaacgatgtgccaatggccgccacctcgattgcggacgcactgggcgagcattacgccctgacctttcgcgatattccaggcatccagaaacacttccaggtgcacctgaccctggccgatggcaacccgatcaccctcgacgtacgccccgccgccctgcccgtagcctattggttgccggtggtgctggtgctgcaactggcgctgctgctcggctgcacctgggtcgcggtgcgcctggccgtgcgcccgctgacacgcctggcccgtgcggtcgaaaccctcgacccgaacgctcaccccacacccctggacgaaaccggcccgagtgaagtcgcgcatgccgccgcggcgttcaatgccatgcaacagcgcattgccgaatacctcaaggaacgcatgcagatcctcgcggcgatttcccatgacctgcaaacgccgatcacccgcatgaaactgcgcgccgagtttatggacgacagcgccgaccgcgaaaaactgtggagcgacctgagcgaaatggagcacctggtacgtgaaggcgtggcgtatgcgcgcagcgttcacggcgccaccgaggccagccaccgcattgacctggacgcctttctcgacagcctggtgtttgactatcaggacatgcaaaagcaggtcagcctgcgcggcaaaagcgcgctgatcctcgacacccgcccccacgcgctgcgccgcgtgttggtgaacctggtggacaacgcccttaaattcgccggcaacgccgagctggaagtcggctcgacagccaatgggcagttgtcgatcaaggtgttggaccaaggccccggaattgccgaagacgaattggcgcaggtgctgcagccgttctaccgggtagaaagctcacgcaatcgcggcaccggcggcaccgggctggggttggcgattgcccagcaactggcggtggcgatcggcggcacgctgaccttgagcaatcgggttgaaggcggcttgtgcgccgagattcggttgagtctttagcgcactgttctgtggcgagcaggcttgccctgcgttgggctgcgcagcggccccttccagttgatttaccgcgccgtctgaattggggcggcttcgccacccaacgcagggcaagcctgcttgccacattgaatgcacagctttaataaaatttacgcatgataattctgctttttataattaggttagaaccaacaggcattttacagaccccgccacggcccttacttttgacccgagtgaccgaccccacgcccggaggaggtgttaatcgcgcaatcgacaaggacagaccatgagcatcgaacttatcggttatatcggcggccatcacgcttccgagattcacccgcgcagcggccctaccctgcagccggactacgtcgaaaccgtggcccgcgcccacgaagcggccggcttcgaccgcgcgttggtggcgtttcattccaacagcccggacagcacgctgatcgccgcgcatgccgccagcgtgacccaaaagctgcagttcctgatcgcccatcgcccaggttttgcccagccgaccctggccgctcgccagttcgcgaccctggacgtgttcaacggcgggcgcacggccgtgcatatcatcaccggcggcgatgaccgtgaactgcgtgccgatggcagccatatcggcaaggacgaacgttacgcacgcaccgacgaatacctcagcgtggtgcgccaggaatggacccacgagcagcctttcgattttaaaggcacctactaccaggtcgaaggcgcgcactcgacggtgaagtcgccgcagcaaccgcatatcccgctgtacttcggcggctcttccgcggccgctctagaggatccaagcttacgta

SEQ ID NO: 2278 - DNA, 1048 bp, Homo sapiens
cccgggtcgacccacgcgtccgacaaaaaacaaggtatgtgtgtgccttgggatgcttttctgggcttaccccatctgtgtcttcatagattctctgtcctgccagccatgtctttggtccacaggagccacttcccacttcaactctcccacaacctccccactgtttactctcttcatgccctgtgctcttgccccaaatcccttcacccaattgggaaaactggatgatagataagtagtttcttatttacatgcatttctctggaaattaaagttgctttccagctagtatttcctcacgtcggaagcatgtgtaaaataacacatggaaactatttccacctggcacataagaaaaaaagggtctgcctatattgtaactgacttctacactttgcatgttttagtctgacccacaatttttttttttggatagttgaagtaaaaaacgtggttacaagatgactaaagtttggcctacaatttcctgtttggacaacaggaagaattgtgcagtgttttgcaacaggactaattctagattctcactgcccttaaagataactagagggaaagggtcttctctttctttttcatttattaaagatacttacaggttcttcagaagaagtgatgggtcctttaggtaatgaaataggtgttgatggtgttatgggtgatgatgtaactggtggcggctgtataaagtcttcatccttaaacatcagaactgagagttgggttactgatttaaaagaaaatgtgtattaatctacagtccactaccttgactaccaggaacttgtcacaactacctcatatcctggcacaggattcaaaaggcaaaatctggaacctaattacgtgtagccaaatattaagcttcctcttagatcaaacagtacaataaatattccttattaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggcggccgc

SEQ ID NO: 2279 - DNA, 907 bp, Homo sapiens
  misc_feature (455)..(455): n equals a,t,g, or c
gggtcgacccacgcgtccggcaaagatcatttcagtctcgggcttcttcgtgggaacttgacttgccgggtagctccccctggggttcagatctctgttcattgtttctcttcaagccctgggaagtgccatgttatctggaaagctttccctaacatgttctgtctgcatttatacttcacccatgtgcccctcaactattcatcatagccctagtcccaccataatgaaaatgtctctcattatttttctggctggcccacgagcctgcaagtccttataggcgccaactaagtatcattcatccctggatgctctcccactagacgtttattgaatgaagagtggaggaatgaatgaagcaacgatggctttctctgtgctcatccttccagtgttctacgcacagattaggaacaagagtttcctttgtctttctgacattctyccattantcctcatcctcctcttttgatagactcaaggtttacccaattggtgaatctctcttctgagccttctcctaaactaatttgtccccagaatagcaccccttctccctctctgtccttaccaacacatgcttctgacagtccaggttccacctctgaaatgtcagctaaaactcttctcattcaggcagtgttccctgtccagaaaagaggcagcactttctctcttgctctatttgaattaaacatgcagttgccaggagtcacctgaattcacactctacagcatactctttcttcccccttgattcaagcatgatgtaaaatgttatacattttttttcaagttgtaaaagtattaattcatttgcatcgatgacttatctttgtcttgtaaatattttgataatatctaaggactcttctagttctaaaaaaaaaaaaaaagggcggcc

SEQ ID NO: 2280 - DNA, 362 bp, Homo sapiens
  misc_feature (1)..(1): n equals a,t,g, or c
nttaacgtgctgcttaaatccacgatgtgaattgtatgttagtgtgaatgtttccgagagtagaattttttttccttttgagaacctcagtggcattgcctgctcttgccctctctgggaaggacagcagaggggacactgctgtccctgctgtgacaatgtgcagtgatcacagggaggctttcaccctccaccctaacagtcagtcccagctgagccaacccaggatctggttttctgtatatcagatgcacgatgcacacaactgttttattaagcatgaaacaaaaccaagaagtataacagtgctttacagttcttctcttaattctggcctcgtatgatcttatcatgtattaacc

SEQ ID NO: 2281 - DNA, 2095 bp, Homo sapiens
  misc_feature (14)..(14): n equals a,t,g, or c
cccacgcggtccgnatcgtccttccctcacttcagagggtggccagagctgaatacccagagagggacaagtaagggtccagttccaaaacatcatgaggatgtatcatcccacgtgtctcacctgacagttacagaggaaacccgcacccagaatgcacgtgctgtcttatgggaacactcagcgcagagtgctcaggtccggccacactcgggctgtgcttggtcgtgccatggaattcctcaggactttctcagcctccctaatggcagaagcccctttacagcaagacatttaccgtttgtctgaaaatagccgaactgagccttttcttcaggctatatgagaagtctctagacagtgggcaccgtcagaaagcccagagccttgtgatagctcccaccctgcctggctcagatcttcccatttttttcctctggcactaacctcaccttttgtttttttgtgtttgtgtttgtttttgtttttgcagagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcrggaccrctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttygtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaawaaaaaaaaaaaaaaaaaaaaaaaaaaaaaaaaaaaaaaaaaattc

SEQ ID NO: 2282 - DNA, 355 bp, Homo sapiens
cggggtcgacccacgcgtccgggaagctacagccagcttggtaattgacagccctgactatgaccttatatttgtgtctcctttttccttatttcactttttttcccctctcagccttgttgcccagagattgtaccccccaacaaataattaattatcactaaggtttgccttggcacatccctttggcggctttgccagcagacgcaagcaggtaatgtgaaccagacaccgtgctaggtgtgggacatcaaatggtgaacaagacagatttttgcccgacccttatgcagttttcgacctagtgagagagacaggccatatgctattaaacaacaataaaaaaaaaaaaaaa

SEQ ID NO: 2283 - DNA, 628 bp, Homo sapiens
tacagcagtttaaaaagcagtgtctttctttgagagacaggaagtctagtgaagagccagtattttagggatagataatgaaagaggctgtcatttcagacattttaatcctctgaaagaatacaaaagaaaaaaaaaagaaaacaaatctttcagaattgtttgaagtaagaacaagacaagaggaggtgattggtgtgttactgttctacgaaaaaggagaaaaagcttcatgaaatcgccattcagcaaggacagaactggagatggcttctcttttacaaagaaatctctgtcccaggctttcagtctgtttggtgttcatacaagtgtttgtgtgttgtgtggaaggcgggggaaggcgggtgaaggcggtcctgttcagggccccctttggtgaacacagcaggcaaaatactctcgtcatccccagccaaactggcctgcaagcgcactgacttccacatccctagcatttaggcctttgaatagaagctgacacgtagcagccagctgaacaagtatttaatgaggagcaacacaactccaagaagggctccttagtgtattgtcaagttgctgcagccttgtgagatggaaaaaaaaaaaaaaaaaaaaaagggcggcc

SEQ ID NO: 2284 - DNA, 558 bp, Homo sapiens
agctctaatattactcactwtgaaggsaaagctggatacgcctggcaggtaccggttccgggrattcccgggccccatcacaccctatgggggagagcgaatgttacaggaggctttctggtgcctcgtgcacatggactgtgcatgtggattttgcctaaggtcagccttatatgcattgtggaactagggtatggaaaaccatgaaacatgattattttcttctagcatgcctgtctatgacttcaactggtggtattctttgtactttataatctacattatcattaatacctacatcttcaagtctgtctttctggccatggtgtacagcaattataggaagcattttcacatactgtgtgtgtgtgtgtgtgtgttttgtagtgatgaacagaacttgttatttacccaattctattatctatcataatagtaaattagctactataatagacaaaagtatgactctcagttaaataagagattttttaaaaacttgttacaaaaaaaaaaaaaaaaararaaaraaaaaaaaaaaaaaaaaaaagggcggcc

SEQ ID NO: 2285 - DNA, 614 bp, Homo sapiens
ggtcgacccacgcgtccgacctccccctcctgggctaaagtggttctcagctcactgcaacctccccatcctggctcaagtggtctcgtgcctcagcctcccgagtagctgggacaacaggagagcgccaccaggcctggctaattttgcatgttttgtagaggcagggtttcaccatgttggccaggctggtctcagactcttgataaaataaatgattaattgtggcattttggttttcaaaatgagaattgtgtttaaaatgcaaaagagggaaagaaagttatatgtaatcttcctatatttagcttttattttacttcattggcagtctgggtaaaaaattcatagaagacagaagacttggtttctagtcttggcctgaaacttttagctgtcacaactgggggatgctgttggcatctagtgggtggaggccagggatgctgcaaaacattccacagtacacaggacagcgccttacaggttgaaggtttatacaaataatattaaagctctttttttatattaatgtggaaaaatgttattttggttcccatgagaaactgctactatttgaaatttaaaaaaaaaaaaaaaaaaaaagggcggcc

SEQ ID NO: 2286 - DNA, 916 bp, Homo sapiens
gtttgtgtaaccatgttcttcagaatgcaggtatgtgagcatcatggtttctgggtaattctgctgctcctgtctttgaaaatggagataccacttgcagcttatcccactgctgagtattccagcattggtagtggtttcactccattgcatccatccagaactttcacacaggcctccccattacccagcattttttaacattgatcaataaggcctataaccagatttaggctagcaacaccagaggtctgggggcaagggtggaaattgactttacattcttagtagctaatattccataagtgctttatatatatattgttgttattgatcatctattcaaaaaatatatattgagcagctgctgtggtataggctctgtgctggccagtgaagatacatgattaacaatgttgtgcttgcttggttcacagtcctgtgggtacatggtggagtaaaataagtacaattaatttctcagagctgtgcacagcaacacacagaaggagagataactcacccagcttcagaggggtgggacagagaatgaggttagcctcccagatgtccttgtgctagttttagctgttttcaggtgttgataaaagctccaggagctggcaggaggagagcagaggaagctagagcttacaaagcacaaaggccatgacagcatgccagacgggtgaaagaggacaggggaaatgtaggcaagtgtctcttctcagaggatgttatatactatgtttaaaagtgttgatctgctgggcacagtggttcacgcatgtagtgtcagcactttggggtgccaaggtgggaggattgcttgagctcaggagtttgagaccagcctgggcaacatagtgagaccccatctcttaaaaaaaaaaaaaaaaaaaaaaagggcggccgc

SEQ ID NO: 2287 - DNA, 989 bp, Homo sapiens
ctggcttggctgctatactcttgcccttcactgaacctcagttttcctcatctgaatagttgggagactcattcctgcctttctcatgtccctggctatttggtaaaccagccagtaggaagacatcgtgaaatgtattaaagtggtcttagctagacagagtgggcatgccagggtcagcagagattctgaagtctagaccagttccctgggtgggccgttgtcagtcctagcagatggccaggtcagccctcaggctggaaattttagggcagctattggtaggtgtctcctcttgctgtgctgagatacggtcaagatcatacttaggcttttgttggaagaacatacaagacgagagaaaaaaaaagatcatacttaggggctcccggaatttgctctgccctaggttgctgagacctctagaacctgtgcaggctaaaggaactcagtcggtagatccgagagaggtggtcagggagaccaggagcatgtctacactgccagcagacttttgcctcctcccccaagccagcaggatggcccaaaaaggctcccccagcagatcatctttgcagctccttttttagctccagtggcagcagggatgaggaagggaaagttctatcatttttttctaatttaaaatgacatttaaaatcactagcctagtgggggccaggtgtggtggctcatgcctgttgtcccagcactttgggaggccaagacgagtggatcgcttgagctcaggagttaaagaccagtctgggcaacatagcgaaacgccgtctctataaaaaaatacaaaaattagctggatgtggtggtgcacacctgtattcttagctgcttgtggggctaaggcgaaaggatcacttgagcccaggaggtcaaggctgtagtgagctgtttgtgccactgcactctagcctgggtgacaaagcaaaaccctgtctcaaaaaaaaaaaaaaaaaaaaaagggcggccgc

SEQ ID NO: 2288 - DNA, 392 bp, Homo sapiens
tcgacccacgcgtccgcccacgcgtccggagggaacttaaatgatattccccttttccttttccctaataaccttcctgccagattttcaagtaggcaatgataacagcaggtgagatattaggaactgtgactacgaatatgtagatggagatgtgcagaaggatccagagacttagagcaatgcttcacatgcttttggtaagcatgctccctactgtgggtaaaccaaacatgtaccaacccccccagaattatgatattctactgcagtaaccagcctcttcttttaacatcagatagctaaaggacgttatcctcaaagtcatggaaaagcaggaagtttttcatgacaaatcagtttgccatagtacagttaaaaaaaaaaaaaaa

SEQ ID NO: 2289 - DNA, 1882 bp, Homo sapiens
  misc_feature (755)..(755): n equals a,t,g, or c
  misc_feature (1237)..(1237): n equals a,t,g, or c
  misc_feature (1866)..(1866): n equals a,t,g, or c
gcaagttttgtgtttggccctcaataaactagtctctctgtacccctggcagggggtgggaggagtcctgggggagctcccttccaaatcttacagggtggtctgtttcttctttggataataatgatgtaatggctagtctcttgagaacttgctgtgttccatacattgtactaagcatttatttggattatctcattaaatcttcacaatcactttatttaacagatggagaaattaaggcacatggaacctaagttgttcaaggtcatggagccagtaagtgttagagccaagtcgtttggctccagagcctgtgttcttaactactactttgtagtgtctttcttacatattagttgggcctgtgtattgctagttgaattcctcttcccagtggcaggccttcacgtgtttgaccatggttttcatgttctccaaacctcagttctctagatttgtactttggtaggtcatcattttccacagatcctacctctttaggtcagaaaatcttgccagtttataaagattctctgggactaactcccacaaagcaaggtcacaagagatcaatgtacaaatgaagcagttcagtgagtttgtctaccattctccataagtacatgggrgacamctgatgattggaaggtttggttcacctcatgggagctgtgatatctcactcaccacacagatctgctcttctgagggaccatcttgccaatttccagagagttgcagggatattaaanttttgcacattaagcttcctctttccaagctgsacatgggscctgctaccgkttgtgaamagtcttctagagtgatawaggttctagctttcttagttaagatcgtattttctgataccactcccttgtcactttgcctgaaatgagaaactcccaacctcaactgcttttctagtctcttccaatgaatgccttccaaagggctggtgtcctccagggtgtattagttgttactaatttcatcctccaaggctgatctgattttcaagatctgtagagagaccttagtatattgccttgcctgtaccaaatmcagtcattatggcmcaggaaaatctcaaatmccttattggaaacccaggcaaatatttatttgaccttaatgaaatgaaaaagacattggatgcatacatttaaagaaaacccaaaactttggaatctttaccaaggagggtatcttttgaaaaggacagkctggaacnaagaacttgataaaatagaagtaaaggttgacactttttttttttttttttgagatctatatcactctgtcgcccgggctggagtgtagtggcgtgatcttggctcactgaaacctcggcctcctgggtacaggtgattctcatgcctcagcctcctgagtagctggcactatgggcatgtgccaccatgcccagctaattttkgtgtttttggtggagacagggttttaccgtgttggctagctggtcctgacctcctggcctcaagtgatccacccgacttggcctcccaaagtgaaagtcggcattactagccctgttcagcacatgagacagggcactggatggtgtctacctaatgattttcaacccaggggcccttggcccaagcgtatcactggtataaagggcctctgccagctaatgtgagggtgagtgtggctgttgtttccatgagagaactcctgggagttctacactcagcaaacgtttgttgttggactatgaaggcggacacagattttatacgaatttgtaatgctaacatctagcataagaattggcaaccatagaaaatactacgtgtatatatatgtttatagtctcaaaaaaaaaaaaaaaaaaaaaanaaaaaagggcggccgc

SEQ ID NO: 2290 - DNA, 1321 bp, Homo sapiens
ggcacgagcccaggagtgcagtggtatgatcatagttcaccgtagcctcaaactcgtgggctcaagtgatcctccagccttaacctcccgaatagcctggcttataggtgcacgccacacacctgactgctcagtatgtaaatttttactatgcctaaggttgaccaccttttaatatgtttaggagccatttgtatttccttttgtttcccatattgttttgttcctatccatttttctactatatcgttgatatgttgtttatttgttagggatatgaaccctttgacagtaatgagttgcaaatattttctttccaatttgtcatctgtcttttgcttatgatggctttgtcatgagttttaaaaaatttttatgtagtctgaattaccagtttttttagtggtttctggattttgagtcataattagaatgtatttctcaatccagagcaatagagtaattcacctaaattctacatctaaattttgaacctctgaagcatattctggcataagatataagttatggatctaacctaattttttccgcaggtgattaacccagttgttccaatattatttattgaactgtttgttttttcctgacgagtttgagaggctacattgatcttatcttagaatccgtcatatgtatttagctgtgtatctgcttctgtttctctgtatctgtttctatttcattgctctatttagtcatgcactagtaccacattgttttaattacccaggctttagttttaatctagtgcattggtcctccctcattcctcccctgcccaccttttttttttttaacagtttttctaactgttcttatttttccatatgagctttaaaaaattcttaacatatagagcatactaaaactgtccaactcaagttctctcccaagggttgcacttttaaccacttattttgtcactgttcttttgatactttacctgataaagatacactttttactacttttaaattattacagtgttctatttggcagtgcccaaacaggtgatggcagatagaggcaggatgcaatgcctgtgtggaaagaatgtcatctcagtgcttctattttaagatagtctctaggaatgatttaaggactgttctcatgtaaaatccctatttctttttttattccattacgaattatttgcccaaaagttggatatctgtcaaagattcataagacaagagggagagacccttaaataagtactaaacttgtaaaatcaatatgtggataaaagtgcaagtacaagaagttactttggaaaaaaaaaaaaaaaaaaaaaaaa

SEQ ID NO: 2291 - DNA, 489 bp, Homo sapiens
ctcttaggctttgaagcatttttgtctgtgctccctgatcttcaggtcaccaccatgaagttcttagcagtcctggtactcttgggagtttccatctttctggtctctgcccagaatccgacaacagctgctccagctgacacgtatccagctactggtcctgctgatgatgaagcccctgatgctgaaaccactgctgctgcaaccactgcgaccactgctgctcctaccactgcaaccaccgctgcttctaccactgctcgtaaagacattccagttttacccaaatgggttggggatctcccgaatggtagagtgtgtccctgagatggaatcagcttgagtcttctgcaattggtcacaactattcatgcttcctgtgatttcatccaactacttaccttgcctacgatatcccctttatctctaatcagtttattttctttcaaataaaaaataactatgagcaacaaaaaaaaaaaaaaaaaa

SEQ ID NO: 2292 - DNA, 2845 bp, Homo sapiens
ttttttcaatattaaattttccattcttgaatattggtacctcagtgattagtgaatgaaaaaaatgtagggtgggtatgtcttacaatgagtaaaggtaacaattaaattttgtctgccagtgcctgtgtagataagtatatttgtcttcatctctagtttttgaatgcatgctatcttttccttttctttaaggcctttgcaagcaaacttttgtttttatttaaattctaaatttgataaattatttcagatttttataatttggatacttttttcaggtgaatgaaagaatggtttactttagaagtccctttttccttacagtaacaagttgaatctacttggaaaattgagaaatggctcaaaagagataagaaaagttgatggagccgggaattgctggggtttagatgcactttttcttttgagagtaagggaagttttggaaaagaatagaaaattagtgtaagttgatatgattttatttaatcaaaattaactgctacgctgcgaagaacagcttttacaaagtagctgaatttgtttttcccacttgatttggattcacattgctttcatttcttaaaatgcttccacttcaggttcttggtcttggaaataaatttcaaggtgcattgtatccattttaagctgctttattttattttcacttgtatgagcaaattcttgggggagctttgcttttcttctgccagaaaaacaaaagggggaaatgaaaatcttttttggaatgagttctgtgggttttcttaacagccaccatgtttattagttacattgtgttttggccaatcagtgcaatgtaacaaattttacagttaattgctttcaattgagtcagtaaacctgtgatagataatttatttaactggaaaacctaggtacccataagaaaaaagattcattctctgtgaaaactgtaggaatctgttgttgttttcatttgaatatgctctacttctgctctagtatttggtttggaatatattttgtggctctaattactgtatttttaaaaaccctacctccattaacagttggtaaaggccccttttcaggaaagtttgttgctttttttttttttttaaagggaaagctgctctttgctcagtatagtgttttgaaagtggaacataggtaacaaatactttaaaaataaagatacacaatttatatttgaaaataaaaactttctgctggtgggattatttatagttctttatttttaaagaaaatgttttcctttttatattgctcttgaaagtttaatgagcagaatacaatactggttataataaaaatatggtaaccacacagtactcagcctttcaatatgtttttggtcaaacttcatttaggcactagcatttagaagaataccaatcacagtgatgcttttgttatttaatatgaaggaaatggaactaaaacatttatgtcatcaaattttatttcacttctttatatttgacttgctggttgatacataatggttgatgaacatatatttgcttaaatcactaatagggatggttgtaaagtagatagatcattggttcaaccattttagtgtttttgccagattgtcaatgaaaccatcatactgaccttttcctccaaaattgccaaattgactgaactggttgggtgtttgtaaagatgacgttaactgtgtgactaaaaagtcagatggttgccatattgtttggaatatgttgaatgtcagtgtatgccttatgtctttaattgggtatgcaaaaaaatttttacttaagtagattaaaattttaacctctagcatgaaaacccagcaccaacactgaaagactccattcaggttgaagtagcctcaaacagtaatttactttttgataataggctgttgtttttcttaaataagcttaaaacaattctatctgaaattggtagcatgggttcacttggctacaactgagcaaaatagatgcaactttcttttaatggggtgctgcctctttaggactgactgtactatccactgacactggtttggcagttggtactgctgaacatttttatacatgctaccatgaagctatatatgttagtattgaagaagctaacgggtatactatcatttttgatgtgtgggctgattataatttcctgtatttcctgtacattgggatgaaactactttagcaaagtccacagatcagaaaccagacggtagtttttgaagttgaaaccagcaaattaagaaaagataaaaaatcgattttaatattttctgcctctttcccaaattacccttcccacttgctcgacaaatctatgtaaagcagtttgttttttcatgttttaactttaccttgccctgtgttatggtactggctgacatgtctaagactggatgtgtatatttattatggtgtctaaaaatcatgaagttcatcacttttcaggagtatagataaaatcaaattggtagtacatcagagttacttttcagtgcaccatgacatcactaaaatgagtgctgtaatgttacagggctttcaggtttgtaaaaacataaccataaattatattgacgtcagatatgagttgagtatctataaaatatcacgtgtatctcaaaatattggactgctgtttgactggatattgctgcataattttcttctattgtcccatatccttttggagagagatttaatgggatttgaaatgtgcaagctgtctaaataagatgcagtcaaataaagtatggttaagttgtgtttgcatttttcttttagatacagctgtgtgcattttatgattgggttgttttgctttt

SEQ ID NO: 2293 - DNA, 1443 bp, Homo sapiens
  misc_feature (1435)..(1435): n equals a,t,g, or c
ggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaaaaaaaaaaaaaaaaaacttccggggggnggccccgt

SEQ ID NO: 2294 - DNA, 575 bp, Homo sapiens
gaattcggcacgagatttgtgaggcctcagctcacaaaacctgaatcagggtccaacagcatctgcctgtttttattctgcaaagctgagatcaagttaaaaggatgatgataatcacttgtttatctattcactcagcaaacacttatgggacatttactgggtgccaggtcttgagctgggcactgagatgagaagctgcctgaggcatgatggtcccatcccactgccctccagggctcaaaatactttatagtttacaaagtgttttcacatgcaattttgtgagctgtgggtgccattattatccacattgcttaatacatggcagaacctgaccttaggttgtccaagtccagattctaagtccaagtccagtccagatcctagagcctgtccactctttccttccttcctctctttctttcttgttagttctttctttttctttttctcttttttctttctctctctttctttctttcttcctttcttctttctcttttctttctttctctctctctctctttctttttttcaagaccctgtccaaaaaaaaaaaaaaaaaactcgag

SEQ ID NO: 2295 - DNA, 635 bp, Homo sapiens
  misc_feature (1)..(1): n equals a,t,g, or c
ntggaatgtagtgaaaacgagatgctgtctcttagggactaaggaagctatctttcctcttccgacatttgctgactggtcgatgctagatgatcttgagaccctgtgctgaggactggagaactacaggaaaggagcagtatctctgaattatcgtgtggaaggtcacttgtctagcccctgatgactgtgagcctcttcctcctgcttgccacctctcagtcacaagacggctgctgcgactcaggctcatgtcccaattcaaggcagcaagaaggccatggagcggcacctgccagcagatgcccctgcaggccatctctccaggctcaggaacctaaagaagaatctacccagatgtggtggctcacacctgtgatcccaccactttgggaggctgaggcaagaggatcacttgagcccaggagttggagaccaacgtaggcaatacagcaagactcccatctctaacaaaaaaaaaaaagaaagaaagaaagaaagaaaagaaattagctggctgtggtgctgcacatttgtaataccagctactctagaggctgaggctggaggatcacttgagccgaggagtgagctatgaccacaccattgcatttcagcctcagtgacagagcaag

SEQ ID NO: 2296 - DNA, 761 bp, Homo sapiens
  misc_feature (166)..(166): n equals a,t,g, or c
gaattcggcacgaggtagagacgggggtttcaccatgttagccaggctggtctcgaactcctgacctcaggtgatccacccgcctcagcctcccaaagtgctgggattacaggcatgagccaccgtgcccggcctatgattctttttttttttttttttttttganacaaagttttgctcttgtcacccaggctggagtgcagtggtgcaatcttggctcactgcaacctccgcctcccagsytcawgagattctccctgcctcascctccgaagtagctgggattacaggcgcccgccaccatgcccggctaattttttgcatttttagtagacatgaggtttcatcatgttggccaggccggtctcaaactcctgacctcaggtgatgcacccacctcagcctcccaaagtgcagggattacaggcatgagccaccatgcctggccatgattcttaagagaattgactgggcctcatgaataaaaaaattagaaaatctggtcatttgcatttgtcactcaatcactgtggaatcccatttcccgagtgcatttcatgaagcagatgggactactgtatggaaaaacatttggcatgtattccaagtgtcagattattctgtcttggtttgtatgggaaaatctgcgggttgtggaatattaggttctacttcacacacaaaaaaaaaaaaaaaaaactccaagggggggcccgggtacccaattcccccctataatgagtccgtatttacaatcccct

SEQ ID NO: 2297 - DNA, 504 bp, Homo sapiens
tcgacccacgcgtccgccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaargctacatggtggtgctccggcttgcgacgggcttytyccaccycctcacgcagagtgcagacatgggcc

SEQ ID NO: 2298 - DNA, 1667 bp, Homo sapiens
  misc_feature (1)..(1): n equals a,t,g, or c
  misc_feature (1617)..(1618): n equals a,t,g, or c
nggctgaggagccgggagtccgccgcgccggctcggggctgcgggatggggagttagcgccacggcggcggcagtggccgcagcgcaccccgccgccgcccaggagcccgtccagccaggggtgccgggcccgcccagcccgccccggagccaggcccgcgggcggcggcggagctgggcaggtggatgcggctggaagatggcgccctcgggcccgggcagcagcgccaggcggcggtgccggcgggtgctgtactggatcccggtggtgttcatcaccctcctgctcggctggtcctactacgcctacgccatccagctgtgcatagtgtccatggaaaacactggcgaacaagttgtgtgcctgatggcctatcatctactttttgcaatgtttgtctggtcatactggaaaactatctttacattaccaatgaatccttcaaaagaattccatctctcttatgcagagaaagatttgttggagagagagccaagaggagaagcccatcaggaagttcttaggcgagcagccaaggatcttcccatctataccaggaccatgtctggagccatccgatactgtgacagatgccaacttataaaaccagatcgctgccatcactgctccgtctgtgataaatgtattttgaagatggatcatcattgtccatgggtgaacaattgtgttggattttcaaattataagttctttctccttttcttggcttattctctgctctactgcctttttattgcggcaacagatttacagtattttatcaaattttggacaaatggcctacctgatactcaagccaagttccatattatgtttttattctttgctgcagctatgttttctgtcagcttgtcttctctgtttggctatcattgttggctagtcagcaaaaataaatctacattagaggcattcagaagtccagtatttcgacatggaacagataagaatggattcagcttgggtttcagtaaaaacatgcgacaagtttttggtgatgagaagaagtactggttgctacccattttttcaagtctaggtgatggctgctcctttccaacttgccttgttaaccaggatcctgaacaagcatctactcctgcagggctgaattccacagctaaaaatctcgaaaaccatcagtttcctgcaaagccattgagagagtcccagagccaccttcttactgattctcagtcttggacggagagcagcataaacccaggaaaatgcaaagctggtatgagcaatcctgcattaaccatggaaaatgagacttaactcttcaagcaagataaattcatactttataaaagtatcaatgctgtagatggatggaagaggcttcccacaggaaggtgccaccagtcagttgtgcctatgtccctttggctggaaatgcagaatatgaattgattagttctctccaagccattgcttaaaatataacatgttttggatccaatacacacattgttacaactaacacaaattcctattaaatattaaaagtagttctggtttattaatcaacggggaaaaacatcttctccaaaaaaattgggaataaatcccaagggaccaatttttacccnnatatatggggtagcacaagtttatcacattagaactcccattaatcatc

SEQ ID NO: 2299 - DNA, 2539 bp, Homo sapiens
cacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaggattgcccagttagatttgaatttcagataaacaattagttttttaatattttacatggaatatttggaaaatacttatactaaaaaattgtttgtttgaaattcaaatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcaaaaaaaaaa

SEQ ID NO: 2300 - DNA, 2317 bp, Homo sapiens
ccctaaagagttgaagaactaattggtcggtaaaaattggatattgaattcataagatgttaaaatggactggatttttggtagttttggttgcttttaaaaaaattagtgctagctttcaagtgaattacaaccttaaatttgagatttcctttggtgaaccatggaagtttacccagtggtaaggagaactgtaatgtttaggattctgaataagtactgtgttttaatcacagctcttaattcaaagcattgatttaattccacgtagtctgttatattcagaaacataaaaacaagtggaaaaagtatgaccccagtgtcggagatggctatgtgtgcatgtatatacaaatagacacgtatatgtgcatgttacctttacgtacatgtggaaaaacagttctaattaagtcaatatgtgtcttgtatttgcatatattagagtatgattttcctaatggtcgagggcctttttggtgggccgcagtttggatttatgtggtatgttgatgaagacttagtgaatagccacagtactcagcttttcctctcacagattaatctgccagtttctcccactgtgtattgtgtatatgtgatagaatttgagggggaaaataacacaccagctaatgatgaaacgaactggctctagtctgtaaggtaacgggaccagcccaattatataactgattgaggcattgccatttttcacttaactctttgaatcaagtcataattttatttaataatttttttgaggcagagtttcgctcttgtcgctcaggctggagtgcagtggcccaatcttggctcactgcaacctccgcctcccaggttcaagggattctcctgcctcagcctcctgagtggctgggattacaggcacccgccaccaagcctagctattttttttgtattttttagtagagacggggtttcaccatgttggccgggctggtctacaactcctgacttcaggtgattcaccggcctcggcctcccacacagctgggattacaggtgtgagccaccgtgcccgacctgaatcaagatattatttaaaagaactgtttgatgttatttatttattcatgtcttcaataggtatttacatgtctgtcttcggagatggtgttagaggtttttttttttttttttgagaccgagtcttgctctgttgcccaggctggagggcagtggcgcgatctcggctcactgcaagctccgcctcccgaattcacgccattctcctgcctcagcctcctgagtggctgggactacaggcgcccgccaccacgcccggctaatattttgcatttttagtataggtggggtttcaccgtgttagccaggatggtgtcgatctcctgacctcgtgattcgcccgcttcggcttcctaaagtgctgggattacaggcgtgagccaccaagcccggccggtgatagagttttgaacaagacaaagctccttgcaaagctaaccttgggaggtttggggaaaaccacaaagagggtgacaagataatttcagatagggctaagggataggaagaaaatgaagatgggacatgttaagtaataataatagatgacatttgaacactgtgccagtcactctgtcgattgttttacatataccttgtgacaaccctaagaggtaggcaccgttattacggacattttacaggtgaaacagggacacaggaaaagtaagtaacatgcccagctgttgaatcaaggcagcccgggaccagagtccactctctgagaaatggcatttgggcaggatcgagaatgaggaggagatccagtgtggcagaggccctggggaggaatgggctggaagtattcgagaaacccaaaagtaagagtggcctgagtggcccagagaggttgatgggaggcaggagtcagagcgtgtctaccctcgtaggccattggaggcttacatgtggaagggacaggttctgattcctgtttaaaaagagggctgctgtccgggcgcggtggctcacgcctgtagtcccagcactttgggaggccgaggcgggcggatcgcgaggtcgggagatcgagaccatcctggctaacaccccgtctctactaaaaatacaaaaacaaaattagcccggcatggtggcgggcgcctgtggtctcagctgctcgggaggctgaggcgaaagaatggcgtgaacctggaaggcggagcttgcagtgagccgggattgtgccactgcactccagcttgggcgacagagcgagactccatctccaaaaaggaattcgatatcaagcttatcgataccgtcg

SEQ ID NO: 2301 - DNA, 1367 bp, Homo sapiens
aattccaaaacaaggtaaaaggaaccagaaaagaaaaaaaatgtaaataaagttataaaaataaagaattttttcaaggttaaaaagctgaaaaagaaataattttatataagaaagaattttatatggtaaatttagtcctaaaataaaataactggttgtttaacaaggagggatgttcaggacaaaccagaaagtccaagcatgtcatgaacattggtgtaagtcatgataagattttatatatatatatacacacacacacacacaccccaaaagcttttatataatcaagttgtcmtattattattaagttttggtttgcttagggaagaaagarctaatttttaaaaaatcaaggttattacatccatgtatcttcctgtgtatgcttttaaagtccttgtaacattgagttacagggctttaactcctgtgtctgaaaaatcacaaacactgatgacaatcaaagcctcatcttaaggccccgtagaagatgccaatcaaaataaactgcattcctgaggcactaggcaagaaattaaagctattcaactcctcaaggcccagggactattgcggaagaggtgggcgcgtaagattgtaagggccgattttgaaagatccagtaagttcagtttctctatgaactaatcattcaagtcaaaggcacactgatgcaaaatcagtatatggacccctgtgtctgattagcaaggttttcttgaagcattaaccaactccttcataaaggttataaaaggcttatggragttatattttataatcaagattaaatcttatagtttgtttacaaaattttgaaaatcaaatgtgattggcttcaggctgtttttattagggcttcttgtttagaaagttaagtcacctctctcaaagaatgaaggtttttgctttttttgaaatccttgaattatcacttggrttaaataaatgactttacgatgacctgtaattttattttgtaatgtcaagtgttttaaaccttttgtatttgacaagctttccaaaatcaaattataaattatgtatttttctaacctaattaatcctttaagatcttagtttccctaaagtcctaaaatgacataatttggcttatttggtataaaaattatataggaagcattgtcaaatgtgaaatggtgtttggttttctttgggctgtatttgtataaatatgttattggtgtatgttccaaaattatgtgaaactcctataattctaatataacttagtgtacattatcagtaataatcataattgttatattaaaattattgtgtgccacagaggtaaaaaaaaaggaattcgatatcaagcttatcgataccgtcgacctcga

SEQ ID NO: 2302 - DNA, 1434 bp, Homo sapiens
cctgtgctaatctctagggatacagtggtgatcaaaaaagtccacgttaatcaagtaattaaacagttttataattatagctgtgataagggttgcaaagaaaggacatgtgctataagagcaagtgctccaaggacctgccccacctagtgttgggggtggcccgtgccgaggcacatgacatggcacacatgctgggagcaggagtcaggccaggactgcagatgtgggtaccatgtggcctagaatgctggctttctcaacttggcttgagtggcttctcttctccccactcccgcagtctgtgggatgtcctgggccccttgagttttattgtgtccaagacaggagacccccttctctgccagatggtgctgatcatttctcttcccccacccgcatcacatcgtcttctatttccccagctctgagcctgcaggctcctgaagctggaggctttctttccattccaggctgaggggaagttggggggtggggatgggggtttgcttctcacttcctctgtagacagcacctcacttcctgtcccccaggctagaagaaggctaaaactcttggctttgctgtcccttcctttctcctccctgactgctttcctggaaagcctacaggccttgaaggagcaaggcagcatcaaagccagcagcttatccctgaaggccctgccgagctccttaccccacccttaccccgcacaagggacctggctcctcagctgcagtccttttctagatgggatattcttctctcctgtgccctgcaggggagaggagtcagagtcagagggctcacccccattttacaggaaggaaactgaggcccagaggggtgccagcttcacctagggtcacgcggtttggctgcatgaatctcaggagcagaatcccaaaagcctgactcctgtttgtgatcacaaacaagagcagagcccagtgggggcttgtgggtgaaccagagctgttttctcctcccagcgtagagctgacagcttggggtgtcacctctgggctctggctggatggtgcccactagctgagcactggagttgcttgagtgcagaaggcatattggctggccagagcctattctttttgtagaaagaagccaggagatgggggcctgggtgcagtggctcacgcctgtaatcccagcactttgggaggccaaggtgggtggatcacaaggtcaggagatcgagaccatcctggctaacacggtgaaacaccgtctctactaaaaatacaaaaattagccaggcataatggcacgcgcctgtagtcccagctactcgggaggctgaggcaggagaatcgcttgaacccgggagatggaggttgcagtgagccgagatcgcgccactgccttccagcctgggcgacagagcaaaactccatctcaaaaaaaaaaaaaaaa

SEQ ID NO: 2303 - DNA, 1781 bp, Homo sapiens
cgacgtgtgttaggaagctacaatggcagctccctagtggaggtgtttcggaaaaactccgaagattccacttgagaaaatcatcggccttcagacaacgtctatgccagataatgctaccaaatcacaaccttgcctttcctccctactgctgttctgatgtgggaggacccaaaggcagcagaagagccaaagaagagtagcagaaaggcatatccacagctcttcaaataagcaatgtgatgttagcaaaagtgcaggggctccttgagaactttccagggctaaccagctgctgaggagtggcctccaggaaagagagaagcactctgattcaggcagtgatttacacctaaaataccaactccgtcatatcttcagaacaattcttctagaccttgcatctaaatatgggatcagcatgtgcaaagatgaagaggcataaggactgaccagtgggtcacggcaatgagacatttactgctgacctccaagagaagacttccattgaatgagaggaagatctacactactaatgatcaaacttacctggagcagtatctgacacagatatgtgttgagtgaatggatgaataaatagatagaaggaagatcctccaactatgaagtttcttcttttcttctgctgctgttgagtagatgagggtgccaagaaataagacagcaacaccaggaagaagaacaaatttggggcactgctgctgtactgagaatacagctgtgaacaacatccctgtcgctttcgttctagagaggaaaaacaggttttggtatcaggatgatgctggcctcataaaatgagttaggaggagtctctctttttctacgatttggaatagttacagaaggaatggtatcagctcctctttgtacctctggtggaattcaactgtgaatccatctggtcctgggctttttttagttggatctctaatgcctgtcatctgcgccatgggctttagttcaagtgagtcttcctcctaccttccgtggtaagtaacaccaccaaagagatctgatgttggggaggttcccacgtacttctaggtgatacaaaatagttatttccattcccggaaatcctcctgcaaggatttctgaaaccattctattgtataaaatctgtatgttcccaatttaaaaatatacaaaacacccttccaagtcatttgaattaacactagtattaaggaagctaagtctgcataaccagcccctggaaagacagaatgccatctcctcaagtctaagtgctgtgtaatcattactctacaaaccaagtggagatattacctattctgcaaacagcaaaccaagcaaaattcctaggtgctcccaagggaacaaatcatgcagagaaactgctctctgcttctctcgaaagccctcgctgttcccaggggccctaaaactcattatccccctgcgggtgaacagcagactccagtagttgtatacttctagaaagtggaagcagtacatctaaatgttttcaaagtttgctcatgacaaggaagggaaggatggggactcaagggctgggtaagtaaagagtgttatggaccaagagggtcagcaaagagggggcggtagaaaatgtaaggagagagaaaattgatagaaacaggtccaggagcaagtgaaagatttgctccagtggaattaacatgaatatacatggggatgggggggcagcacttgaattttagaaacaaaaaaaaaaaaggaattcgatatcaagcttatcgataccgtcgacc

SEQ ID NO: 2304 - DNA, 1416 bp, Homo sapiens
tacatagttattcttttttattttttactcaagttacatttaatatctttatcacaggaaggctggcaatataaaacttcctatgtacgaaaactcaaaaataaccaaagtggcaagtgaataattcctttgagaagcaaaagaacagtacaatgtttattaacacgtttcttcctgaattttcttcaatttttttaaacacacaaaaagcttttctgtacttagattgctgtttgctgtttttaatgttgttaacatgcatattattgcatttatggatagtagtagatagtgtaatatacatgaaaccaacatctagggatggctgccttctgagtgctttacagatggcacgttctcttattatccagcttaatcacagctcctccaactgataacttcacatcatctgcagtatttccaatctgtaaatctggttggcacaagttggttttagcgtatttggaaccgtattttaaatcactggaactactttgccttaatgcccatgggctgtcagctcccaagggctaagaccaagtttttcttaactttgtgcatatagcgtgggacctgcccagaacaggtactcaacaattttgctgagcagaactgtcctcaatggagaaaagaaaggagaaaggctttactgaagactgccccaaatacaaacaaattccattttaaatggaatatatacactttagcccccaaatgcagaccagtgcacgtctgtgtagtttccgactagtcacctggtaatagatcattcctgtcattcacaggctcagtcccagctctatttttcagtatcttgaatcaagttctctctcctctaatcatggaagaaatagacccataactagttattttgggtaaatgggagctatttaaaaaattgatattttaaaagcttaaatgaaatgttaatcaaatatgatttatgattattttctttctatgagtattctttaattgtggaaggcagtttcttaggaagggaacaagggttctcttttacaaccaaaagtttggtggtggtttttttttcacaaaattattgagtttaaaaaaattgatggttgttttgcatttcacctagtagcttattcaatggtttgtttttctgctaaatgttaaccgtcaaaacttgaattaatttcttaattgctatttctacttcaggaatcttaagaaagatggcttaacccagtcagaagggacaagcataattttcttccatggctatttaagtaagtattaggagagctttcacgaccatgctatagcttcctagtgacgcagaattggtaagacttgtgtgatatatacatgtgtgacttgttacatatcatagcaactgtgtagtgggaaggatgtaaacagttcgatatcaagcttatcgataccgtcgac

SEQ ID NO: 2305 - DNA, 942 bp, Homo sapiens
gaattccaggactgctgggaccccctgcacctcctggccacggagagatcctgctcccagggaccagcgtctgggtgggacacagttcactcctctctccacttcatgttctttttcttcagcagatggctcaagttccttgtttttctccttgctttctgacagccgtagcttctgaaacctgccatttttggtctcctgatgcctgatttcctaattgtcctgactgtgtcttctaggaagcattaagtctgaactgacttattagggaacttcagaaagttaaacacacaaaaccctttctttgactcctatcttaaggacatggagatacagttacatatatttatacacaaggatattcatatggcaaaaacggggagaaggcacaatttaagagcccaatggggactgggattgtgtatgcatctgtacaatgacatgttatgaagtcattctgttttttataaaactttttagtgacatgggaaaatacaaagaatgtaaagaatttaaaaagcagcgtacaaaacmatatatgtgatccaatttgtggtggaaatattttatctatatatatccattttaaamcaccaargaaaatacacagttaacagtagttatctttggaaggcaggattataagtgatcttagttttcttccttccacttttgttaccgatatcagaaaaaaactctgtctctacgaaaataaaataaaatgaaataaaataaaattagctgggtgcagtggctcatgcctgttgcctcagctcctcaggaggctgaggcgggagaatcacttgggcccggcaggtcgaggctgcagtgagctaggatcgtgccactgcactctagcctgggtggcagcaagaccttgtctcaaaaaaaaaaaaaaaaaaaggaattcgatatcaagcttatcgataccgtcgacctcga

SEQ ID NO: 2306 - DNA, 2307 bp, Homo sapiens
  misc_feature (1186)..(1186): n equals a,t,g, or c
  misc_feature (2000)..(2000): n equals a,t,g, or c
  misc_feature (2275)..(2275): n equals a,t,g, or c
  misc_feature (2285)..(2285): n equals a,t,g, or c
  misc_feature (2290)..(2290): n equals a,t,g, or c
  misc_feature (2292)..(2292): n equals a,t,g, or c
gctccccgcggcggcggccgctctagaactagtggatcccccgggctgcaggaattcccctttgcacatcttccatatactttaaatcatctctacattacttataataatgaatgtagtgtaaatgctatgaaaatagttactacactgtattgtttatttgtatttttattgaattgttttggggtggggggcagctgtatctttcttagtaatagaacccctggttttagctgggcacatgactgccctcaataaagattaaagtaccccagccttccttgagattgtggccatgtgactgaactttagacagtgagatataagcagatatcttctgtggcagtgttaggaaactattaaagacagtaagaacattgccctttgccttctttttcctttcttcatttttctgtctggaatgcaaatgtgatagctaacaccctarcagccattttagattatgaagatgagagtcactccccaggaagggtggacctgaaagctggattctagatgtggaatgacaataccagccctggactacctacctgtaggctgtgtgtgtgtgtgtgtgtgtgattgacagagagagagagatagagagagataccacaagtaacacaaagcatcatacctgggactgggaaggttaatgtttaaacattttaaatgtggcattggtttgttgaagacagtcaagcagtaggtgctgcaggctttgttgaggctagaaagctgttggtctttattaggtgatggcaaaacaatggatcacattttcatgtgctgtgtcttgggaggcaaatgatgagaatgtaggattggggaaaatggtaaggaaaatccaaaatgttcatgttttctaaccccttcttgccaatcttaaaagaaggacaaacaggctagattaagcaagtctacagttacaattggaaggaaacacagccgtactaaggaagtactctgtctgtggcctgcagtctagtttgactaggtcctgtatttgagctttgaaaragtaaagaatacaagtgctcgtatacccctgaagtasttaccagcagtgactgcaaggaggtaatcttatgggatgaaactataactctgtattaaccatcatatatagcatatatgtgtatatgtatgtgtgtgtgtgtatatgtgtatataaatatatgygtgngtatatacacacatgtacacacaccctacaacccagtgatttcaaaaaattaaacatttgtttagctcatgaatctgtgggttgggtgaacatttctattggtcttggctgggctcacctgtacccagtcagctgcagggtctagctcttcttatcttggctgggatctcacacatgtctaggatcagctgctttactagtctaggattgtcttggctgagacaggtggactactcagttctcctccactgccttatccttcagctggccagcccagaaatgttgccatgtttacagcataagagcaagcaagaaagaataatatgcaaccacttttccaagcctaaggtgaaagggcgggcagaacctgtggtgttaggaggcaactcataccagcccatgggtctactgtttaattttcagaaatttggcaagctgattgttaacacagctgttgtttaatttatgtacttgtaattaaataatttacattaaaacaaagataataggtactcaaaaaaggaattcgatatcaagcttatcgataccgtcgacctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgntaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagctttttggggtcgaggtgccgtaaagcactaaatcggaaccctaaagggagcccccgatttagagcttgacggcnaaagccggcnaacgngncgagaaaggaaggca

SEQ ID NO: 2307 - DNA, 1745 bp, Homo sapiens
ccaagcagtgggcaagctgctactctggagaagcccatattgtctctacatccaccttggaccaccatcttcaaaggggagcgggtaactttgaagtgtgatggataccacccactgctcctggagctccagcccatcagcactctctggtatttgggccacctacttctgccctctcacaagaagagcattgaggtgcagacaccaggggtgtatcgatgccagacacggggagcacccgtcagtgaccccatccacctctctgtatccaatgattggctgattctgcaagtgccctatgctccagtgttcgagggtgagccgctagtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccgctaaggtggctgtgacagtgcaagagctgttccgggcgccggtgctgagggtgatgggtccgcgggaggcccgcggcgcggcgctgggtggggtggtgctgcgctgcgacacgcgcctgcacccgcagaagcgcgacacgccgctgcagttcgcgttttacaagtacagccgcgcggtgcgccgcttcgactggggcgccgagtacacagtcccggagcccgaggtcgaggagctcgaatcgtactggtgcgaggcggctaccgccacccgcagtgtccggaaacgcagtccgtggctgcagctcccggggccgggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagggggcggctaccgtcccctctgcaggctcattcctccttggtctcctgcttcccctcacgcgaatttctttcaaagccatctgtttgcatccttgtgttttgctgtggtttttaaaggagcgcccacgaagtgtagtggctgacgatttcaacctcacacagcagtttgtaaccgcaagcattctctttgaattctcacagaattcagcaagaagtagaaacctgttatttactacattgtgatttaactttggatgtgaatttagtcacccttagcccttcagataagcctagccagtacatatttcagcacaggcagtttttttggtatttaagtacattgaggtaactgagcacttgagaatattttagggtcaaagtgtaattattcataatgaatttactctgttgatattaaaaagacgttcagtcctattactgatgagtttacatcttcaaataaatcctgggttctatttaaaaaaaaaaaaaaaaa

SEQ ID NO: 2308 - DNA, 1984 bp, Homo sapiens
cggtatcgataagcttgatatcgaattccgctggcggccgacgcgggcctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaagggactatttgatgatgaggacgaggagagtgacctcttcatggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgcaaagtccaatccactgccgatatctttggtgacgaagaaggagatctgttcaaagaaaaagccgtagcatcgccagaagccactgtgagtcagacagatgaaaataaagcaagagcagaaaaaaaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaaaaaaaaag

SEQ ID NO: 2309 - DNA, 2486 bp, Homo sapiens
ccggcgctgaggtcggaacgtctgcgtgtgtgcgggctggttttgtggcggctgctgctagagctggagcatttgccggtcagtataaaagattaaactctacagaagaatgcaatcaagtgatggcttttcctttagaatttgaatatggaggctacaggaacagatgaagttgacaagctaaaaaccaaatttatatctgcttggaacaacatgaaatatagttgggtgttgaaaacaaagacgtattttagtagaaattctcctgtattattgcttggaaaatgttaccattttaaatatgaagatgaagataaaacgttacctgcagagtcgggatgtacaatagaggatcacgtaattgcaggaaatgtagaagaatttcgtaaagatttcatttctagaatatggctgacctacagggaagaattccctcaaatagaaggctcagctttgacaacagactgtgggtggggctgcacattgagaactggccagatgctcttggctcaaggactcatactacactttcttggtagagcttggacctggcctgatgctttgaatattgaaaattcagactctgaatcatggacttcccacactgtcaaaaaatttactgcatcatttgaagcatcactttcaggggaaagagaattcaaaaccccaacaatttctctgaaggaaacaattgggaaatattctgatgatcatgaaatgcgaaatgaagtttatcataggaaaatcatctcttggtttggtgattcccccttggctctttttggcttacatcaactaatagaatatggaaagaagtctgggaaaaaagcaggagattggtatggaccagctgtggttgctcacattttaagaaaagcagttgaagaagcaaggcatcctgatttacaaggaataactatttatgttgcacaagattgtacagttcctgttagacttggtggagaaagaaccaacaccgactacttagaatttgtgaagggtattttaagcctggaatattgtgtgggtattattggtggcaaacctaaacagtcatattactttgctggatttcaagatgacagtttgatttacatggatcctcattactgccaatcttttgtagatgtcagcataaaggatttccctcttgagacattccactgcccttctcccagaaagatgtcttttcgaaaaatggatcccagctgtacaataggattttactgtcgaaatgttcaggacttcaaacgagcttctgaagaaatcaccaagatgctgaaattttcttctaaggagaaatatcccttatttacttttgtaaatggtcattccagagactatgattttacatctactacaaccaatgaagaagaccttttttcagaggatgaaaagaaacaattaaaaagatttagcacggaagagtttgtcttgctttaaagattagcacatttgtgcttgataagaagaattccattgaaaggggaaaaatgaagagaaacaagtatatctgaaatgtttattttcacaaatatcttaattttatatgttctttaaaaaagaacatttgaaaatataacagttaaagatatttttctaaaagagaaatgatttaatgaatcttgctttctaataaataaattgagtgattctggttgcattcctatttccctaagatctactagtgataattctaccttaactgtaagccttttagtcttcaaagtcttccacctgagcccattgttctcatggaggttttgtgatattaaccctcccccaaagactgggatcaccaaatagtttcaaaattctcagtttgtactgaagaccagaagatcagagaaggaaactttaatgctgtctagcctcctgctattaatgcaatcaaagaatacttttgcatatgtcttgataattaaatagtatttgttaactgtgatatgcatacacttatataagcagaattatgagttaaagtaatacttagcaatatgattttataatggctcctcattatgcttgctgttgaaccttttatgaggagtgaatataaagtattggttttccctcacaaatttaaagattatgttattaatactattataactgcatcaatcaagtcagataaaggcaactataaaatagtagtagtgtttgtttcctatctcaagggcgaaattttatgggaactcaatttattatgcagtttttaagtttaaaataccaagaaagatgtcactagattctcttctatgtgatttttgttttttatataaagcagtgtagtggtgtttagaagctgaggccacctgtaaggcaaatctgccttaagtgtattatgtgttacttaaaggcaaatttgtgatctaaaagtacaagagtgatttttgagctaggattataaaatacataataaagatgtgagaagataaaaaaaaaaaaaaaaggaattcgatatcaagcttatcgataccgtcgac

SEQ ID NO: 2310 - DNA, 872 bp, Homo sapiens
  misc_feature (422)..(422): n equals a,t,g, or c
  misc_feature (847)..(847): n equals a,t,g, or c
  misc_feature (856)..(856): n equals a,t,g, or c
  misc_feature (872)..(872): n equals a,t,g, or c
cagtatttccctcagtactgtaagcaaaagtggtatgtttttctttctttatgtctactctgtcctctgtggccttctggtgtacccctctcttcctagccattcagtctctctagtcacctccctagtagctagtgctctctaagtttttatttaattagaacaactccatttccatttcaaggtaggtcaatggggggaaaagcctcatgatttaaactgaagttaacaacacagcttttaaaatgaaaactcatactccaacttctaaagtatatttgagctgatttgtttccaaaacaaagatatgctgtacctaaaactgctaaaacaaaaatataaagacaaggactaggtgattaaggggagagaaaaatcatytcttttccaggaaacctttgctaaaataagcaaaacttgantctatgcttcatggaaactgacacaaagaaaagaaactgatggattgcacaggccttgttatagaaatagatctataaaaagatctgtccacaggaaatatacaccttctcctggttctgaacttcaatggggatttgtcacctaggtctccatctataggaataccttcacatacctatctattcatgcacatattctgaaaacaggtacatacaaaattacaacaaaggaaaaaaattctattgaacacttaaaaatagaaacaggccaggcacggtggctcatgctgtaatcccaacaatttgggaggctgaggctggtggatcacctgaggtcaggagtgtgagaccagcttggccaacatggtgaaaccccgtcactactaaaaatacaaaaaaaattagcctgtgtggtggcacactcntacaatccnggctgactcgggaaan

SEQ ID NO: 2311 - DNA, 1779 bp, Homo sapiens
aattgccaagactgcacaaaattacagtgctaatgtatatggttgcagttcacataaagacaaaagcatctgttatgaaatgagtagtaatattgggtggttgatttgttcttagcagacttggcttcatwttggtcttgagataaaatggccagcataaatgctgtttatattcacgttttcctaggtgtgtgtgtgcaggccacagcagcatgcccttggtgtagtcagtgccgaaasgggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgktcatcacatttaaaattggragagaacgcgcttgakggatagagcgccttcagkgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagagaaaaaggaaaacggggcacaggccattcgacgccttctccaaggggtctgatttgctgagacaccagcttcaccttcttaacaaggcacctaattacaacaagcatgcacattttggtgcattcaagaatggaaaatcagaatagcagcattgattcttctggtgcagctcagtggaagatgatgacaaccagaagacatgagctaagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatcaa

SEQ ID NO: 2312 - DNA, 1804 bp, Homo sapiens
  misc_feature (1593)..(1593): n equals a,t,g, or c
  misc_feature (1701)..(1701): n equals a,t,g, or c
  misc_feature (1792)..(1792): n equals a,t,g, or c
gatcctattacagctgcctacttccctgatgactagagggcaccgccaagcagtgtttaccaaaatcaacaggccagagcacagctgraagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctyctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtnggtgctcctcaggactgcagcactgagatggaacctggcctcagtttaggaacaggggccacaacagggcaggaacccaccaccctccacataggaatacaaccagtnggggccacatcatgtgaggcatyagacccacamtktyagccagcaaggcgggstktgttcttyaaaccaktgytgcctarattytgatttnggggatttccag

SEQ ID NO: 2313 - DNA, 2094 bp, Homo sapiens
  misc_feature (2078)..(2078): n equals a,t,g, or c
gagggtttgaagccgcgccgcgagggagcgaggtcgcagtgacagcggcgggcgatcggacccaggctgccccgccgtacccgcctgcgtcccgcgctcccgccccagcatgacagccccggcggktccgcgcggctcagagaccgagcggcttctgacccccaaccccgggtatgggacccaggcggggccttcaccggcccctccgacacccccagaagaggaagaccttcgccgtcgtctcaaatactttttcatgagtccctgcgacaagtttcgagccaagggccgcaagcctgcaagctgatgctgcaatggtcaagatcctggtggtcacggtgcagctcatcctgtttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgctgtggaccagtacctggcgttgcctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggttactgactgcatccaggtggatccccccgagcggccccctccgscccccagcgacgatctcaccctcttggaaagcagctccagttacaagaacctcacgctcaaattccacaagctggtcaatgtcaccatccacttccggctgaagaccattaacctccagagcctcatcaataatgagatcccggactgctataccttcagcgtcctgatcacgtttgacaacaaagcacacagtgggcggatccccatcagcctggagacccaggcccacatccaggagtgtaagcaccccagtgtcttccagcacggagacaacagcttccggctcctgtttgacgtggtggtcatcctcacctgctccctgtccttcctcctctgcgcccgctcactccttcgaggcttcctgctgcagaaygagtttgtggggttcatgtggcggcagcggggacgggtcatcagcctgtgggagcggctggaatttgtcaatggctggtacatcctgctcgtcaccagcgatgtgctcaccatctcgggcaccatcatgaagatcggcatcgaggccaagaacttggcgagctacgacgtctgcagcatcctcctgggcacctcgacgctgctggtgtgggtgggcgtgatccgctacctgaccttcttccacaactacaatatcctcatcgccacactgcgggtggccctgcccagcgtcatgcgcttctgctgctgcgtggctgtcatctacctgggctactgcttctgtggctggatcgtgctggggccctatcatgtgaagttccgctcactctccatggtgtctgagtgcctgttctcgctcatcaatggggacgacatgtttgtgacgttcgccgccatgcaggcgcagcagggccgcagcagcctggtgtggctcttctcccagctctacctttactccttcatcagcctcttcatctacatggtgctcagcctcttcatcgcgctcatcaccggcgcctacgacaccatcaagcatcccggcggcgcaggcgcagaggagagcgagctgcaggcctacatcgcacagtgccaggacagccccacctccggcaagttccgccgcgggagcgctcgggcctgcagccttctctgctgctgcggaagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaaagggaaaataaaaaaaaaaaaaaaaaaaaaaaaaaaaaaaaaacntykggggggggcccct

SEQ ID NO: 2314 - DNA, 2790 bp, Homo sapiens
ccgtcttgggctactggcagctcctctccttgggctcctggctgccaggcgttggtgccacttcttaaaggcctggaaccagggaggagaggaaatgctattgttgtgggctttctccggggtctgtgctgtgcctgctagagcaacccctgtacccagctccttttgtccccagggcccctccctctgccccaagcagccagccagtcttgcctaggccaaatgcacaagctcagaatagatctgatggtgagctgggaagctgtactcagagcagagcaaatgagggagggggcgctcaggacccaggccctccatgggctaatgtgagtggcagccatgcctcatgccacaccttcttcgcaaactgatggaccgggtgggcctggcctgagctggggccacaaatcaaatcaagggctccagcatccagcctgtgtgttctgtaatggaactgaccccctcccctgaaaacgaaagggccccggggctggcaatcagggaaagctccacggtgcgcggctgtggcacaaacttctggaaggctggctgactggaatgcagggaaaacggcagtacctgggaaaggacccacccatcttcctgctgctgtaactgctgagccactcgcagtcccaggatccgctgccaccacgtctgccaggcccatctcaggtgccactccctgagctttggggacagttggcagagaaggcctcttgtgctcacgctcccccgcagtccccagcccttctgcctttctcccccgacactgctgcaccagagtgaaagggctatggcaagggggtgtcatctgaggagtattaagaatgcagattcctgggcctgtcccccaaggttttggagtcagtaggtccaagggccatacttttgagaggggtttgggttaagtatgaggtgaaatgggagatggtcagtgtggagaggggtgcacccactcaccagggtccgcaccagctgctctgccccttgggcatccacccagtgctgccatgccactgccaggcacctggcctgctgggaaccccgcagcccgtgaagcagtgcctcgaggcaccggcgctgcaggtacttcctcctgatggccaagagcatcgtgacccttcagggccagaaggagggcagagccatgggcctgggcctgcttttccaggatcctgcaggaacgagcactggccagagagggcccagctgtagccatggctcaggcaagcccctcagcccttgcccccatccctcggacccaccaaactgcacacacagctcctcttaccgtagcctccgtttatgggccttgctttgggctttgcaggctctgggctcagggctggagtgcgctcttggtccctggtccctcgtccacaggggcaggcctgggacccagctactctgtccaggccactgtggccagagctggaaggcagggcagagggaatgttccctgcaccctggaaaggggagttgagtcacaagaggttaaggtgggtccaggaaggcagctgctcttagtgcccgcctaggagttgagtacagtgaggagggtggaggaaggtgctgagcttagccttgtgccctgcccccatctccccaggcctccagcctctcccggctgcctgccacccaaagagaaatcacaggggcggggcaggaatgcaaagtgttttctcagaacagctgaaacattccgaagagggaatggatggggagaatggtcaatacacataagaccgtgtcccaaggagctgatttccaggcccctgaggactggagaccgcttcacccctgcacttcagacaccgtttgtcccccggggcaaggtctccttactctgagcccaggccgttccccttggcttcctccgtccacccaggctgcactgcagtgatggcgcgggaggcaccagctctgtggcctgtgtccagcagctgcgggtctgaaggaatagccagagaggagcacctgaaccccatgggcttggacttcctggggccccgctgggatttcttcgctgctctagctggcaggacacatcccggcctcttcttccacccattcccccatgtggctgaagacattccaacaatggggtgggcccataatagttagccctcagtcagttcccggagcacagccctgggagggggctatttctctccccactgaaaacatttcaaagctgagttacttgtctgaggcctcatccctcggaagccgtctgactccagagtctgagcccccggctagtaccctatagagagggggctctccaaaggggctgctggggcatgtgtgcctgtggcagaaaagaggagaccctggaattcagcaccctgggtgccattcccagcgtttagtttctagaggcctcagtttctccatcagcttatgggatccttgtctttactgacaagaatggaatagaaatgtaaaagtactctgaaaagcaattgccctgtaacttatctagaaagaaaagaccctgagactccagaatctgctgttgccatagccccatatgtgtgaattctgcaactagccaaggctagttcctttcaattccatttaaaaaacaaaaaccagcaggtgtggtggctcatggcgtaatgggcctgcccaatgctttgggaggccaaggcaggtagatcgcttgagcccaggagtttgagacaagccctggcaacatagtgagatcccatttctacaaaaaaaaaaaaaaaaggaattcgatatcaagcttatcgataccgtcgacctcgagggggggcccgg

SEQ ID NO: 2315 - DNA, 1872 bp, Homo sapiens
  misc_feature (1871)..(1871): n equals a,t,g, or c
gggtcgacccacgcgtccgattggcctagagctcctgtgaccgagagcgccacggaagcctggggatgatgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgrgaaaccacaagcgcagagacgctgaggcccaggcaggtgaagaggaagtggctttgggtttttaaagtaggtgagcgtgacctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcgcatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcaatgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgmaaaggtctcaatgccttttggtaacatccgtcattgcagaagaaagtttacacgacgtcaaaaagtgacgttcatgctaagtgtttttccagaaatattggtttcatgtttcttattkgctctgcctcctgtgcttatatcatccaaaaactttttaaaaaggtccagaattctattttaacctgatgttgagcacctttaaaacgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtgaaaaaaaaaaaaaaaaaacnt

SEQ ID NO: 2316 - DNA, 1276 bp, Homo sapiens
  misc_feature (1168)..(1168): n equals a,t,g, or c
gaattcggcacgagtctgcctgcaaagcccacaagcatgtcagatcacctgggctgcagacagacaaacacctgagctgttctgaataccttcaggttcctggcctcsctgagcaagtgcagaaatttttaccttcaaggatcagggtttttctgtttgtttgttttttaacacacayatatgtgaacaaagagtatgcgtttgtactggcagaagaagcgtctggtaagacaaccagcaagttaacaatggtcacctccagaaatgggctgggtaaaccaaagaatttttttgtttttgttttttttgagtcagggtctagctctgtcacccaggstggaacgcactggtgtgatcasggctcactgcagccttgacctccctggctcaagcaatcytcccagctcagcytcctgagtcgttgggactacaggcacgtgccaccacgcctgacacattttttaaatttttgtagagacagtgtttcaccatgttgcccaggcaggtctcaaamtyctgggctcaagtggtcctccagsttcagcctcccaaagtgctaggattataggtgtgagccacagtgcccagccccgtagtggagaatttctgttgaatgaaccaaaagcaactgccaacctctccatgcaccatgtgtttcagaggagaaagcacagtgaagaatgcagtgtgttctgaggtcctgtcacccctgaggctgtgtgtgtcctttgccaaattaaagagtcttactgaatgcggtgcatccaggagacaggcccaggtttggactggtcctctagcctcagaagcatctttttctccgactgattccgtgttcaggtaatgtctgcctgcctgcctagggatctccacaccttaggccagccacgtccgcctcgcccgctggaacctacctgcccatcagagtcgtagccccagttagtggagcctgctagagccacggcccgggcatctgcgtctcggcgggctgcactcaggacgaagtgccaggccctgctgttccgggggcgtctggccatggtggaaagaatctagaagaaaacacaggctctgggcaaaggaagactcacagcactcccagccctgagcttccaaggctgggccacggacccactcaaagtggggactgcaggggccgcaccggtgnccagccagggctccagaacgcttcaggagcccgtacctcaccccaggatctgagcagctcaataaaacccaggtagatcctgtgaaacgccacccagaaaaaaaaaaa

SEQ ID NO: 2317 - DNA, 1717 bp, Homo sapiens
  misc_feature (712)..(712): n equals a,t,g, or c
  misc_feature (721)..(721): n equals a,t,g, or c
  misc_feature (903)..(903): n equals a,t,g, or c
gctcctaggggcaggacttggcagttgctcaggagatgtttgagaggtgggcctttccggagaagtggccctttaaccctggactgtgggccatttaggagcatcacaccagttttagaatgtcagtagggacactgcgacacagacagtgacctgggagcaggatgcaggagccacatggcaagtttctgtcctggggcaggtggctctggtggtggtctcttgccgcaccagctctggttcaggctgttaacatgcctcccgcatacatccagatagagaactggtacatgatgctcctgatgggctgggagacaaaatgttgccatgtcaggagtctgtgggtgggaacataatgaaagggaccccgacgtggggacagtgtggccaggcagcatggagaagtgggtgccactggctcagcctgggcctgagctcactggggaccggagctactttgcatgttgctgagggatggggagggcagggctcttccttcacagaatgctctttctcttgcttggtaggatgttctttggcaaaaacaaggtgatgatggtggccttgggtcggagcccatctgatgaatacaaagacaacctgcaccaggtaagtctctggccctcacggggtggagctaaggcaaagccgccctctctcccactactcccatgtgacagcctcccccaccattggcaggccagaagctcanggararcanggcctggcttaaactctgggttytccyttmacytccgracccaaggaatarcasttcctgcytcccaytcyttcttgctatgacaaccaaaaastctttaaatgttgccaaatgtacccggtgagcaaaaacgtgcttagtagagaaccaytgttctaatgtgaccaagctgtcctcactcntgatttgtaggtcagcaaaaggttgaggggtgaggtggtctcctgttcaccaaccgcacaaaggaggaggtgaatgagtaagtactgctgaggaacggagggaaagaggcgggtgagaggggatttcagggagggaatgatgcaggaacttcgttccatatgtggcatcaagttggaactgctcctggaagcctgtcactgagctagtggcctgggaccacagccctctctgtcctctccagcatggtgctctgggctggctgctggccagcagccaaggtctgtgatgggggaaggcccagggccacgggacacttgggggagcctgactcatgggctggtggcgtggccaggagcatctcctcctaccacttctcttttcccttaggtggttcacgaaatacacagaaatggactacgcccgagctggtaacaaagcagctttcactgtgagcctggatccagggcccctggagcagttcccccactccatggagccacagctcaggcagctgggcctgcccaccgccctcaagagaggtatgggcagccctggagccaaaaggtcacagcctagagtccaagagcacgggcctgcaagctcatccctttctagctgagcaagttatttctacaagcttccattttctcatgagaaaatggggctaagagtgcatgcctcacagtgggggtgaaagcagacagtaacttacagccaaaatgcagcccttgaggcccatcaggggccttgcgcttgtttaaaaaaaaaaaaagggaattcgatatcaagcttatcgataccgtcgacctcgta

SEQ ID NO: 2318 - DNA, 1838 bp, Homo sapiens
  misc_feature (1076)..(1076): n equals a,t,g, or c
tgttcaccagtagctgggattacaggcatgtatcactatgcctggctaatttttgtatttttagtagaaatggggttttgccatgttggccaggctggtctcaaacttctgacctcaagtgatccacctgcctcggcctcccaaagtgctgggattacaggtgtgagccaccatgcctggggcaaaagatattttcaaaacattgtmaataacttctcccccaaacccagacagggtctcattctgttgcccaggctggagtggcaggggcaccatcgtagctcactgcagccttgaacaccggggctcaagcaatcctcccgcctcagcctgccaaagtgctgggattacacacgtaagccagtgcactcagtcctaagtaactttttaaataccaaaggtagaaaaggaagaagagggaaaaaaaaaataagcccatatatggaaaaggaaaagacagcagataaatataggcaaatagaggtggaaaatataatcacgtagaatttagtatagtaaaggattatctctgaaaaacaaaaacagaaaactatcagagccaaataaagaaaaatggaaatgactggggaaaaccactcactaatgagttgaatgttcaagagaaactgagaaagagtactgcttatataaaaattatgtgaaattaaacaaaaatgtagtttagtaatgaatggtgtttaagcacttatggaatataaaattatcacctgttaaataagaatgcatagtaaatggaatggacaaagaatatgagtgacagataaaatcagtttttaaaaaattttattaaagttgattaagcctattagtgaaagaaagcaggccaggcacaatggcttgctcctgtaatgccaatactctgggaggtcaaggcaggaagatcacctgagcccaggagtttgagataagcctgggtaacacagtgagactccatctctaaaaaaattaaaaagtaaaaaaaaattagctggtcatggtgacacacacctgtsgkccyasskmctwkggaggctgaggcaagaggattacataagcccaggaagatgaagctgcantgacccatgattgtgccactgcactccggcttgggtaacaaagtgagatcctattttccatccccaaccagtccccccagaaaaggccaggtgtggtagctcatgcctgtaatcccagcactttgggaggccgaggtgggaggattgcttgagcccaggrgcyyysagtascagtttaggcaacaaagtgaaaccctgtctttacaaaaggcaatacagtgaaaccttgtctttacaaaaagtgcaaaaataagctgggcatgtgtgccacaacacctgtaattgcagctactcaggaggcagagacaggaggattgcttgagcccagaggtcaagactgtaatgaaccatgattgtgccattgcactccagtttaactgacagagtgagactctgtcttaaaaaaaaaattattttgatattaagtgataagtggctatttgcctagtagcttcctaaaataaactagcataaaatgaaacttattttccaacctatccctaagcccttggaatttcagttctaataactagaatagttacataaaaccagtaaaaagttgtttaataagaatgtacacatttcccctactaaaatttattgcttgtagtttcaaaataaaatcataaagttatctcaaagccaagcaaaaaaattatttggtacaaagtagcaaactcgctgcattagaagaaaaggccatttcttcacatatttgaatacaggcaccaacacatagttccacatgaaattatatttcgg

SEQ ID NO: 2319 - DNA, 1018 bp, Homo sapiens
ctgtaatttttaattttcatataccgtgctttgattctaattttattttttgagttctctgaaggttacatatacagagtgcttcaggaatgatcattttgttattattcatgcttcttaacaatgttgttttagtccaagaagataattgccagagaaagaatacagtgcaggaaagaagargctggagccagtggtgaagarggattgagargacagacattgtgggaatgaaatcatgaataatcgtgtttttgaattgtccaaaaacttctacaaaccatgaaatgttggagtttaaatctaattgttgaaaaattccccacattccttgtatcccttaggttgagcataattccacatccgtggactgatgcacttcccaagagggggcctcattaactcttccgaggcagcagcagcaagggcaccccctcctttccccccacaccccayttctcatggctcttctttctctcatctcatgcttaggttagaaaagggcacaaggtaaggaagcccttgggaataggctgaatctggctatctaatttggtgccaaatacttaatgtgcttgaatttaaaaacagcaaacatgtagaaaggtaattataattatgaggccagttctttaagctagctttttttcccctctcaaacagcatattggcttggatgtcagcaggagaaagtgttttttgcaatacacataatgcatatatggtcctgttagcaatctatagaaaatagatattgctcattaaggtaaatatttttgttgatgaatgatctggaatggtctggacttgttgtgtgaacaggaaattgctctgtaggctttgacttgtgaggtaaagagtgaggctggtaagattaattaaagtaaatactgtgacaataggatgtcaaaaccaaaaacgtgtttctgaaactcaaggaattaatgacacatagggaagtttttgccatattaagcatagagtaggagaggcaagtcaagaataaaaaaaaaaaaaa

SEQ ID NO: 2320 - DNA, 2932 bp, Homo sapiens
  misc_feature (1)..(1): n equals a,t,g, or c
  misc_feature (5)..(5): n equals a,t,g, or c
  misc_feature (33)..(33): n equals a,t,g, or c
  misc_feature (1175)..(1175): n equals a,t,g, or c
  misc_feature (1200)..(1200): n equals a,t,g, or c
  misc_feature (1273)..(1273): n equals a,t,g, or c
  misc_feature (1403)..(1403): n equals a,t,g, or c
  misc_feature (2921)..(2922): n equals a,t,g, or c
nttgnatcccttgaataccccttctcgaaattnaccctcactaaagggaacaaaagctggagctccaccgcggtggcggccgctctagaactagtggatcccccgggctgcaggaattccgaaaccctcagaaatcaacagtagaaaacttctctaaaacagctttggcctttttgcatatgaatgacttttactgcgtaaatcagttattttgcttaccatcctagtcctctgctttccaccccaaatccttgtttatgtgtgtgtggttttgtttgtttgcttgtttgtttgcttgtttgttttttgagacggagtctcactctgttgcccaggctggagtgcagtggctcgatctcagctctctgcagcaacctccacctcccgggttcaagtgcttctcctgcctctgcctcctgagtagctgggactacaggcgcgcatgccaccatacccggataatttttgtatttttagtagaaatggggtttcaccatgttgaccaggctgatcttgaactcctgacctcaagtgatccacccgccttagcctcccgaagtgctgggattacaggtgtgagccaccacaccccgcctgcgtgtttgttttttaaatttctcttcttagggtcatgagatttctcattaatttcacttagagctcctggagagaaaagcctctattattgtcactataacagtaaaaaaagtgtagagatttttttttttcttttgagacagagtttcgctcttgttgcccaggctggagtgcaatggcgtgatctcagctcactgcaacctccacctcccgggttcaagcgattctcctgccttggcctcccaagtagctgggattacaggcatgtgccaccacacctggctaattttgtatttttagtagagatggggtttcaccatgttggtcaggctggtcttgaactcctgacctcaggtgatccacctgccttagcctcccaaagtgctggtatcacaggcatgagccactgtgtccagcttttctttttcttttctttttttttttttttttttgagacagggtctctttctgttgcccaagctgaaacagtgacacaatcatagctcactgtaacatcaaacttctggggctcaagcaatcctcctggctccgccttccaaatagctaggattacaggngcacatcaccatacccaggtaattntttctttttttacacgaaaatgctcaacatggatttttttttcttttttggcagagatgatgkctcactatgntgcccaagctggtctcaaactccctgcctcaagccatccttccactttagcatcccaaagtgctaggattacaggcgtgagccaccgsacctacccccaagaaagctttttttttttttttttttttttntgagacagagtcttgctctgtcaaccaggctggagtgcagtggcgcgatctcagctcactgtaacctctgcctcccatgttcaagcaatcctcccgcctcagcctcccgagtaactagaattacaggcacatgccaccacgcccggctaatttttgtatttttagtagagagggggtttcaccatgttggccaggatggtctcgaactcctgacctcaagtgatccacctgctgtggcctcccaaagtgctgggattatgggcatgagccactgcacccggcccccaagaactcttcaaatgcacctagtgtcacaagaaaagatagttaaactgtgtctgaaaaagtggcttatgtggggaaatttgtgatggatttagggaaacttagggtaaattttaaacataaggccttttgtcagatcacctacattcctcggattgtgcgtgggtttgtcgcaggtgcttgatgtgacaaattacacagcttctattgcttcatttgatcagccgcctgttgactttcagccaagtcctgcagggttgcttctcagattgtatctttctgcaagacaaagatgttttcatagtctctctttaacttctcccttttgtggctattaatttatacttatatgtttttcaactccttatttttgttttctctttataaaagttttaacgtgtgctattcttgagggaaatactgatgcatatctaaactttaggggtgtttttcaccctggctacagacactcggtaaataatttttcaggtgatgggaaaacacatcatcatgagaatgtagcaacttttattttgcagtaactgttaaaattgtggccacagtgctcagtaaaaggggaccttccccctgtaggtgtttggggaggagtgacgtcctgtcctccattttgttagtaacccacttatggatggggcattatcacctagaaagaaaagagataccatggtatgcagttacagggagccagagcaagagcaagacaaagaaattcccttacgtcttcaatgcagagccggcatttagacctctaccccaggcaggacccacaaatctttggcagccatgagcacctgttttgctcctgccttcttcctgttggcaattttgggttttggggttttttttttttagacagagtctcactccatcaccaggctggaagtacagtggtgcagtctcggcccactgcagcctccgccttccgggttcaaatgatcctcttgcttcagcctcccaattagctgggactacaggtgcgcaccaccacggccagctaatttttgtatttttagtagagatggggtttcaccatattgcccaggctggtctcaaactcctgacctcaagtgatctgctcacctcagcctttcaaagtgctgggattatatatattttaaataaatgaatagaattcgatatcaagcttatcgataccgtcgacctcgagggggggcccggtacccaattcgccctatagtgagtcgtaggctnncacaattcaa

SEQ ID NO: 2321 - DNA, 845 bp, Homo sapiens
  misc_feature (1)..(1): n equals a,t,g, or c
ncttgccagggagtttgcctcatgattacagttgtttcttccagaggatttcaccaggaagagagtagcggtgtttcccatgattttaaggctgtgaatgtttttggctttgcgagaactgaggaatgcacctgccattaagcacaaagggcatcttgccaagaattttgttattgttcattaaaaccttatttgcatttctgctctcagatcagtgcaaagggttagcacatctgtggttgaggaggagagagtgtggaccaggcggccttacctgtgctgcagaggagctgaagtcttacacttccatatttgcccctaagctgggggttgttgggggcatggaaatgaaagtaggttgttagctcactgggagacaatttgggggatgatttattttttaatgtttttcagctgccttgagtcacaaacgtgatttaaaaaacaaccagatttgtaaaaaggtagtttctctctcacacatgtacacaattaccaccgcaacaaaaaattccatagcaatgcacatcccacacttacctggccatatattttgtggaggatagaatttgcttttcttcttcctcctggggtaagggtggcaggtggagaatgcttatgggcccatttgcagttagcactctttggactgaatgccttagtgggaacaattaatcacacatttattcaaccatcatttgcttctcaccatccagaggcgctccaactctgtttttgtgggtgcttgtgagtgtaattaacacctgaaactgccttcaggtgagtgaggtgggtggtttctgcccttggggtatgctgtctggccagaatggagctgtaatttc

SEQ ID NO: 2322 - DNA, 1726 bp, Homo sapiens
ctttttggctctcattttgaatttttcaagagctcatgttctttgtcttcattaaaaaaaaaaagttcttatatcgtgtatgaatgtcattcgggatatctatacatacatgcacatacctcatttttattgcatttcactttattgcactttgcaaagtgacattttttacagattcaaggtttggcaaccctatgtccataagtctgtcagcaccatttttctaacatatgtgctcattttgcctctctgtcacattttttttttttcctgagacagggtcttgctctgtcacccaggctggaatgcagtggtgtaattatgcctcactgcggccttgacctcttgggctcaagggatcctcttgcctgcgcttcttgagtagctgagactacagatgtacaccaccacacacccagctaagttttaaatttttttatagagatggggtttccctatgttgcccaagctgctctcgaactcctgggcttaagtgatcctcccacctcagcctttcaaagtgctgggattacaggcatgagccacagcacctggtctctgtgtcacgttataataattctgccaatattccagatttcgtcattattaaatctgttatggtgatctgtgatcagcgaactctgatgttactgtctaattgctttgggatgcagtgaacccgtcagagtcatccatgagggttggaatcaacttcttccaaaatcctgttaatcaagagtgaacttaatcgattaatgttgtgtatgttctgactgctccaccaatctgtgggtcccctatcactctccctctcctcaggcctccctattccctgagacacaataatattgaaattagaccaattaataaccctgcaatgtgaaaggaagaagttacatgtctctcactttaaatcaaaagctagaaattattaagcttagtgaggagggcatttcgaaagctgagagaggctgaaagctaggccggttgtgccaaatagctagccaagttgtgaatgcataggaaaagttcttgaaggaaattaaaattgttactccagtgaacacacaaatgttaagtaagcaaaacagccttattgcttatggaaagaaagtctgaatggtctgaatagaagatcacatcagccaaaacatgtccttaagccaaagcctaatctataatagatcaggccctaagtctcttccattccttgaaggcacagagaggtgaagaagttgcagaagaaaagttggaagctagccaaccttggtttgtgcagtttaaggaaaaaagccatctccataacatggaagtgcaagatgaagcagcaggcactagtggggaagctgcagcaagttatacagaaaatctagctaatgatgagggtggctacactaaaaacagattttcaatggagacaaaacacccttctattggaagaagatgccctctaaagctttcataggtagagagaggtcagtgcatgggcttgaaagaacaggctgattctcttgctagaggccaatgaagccagtgagtttaagttgaagccagtgctaatttatcattctgaaaattgtagggcccttaagcattatgctaaatctactctgcctgtgctctagaaatggaatagcaaagcacgaatgacagcacatctgtttacaacatgatgtgctgaatattttaagcctatatttgagacctactgctcaaaaaaaaaaaa

SEQ ID NO: 2323 - DNA, 1842 bp, Homo sapiens
  misc_feature (19)..(19): n equals a,t,g, or c
  misc_feature (62)..(62): n equals a,t,g, or c
  misc_feature (1793)..(1793): n equals a,t,g, or c
  misc_feature (1834)..(1834): n equals a,t,g, or c
ggatgacagattgcgacanagatttgtgacccttcctgctgaacttcagagggagctgaaancagcgtatgatcaaagacaaaggcagggcgagaacagcactcaccagcagtcagccagcgcatctgtgccccgagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatatttggtacrggctccttttkgtgaayccttaaaaactcaactctaggargcaactactgtttattatactaaarggctgaaaamcctccaggccagactgctaagctctgaaatycctgagaggtctcagaccgggattctacttgttccaagaaagggtaaagcttctaaaccatcttattcttgtctccaagcatgaacacaggagcatgtyaagaaaatctttactactttctyccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattctatgctagtggatatttggaactttttcctcaaacaaacaccccacactgacttcagcaaaaccctaaaactagctacagattactactacgaatgaatcatyaagttttgtgtctgcaacaatttagaagcactaagcccaaatatcaggaaatgtgtgtatgatggaattttctaggacaaaacagatcaagattaaaacaggatcaaggattaatggtataaaaatggtctactaaaacaggatcaaggattaaaacaggatcaaggattaatggtataaaaatctctactggttaccgggtggcngggccatacagggtagtggtggatggatagtttagtttggnaagggtaa

SEQ ID NO: 2324 - DNA, 1102 bp, Homo sapiens
ttttttttttaccatttaaaataaaatgaaagtgaccttctgtttataaaaatctttgtctgcatctctgcttatttccttagaagagattccaagaagcggtgagtgatttcacggcagcagagggttgggacatattacgggcgcggatccctcttggagtgagatgactctccggagagatttagtcgtcaccctcgcgtgtgaggctgcgtcacaccccagggatgtgtctatcaagatggaagatcttttacacgctcttgattttgtttgcctttttttctattactagtgagaatgaaactttttatatgattattatccatcataatccaacacaaattactgcttcatgttcttttactttcctgtgaaggttttagtgccttttaaaaattgctatatattaagcttgttaatacttccatgctgtatttgtggccatcagtttccccgggcacaggcctgcacattttgccttcacacgctgggtggtttttcattttcacttctatttctcgttcttctatcgttttatgttcagacgggtttctccgtgtagaaagcagtttatgaagatttactttcgacagtcttctctctactttctacagtgaattctctgaygtgtctgggagtwtgggggtctgggtaagartcctcctctcaccctattctctattacgatccacagcctcatgctttatgarattggtggccgggarcgggggagatttgcggatcccccaagccagactttatccccctatccctgcctctggatcccacgtacaggcctgggaactccctgtgggtaggggccaatggtctcgcactctcacctgtaccccagggctggcacaggatggtcaaggagagaggctgcccaagcgcatccytctggtgtccccctgacacgcctccaaagtgagcaggtaggtttcaacagccccacgttgcaggtgggagatgaagctcagggtggagaccagtatctcacagttctctttgcatggccgggtacttgttagtcaactgatcaagtgaaaattctagccccagaggcaggagaatccggaacaaaattaaaccagccagg

SEQ ID NO: 2325 - DNA, 1351 bp, Homo sapiens
  misc_feature (240)..(240): n equals a,t,g, or c
  misc_feature (415)..(415): n equals a,t,g, or c
  misc_feature (729)..(729): n equals a,t,g, or c
  misc_feature (766)..(766): n equals a,t,g, or c
  misc_feature (806)..(807): n equals a,t,g, or c
cttttcctacttggaattgagaatggttcccatcatcttttgaacaagatactgagtggttctcattctgagatgcagcagttcctttttttttttctttttttagagatggagtctcgccctttcgcccgggctggagtgcagtggtgtgatcttggcccactgcattckcygcttcmtgagtagctgggatyacaggctcccgccaccatgccaggctaatttttgtatttttagtanagacgggatttcaccatgttggccaggctagtctcgacctcctgacctcaagtgatctgcctgcctcagcctcccaaagtgttgggattacaggcatgagccactgcgcccagccagcagttactttctaggagggtggartggaagaatcgagggggatagagcagaaatggcntggctgtgaaagaataagcatgcagatggaaatgtttccaggaagaagttcattgttgaaagaatattttgatctctaagtctcaaaagcaaacatttaatctactgtgatgcttttccttttttaggagtagatttggtaagaaaaggaattcctaacttctctggttgcagcatccttccatcaacatctccaamagaraartgccaggtaatatagataacctttttgctttccargggtgagacttgcttgattgaatgcttgtgaaaatttcacctgatttctgggatgtgaaggaaaatggtcatctntggtgtaaagacacctgatatttgtgttgcacgctcngatttacgatgcacattcacttgaatctaaaaggacctgnngatttcctaaagacaaagtctttaacccaagatccgtagcagcatttctgttttgccattagaaggttgacacagggataggtgtgtcgctgctaggacagcctgccttgtctagagggaaagtgccagctccagagaccacaaccytctgaaataaaagtccagaaaactgccttgaatgttggtgtctgtaactcactggctgctagagcagagtgcctgtctttctctgctcaagaatgccctgcttgccttgagtgctactgtggttaaaactagtccagattccaccattcagtggaagtctttytggtctttctgattaaggattatgttaaaactcccagattcagactccaattttaagttaatgtgaacatgtttaggaatactagtacctttttgacttcccatgttctgtgcttttagcagtagggatttgagaccctttcagagttagatttgtgtttttttaaggcaagttgcattagatgtaaggtaggaaagagtaagaagacttaaaagtgaaaaaaaaaaaaaaaaa

SEQ ID NO: 2326 - DNA, 967 bp, Homo sapiens
ccgaaaacatcggatttattaggattagctgtagtgtacactgattcctttagctctaaatggatacatatgtgccccgcagacagtatacacgcagggatgtgactgagccacagtgacatagcaaacccaacagctggcttgtgaagccatcgtgatcccaacaaggtctatgttagcaattggtgaaagaagaagagagtgagatgggacccaggtgggcctggaggtgggatcctgtgggttttcagagcacccaccagtgctcccttggtgagcccagcaccacctggaagtggagggaagctgggtcgctgctggaagggagagaggctgactctctacccctcacctctgcaaggaactgaggcctgtagggttgcggctgtcactggctacaggcggcatctttctgtaaaaagcttttcaggcatgaaacccatttctgtatggactgggctgtgttgacggtggtgcttgggccttgtgtgccaggcctctctgggtcccctccctggcctttgccttcctctcaccttctcgaggccaagctgtgcgagacctggcattccttccaaacctcagttcctccacgcccctgcgctggtgtgactccagagctcagaatgtcagcacggagccgtcagtatcgagaaggaactcaacgcaaggcttcacagctttccaaggacagggaccggctctggagtggccgtgcgtgagatgtcaggcacgctcacacgcagggtcctgtgttggctcctgacccagcagggggacatggtgggcggatgtaccagcccttctggataacatgacagtcccaatttcaggaaagtttttattttaaatattggtgattctttaaccaggaatgcaaatgctactgaagtgctgtgtgtgtctctgtgagagccttcatataaataaattggaattcgatatcaagcttatcgataccgtcgac

SEQ ID NO: 2327 - DNA, 807 bp, Homo sapiens
  misc_feature (128)..(128): n equals a,t,g, or c
  misc_feature (634)..(634): n equals a,t,g, or c
gggggttttttttttttttyttytytgaaaaaggtagtgcccttcgtgacttccctgtcccttcccttggcttctccgaggcctggccaccggcagacccaggggcgttggactcgtggctccggagnatgaggatgtcactggccgactcattggcctgtagtgtctgcgtggctttgactgccgctgcccgcctgctgcgctctcgcccctcttcctgctcctccttctcttggatctctggcacctcctcctccccctccttcctgggctccttcacctccctcttgggctccagcctctcttcacttggggactctcttctgggaagaggcacccttgggaacttttgggaagtcttaatatccacttcaacctcttcctgggccgacttctcatcgctcgtatccacatccccaaaggttagagtcccattgcggccgattttcacctgcttcttgtaggtgtagtagaactccacgcactgggccacggtcttggtctggatcagcttctgcaccaggaagaaatccttcttgtagatggcaatgcctttgttgaacagcttcctctcggccatcttccactggtcagagcctgtgtagtgataagttgccagcggatggttgtgggnccgcaggggcttcttcagcagcagcttattcagcgtttccaggatgtctcctctggattcgtgcagacagtgcagggccagctcctggttggtgccagcaccagggaaaatgctggagcaggcggctgtcagcaggtcttccactggatccacaggagcatgaggagggaggg

SEQ ID NO: 2328 - DNA, 1865 bp, Homo sapiens
  misc_feature (1859)..(1859): n equals a,t,g, or c
cgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagttcctctggattatgagtttctggccactgagggcaaaagtgtctgttaaaaatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatattcaggatcatttctctttcttcagggccagacagcttttaattgaaattgttatttcacaggccagggttcagttctgctcctccactataagtctaatgttctgactctctcctggtgctcaataaatatctaatcataacagcaaaaaaaaaaaaaaaaaaaaaaaaaaaaaaaaaaaaaaaaaaaaaaaaaaaaaaaaaaaaaaaaaaaaaaaaaaaaaaanaaaaaa

SEQ ID NO: 2329 - DNA, 1059 bp, Homo sapiens
tcgacccacgcgtccgaaataaagcattctatgaatttataatgccatgcaaataaaaatgtgctccagttattgtttgatgacctctggtcatggcttctcattcactgggcaagaggaagcccagaaccaataacggaagctcaacatagttctgcagcagcttcacaaattctgtactcagcatgcttgtcttattacttttctggtctttaggttggaacaagaaagtagtcttacccctggattctttatgtccttgaaagagttattgacatatattgttttcctttttggattagcatcagagttcatagaatcttctaggcttgtaggattgttgcttagtttataataaacaaaggtctacctagctcatattgttcttttgtgaaaagtagaaaaaaatggcctatttggaaatctcaccctcatgggccatgtcttagtaagcagaatgtgggactgacctcagcatccccatacccattcactcagatgcccttttgcaatggcccaggagagtaatttwagacattaattcctcttagaagatttaaacaatgtagtagtttgtaacatcacataattagatctcaaaacaagccttctgtgttagtccgttctcacattgctataaagatctacctgagactgggtaatttatgaagaaaagaggtttaattgactcacagttccacaggctgtwcaggaagcatggctgagaggcctcaggaaacttacgttcatggcagaaggtgaaggggaagcaaatacatcttaccatagtggagcaggagagagagagagtgaaggggaaggtgctacacacttttaagcaaccagatctcatgggaactcactcaccatcatgagaacagcatgtggaaaatccactcccgtgatccmatcacatcccaccagatccctcccccaaaactgggaactacaaattggcttgagatttgggtaaggacacagaacaaaactatataattctgttcytggccccacctaaatctcatgttcttctcacatttcaaaaaaaaaagggcggcc

SEQ ID NO: 2330 - DNA, 2057 bp, Homo sapiens
ccacgcgtccgcccaaggtcagagagaaagacattgagatgttccttgagtccagccgcagcaaatttataggttacactctaggcagtgacacgaacacagtggtggggctgcccaggccaatccacgaaagcatcaagactctgaaacagcacaagtacacgtcgattgcagaggtccaggcacagatggaggaggaatacctccgctcccctctctcagggggagaagaagaagttgagcaagtccctgcagaaaccctctaccaaggcttgctccccagcctgcctcagtatatgattgccctcctgaagatcctgttggctgcagcacccacctcaaaagccaaaacagactcaatcaacatcctagcggacgtcttgcctgaggagatgcccaccacagtgttgcagagcatgaagctgggggtggatgtaaaccgccacaaagaggtcattgttaaggccatttctgctgtcctgctgctgctgctcaagcactttaagttgaaccatgtctaccagtttgaatacatggcccagcacctggtgtttgccaactgcattcctttgatcctaaagttcttcaatcaaaacatcatgtcctacatcactgccaagaacagcatttctgtcctggattaccctcactgcgtggtgcatgagctgccagagctgacggcggagagtttggaagcaggtgacagtaaccaattttgctggaggaacctcttttcttgtatcaatctgcttcggatcttgaacaagctgacaaagtggaagcattcaaggacaatgatgctggtggtgttcaagtcagcccccatcttgaagcgggccctaaaggtgaaacaagccatgatgcagctctatgtgctgaagctgctcaaggtacagaccaaatacttggggcggcagtggcgaaagagcaacatgaagaccatgtctgccatctaccagaaggtgcggcatcggctgaacgacgactgggcatacggcaatgatcttgatgcccggccttgggacttccaggcagaggagtgtgcccttcgtgccaacattgaacgcttcaacgcccggcgctatgaccgggcccacagcaaccctgacttcctgccagtggacaactgcctgcagagtgtcctgggccaacgggtggacctccctgaggactttcagatgaactatgacctctggttagaaagggaggtcttctccaagcccatttcctgggaagagctgctgcagtgaggctgttggttaggggactgaaatggagagaaaagatgatctgaaggtacctgtgggactgtcctagttcattgctgcagtgctcccatcccccaccaggtggcagcacagccccactgtgtcttccgcagtctgtcctgggcttgggtgagcccagcttgacctccccttggttcccagggtcctgctccgaagcagtcatctctgcctgagatccattcttcctttacttcccccaccctcctctcttggatatggttggttttggctcatttcacaatcagcccaaggctgggaaagctggaatgggatgggaacccctccgccgtgcatctgaatttcaggggtcatgctgatgcctctcgagacatacaaatccttgctttgtcagcttgcaaaggaggagagtttaggattagggccagggccagaaagtcggtatcttggttgtgctctggggtgggggtggggtgtttctgatgttattccagcctcctgctacattatatccagaagtaattgcggaggctccttcagctgcctcagcactttgattttggacagggacaaggtaggaagagaagcttcccttaaccagaggggccatttttccttttggctttcgagggcctgtaaatatctatatataattctgtgtgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2331 - DNA, 2652 bp, Homo sapiens
ccacgcgtccgttctgaggtgcattctttttttgatgagaggcatctctaggtaccatccctgacctggtcctcatgctgccgaggctgttgctgttgatctgtgctccactctgtgaacctgccgagctgtttttgatagccagcccctcccatcccacagaggggagcccagtgaccctgacgtgtaagatgccctttctacagagttcagatgcccagttccagttctgctttttcagagacacccgggccttgggcccaggctggagcagctcccccaagctccagatcgctgccatgtggaaagaagacacagggtcatactggtgcgaggcacagacaatggcgtccaaagtcttgaggagcaggagatcccagataaatgtgcacatcccggtgtctcgcccaatcctcatgctcagggctcccagggcccaggctgcagtggaggatgtgctggagcttcactgtgaggccctgagaggctctcctccaatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttccagccttaccccaagagttcacctacctcaactcacctaccccagggcagctacagcctatatatgaaaatgtgaatgttgtaagtggggatgaggtttattcactggcgtactataaccagccggagcaggaatcagtagcagcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctcctttgaaaacaggtcatattgtgctcttctgtttacaagaggaaacaagatggaataaaagaaattgggatcttgggttggagggacagtgaagcttagagcacatgaactcaaggttagtgactctgcaggacttcacagagagagctgtgcccatcattcagtccaagtgctttctctgcccagacagcacagaactccagccccgctacttacatggatcatcgagtttccacctaaaatatgattctatttattttgagtcactgttaccaaattagaactaaaacaaagttacataaaaagttattgtgactccacttaattttagtgacgtatttttgtatatataggccaacctataccacatccaaaattatgtatctattacagcccctagaagctttataaatacagtgtgtcttcttttattcacaaaatttttgaaatcgtggtaatatggtttgaaacctgtatcttaattattttttttttaaattgagacagggtctcactctgtcactcaatctggaatgcagtggcacaatcttgcctcactgcaacgcctgcctctcaggctcaagcaaacctctcacctcagcctgctgagtagctgggactacaggcacatgccaccaaacttggccattttttgtcttacgtagagacaagatttcaccgttttgcccaggctggtctcaaactcctgggctcaagcaatgtattgaattttaaaataaccaggcactcactcttatgaattaataaacatttggaggtatataaagtaaaaagttaaagtctttcctgtaagttaacacaaatgttaactattgttaaaaactttacaggtagctctctagatatttttctatttttgtatgtatacttatgcatacatgtaagtatataaacatttagaagtgtacctatctaacaaactattatgaaatactttcaaatctgtaaatagatctattatactattttaaaagtctctatagtagtgtgttatatagataaatcataacttttttctttttttattgtagtaaatatgcacaacataaaattgatcattttaaccatttttaagtgtacaattcagtggcattaagtactatcataatatattttaatccttctcatcactggtggacattaaggagactctcaaaaaattcatattataaaaacaaagttcaaacaaatgtctttgtactagcatattatggcactcctgctggattatctgaaggataaatttgtaaatctagtattgctagattatgcatattaaatattcttgttaaatagtcaaaaaaaaaaaaaaaa

SEQ ID NO: 2332 - DNA, 569 bp, Homo sapiens
  misc_feature (196)..(196): n equals a,t,g, or c
  misc_feature (503)..(503): n equals a,t,g, or c
cgctgcccctcccctggtccccgcgagctcggagggcccggctggtgctgcgggggccccgggaggtacggacctgggaggcgaggctcgtccggcgctaggatcggcctccgcctccgggccgctttaggtggctggtctctgcctctcattccctctgggggctcccccgtgagaaaatctgtggcggaggcanctctggcccactcttayggwgtccyttattgtggggctcgctatatggagagggggtctgtgtcaggagcttcccctggagaggtttctgttarggaccgtctttgggagtgatctatctctgctctctgggggggatctttgtctggagcttttggggggcttgtgtttggaagtttgccttcggggagatatctgtctgggacctcttagggtttctgtatctgagctttctcttttgtgtctgtcagtccaagggcagcaaaaagtatgtcctttctgaagcctttttttccgtaggtttcttnattcttttctctcttgtcttatgttcattttagccatagacttgactggagtttagagggaattga

SEQ ID NO: 2333 - DNA, 2288 bp, Homo sapiens
  misc_feature (940)..(940): n equals a,t,g, or c
  misc_feature (1279)..(1279): n equals a,t,g, or c
  misc_feature (1798)..(1798): n equals a,t,g, or c
  misc_feature (2280)..(2280): n equals a,t,g, or c
  misc_feature (2285)..(2285): n equals a,t,g, or c
gatcccattcttctctcggtgggaatgcttgtggggggaaaaagaaacgcaatagataaagcggggcgcatgcgctcccggcacaggcwtcgattgtgaggaargccggctagtctccgagctcatcccgccttgcgcatgcggagaaggtaaaccagcgccccgagttgaggcgcgggtttggtggcgcgtttcagcgaagtcgcacgtgaaggatagcagtggcctgagaaagacccagtcatggcagcctccagcatcagttcaccatggggaaagcatgtgttcaaagccattctgatggtcctagtggcccttatcctcctccactcagcattggcccagtcccgtcgagactttgcaccaccaggccaacagaagagagaagccccagttgatgtcttgacccagataggtcgatctgtgcgagggacactggatgcctggattgggccagagaccatgcacctggtgtcagagtcttcgtcccaagtgttgtgggccatctcatcagccatttctgtggccttctttgctctgtctgggatcgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcctgacccttccacccgggccctgctactcctggccttgctgatcctctacgccctgctgagccggytcactggctcccgagcctctggggcccaactcgaggccaaggtgcgagggctggaacgccaggtggaggagctgcgctggcgccagaggcagncggccaagggggcccgcagtgtggaggaggagtgagccggatgccccacacaccgccagtgtcataccaaagagctgagctgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccanaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccntgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactccaaaaaaaaaaaaaaaagggsggccctctanagggncca

SEQ ID NO: 2334 - DNA, 1494 bp, Homo sapiens
acgcgtccgcagcattcgggccgagatgtctcgctccgtggccttagctgtgctcgcgctactctctctttctggcctggaggctatccagcgtgagtcctctcctacccttcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggagtggggaagggggtgcgcacccgggacgcgcgctacttgcccctttcggcggggagcaggggagacctttggcctacggcgacgggagggtcgggacaaagtttagggcgtcgataagcgtcagagcgccgaggttgggggagggtttctcttccgctctttcgcggggcctctggctcccccagcgcagctggagtgggggacgggtaggctcgtcccaaaggcgcggcgctgaggtttgtgaacgcgtggaggggcgcttggggtctgggggaggcgtcgcccgggtaagcctgtctgctgcggctctgcttcccttagactggagagctgtggacttcgtctaggcgcccgctaagttcgcatgtcctagcacctctgggtctatgtggggccacaccgtggggaggaaacagcacgcgacgtttgtagaatgcttggctgtgataaaagcggtttcgaataattaacttatttgttcccatcacatgtcacttttaaaaaattataagaactacccgttattgacatctttctgtgtgccaaggactttatgtgctttgcgtcatttaattttgaaaacagttatcttccgccatagataactacatggttatcttctgcctctcacagatgaagaaactaaggcaccgagattttaagaaacttaattacacaggggataaatgggcagcaatcgagattgaagtcaagcctaaccagggcttttgcgggagcgcatgccttttggctgtaattcgtgcatttttttttaagaaaaacgcctgccttctgcgtgagattctccagagcaaactgggcggcatgggccctgtggtcttttcgtacagagggcttcctctttggctctttgcctggttgtttccaagatgtactgtgcctcttactttcggttttgaaaacatgagggggttgggcgtggtagcttacgcctgtaatcccagcacttagggaggccgaggcgggaggatggcttgaggtccgtagttgagaccagcctggccaacatggtgaagcctggtctctacaaaaaataataacaaaaattagccgggtgtggtggctcgtgcctgtggtcccagctgctccggtggctgaggcgggaggatctcttgagcttaggcttttgagctatcatggcgccagtgcactccagcgtgggcaacagagcgagaccctgtctctcaaaaaagaaaaaaaaaaaaaaa

SEQ ID NO: 2335 - DNA, 1081 bp, Homo sapiens
gccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagtgagtaagacccaggggcaacagtctaccctttgagtgggccgaacccacttccagctctgctgcctccaggaagcccctgggccatgaagtgctggcagtgagcggatggacctagcacttcccctctctggccttagcttcctcctctcttatggggataacagctacctcatggatcacaataagagaacaagagtgaaagagttttgtaaccttcaagtgctgttcagctgcggggatttagcacaggagactctacgctcaccctcagcaacctttctgccccagcagctctcttcctgctaacatctcaggctcccagcccagccaccattactgtggcctgatctggactatcatggtggcaggttccatggactgcagaactccagctgcatggaaagggccagctgcagactttgagccagaaatgcaaacgggaggcctctgggactcagtcagagcgctttggctgaatgaggggtggaaccgagggaagaaggtgcgtcggagtggcagatgcaggaaatgagctgtctattagccttgcctgccccacccatgaggtaggcagaaatcctcactgccagcccctcttaaacaggtagagagctgtgagccccagccccacctgactccagcacacctggcgagtagtagctgtcaataaatctatggtaaacagaaa

SEQ ID NO: 2336 - DNA, 879 bp, Homo sapiens
  misc_feature (868)..(868): n equals a,t,g, or c
agaggatcccagcgccccttggtatcctcggtggacagggtccgggcaagtgtcattgcgagggttcaggaagccccggcctgtgatcgtgagcggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagaccaacaaggcttgggccaagggggacatccagggggcaggggccgcctcccgccgtgccttcctgctgggggtcctcgccgtcgggctgggcgtgtgcacgtatgcggctgccctggtgaccctggcygcctaccttgcctcccgagacccgccctagttgcccctacagccctcactgtgaaccctgaggccggcagcccagcaaatctgtgggcagmgagtggagaatcttggtggatgaggctgcggcggcggcaggagcatctagaaacgggagcgagctggactggaacccttccccttcctggccaccgctcttcgggcggcagcaacctgagattaaacaccagacacccttgcagccaaaaaaaaaaaaaaaaanaaaaactcgag

SEQ ID NO: 2337 - DNA, 708 bp, Homo sapiens
  misc_feature (40)..(40): n equals a,t,g, or c
aggccaggcctccacagacccccatggcccccagggacgnaggggaggacagagcccttcagaacagaggcctcatctcactgcatcccccatcaccccctagttccccaatggtcctaatttgtgttctgagatcccagtttactccgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgccaaaaaaaaaaaaaaaaaaaaaaaagggcggccgc

SEQ ID NO: 2338 - DNA, 888 bp, Homo sapiens
ccggagttcagctttaacatacctcgtgccaaaagagagctggctcagctgaacaaatgcacctccccacagcagaagcttgtctgcttgcgaaaagtggtgcagctcattacacagtctccaagccagagagtgaacctggagaccatgtgtgctgatgatctgctatcagtcctgttatacttgcttgtgaaaacggagatccctaattggatggcaaatttgagttacatcaaaaacttcaggtttagcagcttggcaaaggatgaactgggatactgcctgacctcattcgaagctgccattgaatatattcggcaaggaagcctctctgctaaaccccctgagtctgagggatttggagacaggctgttccttaagcagagaatgagcttactctctcagatgacttcgtctcccaccgactgcctgtttaagcacattgcatcaggtaaccagaaagaagtggagagacttctgagccaagaggaccatgataaagataccgtccaaaagatgtgtcaccctctctgattctgcgatgactgtgagaaactcgtctctgggaggttgaatgatccctcagttgtcactccattctccagagacgacagggggcacacccctctccatgtggctgctgtctgtgggcaggcatccctcatcgacctcctggtttccaagggcgccatggtaaatgccacagactaccatggagccactccgctccaactggcctgtcagaagggctaccagagcgtgacgctgctgctgctgcactacaaggccagcgcggaagtgcaggacaacaatgggaatacgccactccacctggcctgcacctacggtcacgaggacgtgagtggctcttgctgttccgggggggct

SEQ ID NO: 2339 - DNA, 980 bp, Homo sapiens
tcgacccacgcgtccgcggcgcgctcacaatggagctctcggagtctgtgcagaaaggcttccagatgctggcggatccccgctccttcgactccaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaaaaaaaaaaaaaaaaaaaaaaaaaaaaaaaaaaaaaaaaaaaaaaaaagggcggcc

SEQ ID NO: 2340 - DNA, 1324 bp, Homo sapiens
gacagactgttttttgcaagaccacattatattactttattattttctgctttttcttttaacgacattagtgtttttgatcactatattttaaaatgctttttgtgagccttttggttatgtggaatctgttccttagctctgattttttattcttatggagcgtcttaggttactacatgaaggtaagactgccacagtcccccagggaggcacactgtgttttactgattgatttgaagatgatagagagcctagggggatgagtctattggactcaaaggttacattttgtttttccatttaatttaataatcaacaaaacgacaaagtcagtttaatatctttcttctgctgagtcttcaggatgttagctagtctttcaaaagccattgctacaaaagtgcaaatttctcatttcctgtgggtctctasaaactctctcaatatttaaagccaaacaaatccatcttttctgagagacagaaactaaaaaattcagagttaattcactattaaaaacagcaaggccctgctatttcccaagaataaagaaatttaaaattctcattgtaagaagtatgaacttgaagctagaattggtttatttctggcagctacttacaatattaagaactttactttttaaatttgagacaatttcacaggaaagcaagaaattagtctattgtgaaatgtttttacaactaacttggaatatactgcaaatcactagtaagtagagacacatttaagataaaatgattaataaaacaattggtaattctgaataaggatctgaataaatccagatcacagactgttcctttaccaatatgtaaaagaatgtgcaaaattmgtaaaaatatacccaaaaatttaccagcaacagagaagcaaagaatggagttcaaccttacactataaacatctaatagatatgtatgaaaatttaaaaactagaaaaggttgggcatggtggctcatgcttgtgatcccaggactttaggaggccaaggtgggaggattgtttgagcccaggagttcaagaccagcttgagcaatatagtgagaccctgtctctacaaaaacaaacaaacaaacaaacaaataaataaataaataaaattagctgggaatggtgatgcacacctggagtcctagctactcagaaggctgaggcaggacgatcacttgacctcagaagtctgaggttacagtgagctatgatcataccagtgcactccagtctgggtgacagaacaagaccctgtctccaaaaattaaataaataaaacaaaaaaaaaaaaaaaagggcggccgc

SEQ ID NO: 2341 - DNA, 3649 bp, Homo sapiens
  misc_feature (1317)..(1317): n equals a,t,g, or c
  misc_feature (1500)..(1500): n equals a,t,g, or c
ccacgcgtccgcccacgcgtccgaggtcttcttcatggtggtggcagcggtgtacattctgtacctcttgttcttgatagtgcgggcgtgttccgagctacgtcacatgccttatgtggatctcaggttgaaatttttgactgcattgactttcgtagtacttgtcattagcatcgccatcctttatttgagatttggggcgcaagtactacaagacaattttgtagcagagctgtcaactcactaccagaattcagccgagttcttatctttctatggcctgttgaacttctatctctacaccttggcctttgtatattctccatcgaagaatgccctctatgagtcccagctgaaagacaatcctgccttctccatgctgaatgactcggatgatgatgtgatttatgggagtgactatgaggaaatgccgctgcagaacggccaggccatccgggccaagtacaaggaggagtcagatagtgactgagccccggccagcccagcgaggcgacaagatgcctggatgctttccccggtgaccgtctgttgaccttcccctgttatattcagatttttcttacaagcagagatttcctgttcatttgtttacatatttttttaaaggaaaaccaaaactgagggtaaatttaaatgtttagccaaatttattgtcatggtggctacgagaagaggcattgataacaagtttcaacagccaaatccttttttacagagatttcagatgagcgtgttttcagtgatgaggaaatttcacgtttttagtacagtgaattatgtacttttttttcctgtaatcattcactgattccaagttcacgggcagcctgtgactaggtcctcagcgtgacagcatcaccctctttcttcccttttccatggtactgttttgtgaccctttaaactcaaagggaagccttatctgtggctgcttcagggcagtccttcctcgttgagtggccagtgccctgggtaaccaggtggctgaagtgattggtcagttatgtggactgcgttttgtgcagtgtgtgagttatgactcatcgggaatgggagatgctggggttccaacccttcacgtcaccaaaggggaagtaatagtgtggagttctgaggagggtttgataagttgaataaggaaaggctaagataatttacaggttaccaactcatgtggggaagggcttactgccatggggcttttcaggggcctgtgtgtacacacatgattaaatggatttgcctgtgggaggtatgggcaggagaggaacccttaccattccagtaaatagcagnttctgcaattctgttgaatatgaaatgccatagagctttatttatttatgtaagtaaaagctaaatgaggggccaggtgcagtggctcacatctggaatctcaacactttgggaggccaaggtgggaggatcacttgagcccaggagtttgagaccagcctgggcaacacagggagaccccgnctctataaaacatttagaaagttggctgggcatgctggggcatgcccatagtcccagctactcaggaggctgaggtgggaggattgcttgagccctggaggtcaaggctgcagtgagccatgattgcaccactgcactccagcctgggtgtcagagcgagaacccgtgtcataaataaataaagctacatgaaagattgatagaatattttagattatttattggccaaaagtttttaaaactcatatttggaagcaaaatgaaaagcaagtaaaatgttttaaatggttcatggaaaacgtatttgggtagaaggcaactcgtgcttccggaaggggttccctgtcctccatgtgtccacatggcggtcaggtagggacgacctgttctgtaaagtccttggcactgctgaatctgtggcatcatagaaggccctggagcttccccgttcctttcagtcagggactccatatagagtctcatgtggacgtctcccgtgctttcctcttgacctctacagtcacacttctgttaacatctggtaactgtgggcaacctgactgatgccgtcttggcaattgaggtccagaagatgatagttccgcaacgcaagcagtacctactttttttcttcatctatgcattgactctcagattaccatgcagagcttcacgttatcatccacgttaagtagtgctaggtaggaccttagagatgttcatgagaaactatttgctatgactttcctttgtatctttccttttaatttaaactttaatgataatgtacttttaatatggattctattcacatttgttttaaaaaccttgtaaatatgaatgtttaagacaacttactgcaagggtaattcaagtttacatgatttttaaatttgcaatgatgctttttttattctgtgtattgaaaaaaattttctgttaccaaattttacaacttctaataagactactataactttatgtaaactgatgaagatgtgctgattaacatattctgtgatatggtttacaacttttaatcataattgtccatgattttggaatgctgttatttatcagtaaatgtaaaatatttgaggcatttagccatacacacactagaactttttaaaactttgtcctatagtgtaattataaactgatgactattatcttcatacattgagtcttcatgcatcaatgaaatgaaaaatataggattatttatttactttttgtaactaagtgggaaataagaaaaaaagttagaaagtacttaaggggaaaatcgttcttactaagtcatgtattttcaacttgtcttccctggtatatcataaataccgacatattacataccccatgtaaaattttgcttaaactctctagcacttggcatgtagaatatgtaccataggtatcaggttaaaacactaaagtctgccagaaacttttgacagtagcaagaaaattgttgaagaaaaaataaattatttactgagggtagttatgttaaagttttgcgaacttaaagggctgactttagttccttcatggtaatggcttgagtaacatcatctttgggattttttaaatactggtccagtctaggagaacctggaagatgaccagaggtatttcagtttccctagggagagcttcgttatccatgtggatgataagtctgcttgatttattattaaatcattatagcagtgaagtggtgccattttctctctcttaagccccatttgaaaggctagagaaggggatatatatactatgttcaaggtttgtaaggttgttaatgtacataattgcagattgcaataaaagcttagatacattttgtaaacccaacccactaaatgagcaggttacaagacaaatgtcaccagcctcaagtattttatgaactatttactgagggtagttatgttaaatagattataatgtggtaaattatttcctgaatcctttatcacaggaaaaacacagaccctcataaaagggataattaaaacggatgtgtctgaacatttagtgaagatgagacttaaaacatgaaagtgtatttgtgtattttgagggttttagaaaccggttgccttagaggttagacttttgaagaaaaaaaaaaaaaaaaaaa

SEQ ID NO: 2342 - DNA, 2581 bp, Homo sapiens
gctgacattgatacaggtcaaaatgcgtagatgctttttggtgttggaaataagtgtctgtcttatggtcatcattgtcttcttagatttttgggtaggggggccaggtagggggagactcagaaataaaagcgttccccagataacttcaatctggaaagaattttttgtatagagtccatctctccctcaagactgaccacaggtttcatgagaaggtccctgaaaacatcacatttctctgaagaaccatcaacttgtcttttcttgaaccacaggaatggttctacagaccctactataattcttcacatttcagaacccatgtttaatggagggaagagagaaatgcatggggaaaagaacacctccttttctcctttctcttaaattcaaagacgtttgctttgggaatgccctcacttctccctattcacaggcttctaaaatcattaatttactcaaggcacatgtgccttctttgccccaaatgcatcactttccttttagttatggctgattttgggtgtgtgtgtgtaagacatgcagtcaacaaygagatgaaggccattgcatagatctcatgcagatagtgatggattcagaaagtaggttccagtggcgtcactaccttcttgtaagccagtatacactggctatttgtggaaatctctttgggagatcaaatagagtattatgccactgtgagtgtttataaactggaaggaacaagtacctgtgtttcttgggacacaaagcactcagatcctgagtggatgcagacatgagagtaaatgtcagcccaaattaggcccctcgacctacagacatttcatgggttttatttaatcacaccccatggtttggggctacatgaggaagttggtaatgagctgaatttcttattcagtggaaaaaactgaaactgtctaaaaacacgggatatattttagaggcaattgtggaagcggagagaatgagatgatggtgttcagagggaccagcttctttttcagttgtctttagaactcaagaataatcaataatttagtgccccttcaacagccatactcagcaagaagaatcagaagcttgatcctctaacagaaatagaagagggtagctttgcccattgccactgtctttactgccccttctgcccctccacccacatccacattcagcatcactccaaggatgtgtcagcatcttgcccatgcaggtagaaatttgtgagtaggcctccatacttcctcgggggaagaaagagaaactagtgctggttttaagaatgtagctggcttttcatcagaacccttatgctaacctgaccacacttgctctcggggaagttcaagcctgtgatgtgcataaactccaacaagcctggctttggtgttcagcatgcacattccataaatatctcttgcaggcataccccacagctagactgcaggattaaaataacttccaaaaggtgctggattggagtttgttcaaatttctcattaaccactaatgttaattcataccaaatgcaaagtattctaaaccagctgatgctgtcagtgttcaagttttaagtgacttcaaacacaatggaagtgtttcaatgggagccagatctcatgagtaaaaatccattttataatagctctgtgatatatcagtgggagatgattcataggggagagatttgaacaagcagaattaagtgttagcaaaaatgctgcattgctttgattcatgtttaaagacctaaatttctatgcacaaggaataaagggcctacttaccaagtgtaaatcacaacataggctaccaaaatatttcttatttgctaggagaacaaagctgtcacggtgcatgatagttggacagagatggctaaaaaagaggcaaattcagatttggaaacagggtggcctcttcattatttattgccaagatctgaaaatcttcaacatcttataagacaacaatgaagtagcccctgaacagcatggagttgctgtgagtttgttcgttgcagacctttgtgttgggtcctgggaatctgagctttgttccctgtgcatggtggataattgaaaccaagaggacatgggatagaccttgtgacagaccaattctgtgacccctgtcttctgggtcacattattcattgttgatttaaatacaggactaccaaacagtacaaatctatcatgagtctggtagaaaagtaaaagtaaaagctgcacacgttacatactgtttattgttctaatgtacaactaactatttgcatataatgtgatttaatttattgctgttttgtgtagaaaaggagaactaatgactgtggatataacccatgttttgtataatatattttatttcttgtgcgaactggtcatttaaaatatctacttcatttgatgtttggatataaatgtgtatgtgtccttgtaaatgtttctatcaagcaagaatgccacgtactcagagtataacaatgtgttctcattaaaaaatacatcccaaaaaaaaaaaaaaaaaaaaaaaaaaaaaaaaaaaaaaaaaaaaaaagggcggccgc

SEQ ID NO: 2343 - DNA, 3608 bp, Homo sapiens
ccacgcgtccggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagcaaaaagatggcacctttgcagcagggggctacatgccccctctccggtttaaagcacttaccctctctgtggtgtttggaaccatggttggtggcatccttatccccaacgtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggaggaagctggcagggcggagatgctggaccacgccgtcctgcttcaggtgatcaaagaacagcaggtgcagcaaaagcgcttgctggaccagcaggagaagctgctggcggtgatcgaggagcagcacaaggagatccaccagcagaggcaggaggacgaggaggataaacccaggcaggtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccagggcaagctgagagatggccagaaggatgccgcccccagggcagctggcactgtgaaggagctccccaagggcccggagcaggtgcccgtgccagaccccgccagggaagccgggggcccagaggagcgcctcgcagaggaattccctgggcaaagtcaggacgttactggcggttcccaagacaggaaaaaacctgggaaggaggtggcagccactggcaccagcattctgaaggaagccaactggctcgtggcagggccaggagcagagacgggggaccctcgcatgaagcccaagcaagtgagccgagacctgggccttgcagcggacctgcccggtggggcggaaggagcagctgcacagccccaggctgtgttacgccagccggaactgcgggtcatctctgatggcgagcagggtggacagcagggccaccggctggaccatggcggtcacctggagatgagaaaggcccgcgggggggaccatgtgcctgtgtcccacgagcagccgagaggcggggaggacgctgctgtccaggagcccaggcagaggccagagccagagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcattggccttaaccccctgcctgatgtccaggtgaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggagaaacggcctccgctgcgagctggctggtgcactcccaggctcaggctggggagctgctgcgtctgtggtcaggcctcctgctcctgccagggagcacgcgtggtcttcgggttgagctcggccgtgcgtggaggtgcgcatggctgctcatggtcccaacacaggctactgtgagagccagcatccaaccccacgcttgcagtgactcagaatgataattattatgactgtttatcgatgcttcccacagtgtggtagaaagtcttgaataaacacttttgccttcacccaaaaaaaaaaaaaaaaaaaaaaaaaaaaaaaaaaa

SEQ ID NO: 2344 - DNA, 1731 bp, Homo sapiens
cccgggtcgacccacgcgtccgtaaaattgaattttgcagactaaattattttataaggctgttgctattgaaagatcaattttgtctttacctgcatttaaaatggaacagctcttagcagctgtggtttttttttccatattttttttaaatttgttggctcttaagatgaataaagtttataggtgcatctgcctcctcttctctaagaatatgcatactaatgtttgtttctataaatcaaatacacatgtgataatatgcatgtaaatacataactatcctcatcatgtatggctctcagttcttaattgatgataacatgattgaattgccatatatctgtattacttgtgtgaatggttgtgttgaacacgctaagaacaatttgaattttattaagtacaaaaatccttaacgtttgtatgggaacattggcaagaaagaatagtgtgaaagggaactgttttagtttcctatcagtaattgtacatgcagttaaatgtttaaggtaaaatgattggtctctgtcacagctaaaagatttcagtagccttcattgagtttgggtaaaataagttgctgttcttttgtcttctttttaatatataaaagttatatttaaaaagtatataacatactatatatgttacatactaacatatatatacacaacagaaagtttattggatttagtactgatatttactgtctatttttgttactttgttcttagtaatctattatagttacctattttaaggtaaggtctgtaggcaagatatgtaagtaaaggcaagccctacaattttaaaataacaaagcttatgtcttaagttgtattttttcaaaggttcatgtttttctgagtaaatgtggtttattagcatgaaatattatgccttttacttaaattattttatgtaaaatagggcactgtttaattatgaaagggggaaaatcattccaaataagagtttaatttttattaattataaaaaactctgtattagtttcctagatgtgctagaacaaattaccacaaactgggtggctttaaacaacagaaatttattctcttaacagttccagagactaaatgtccagactcacaatgtcccagtgccatgcttcctccttaggccctaggaaagaatacttcctagcctcttcctggcttttggtggttgccagcaatccctgctgttccttagcctatagtggcttgactccaatctcagttttgttgtcaagtggtcttctaccctgtcttctatgtttgtatccgtgtccaaactctttttctagggagaccagcactggattagagttcaccatgatccaatatgacctcatcttgactacatccgcaaagaccctgtctccaaataaggtcacatttacagggtaccatgtgttaggatttgacatatcttttgggggacacaattctacccactacaggcccatatcttatctaggatgttggtggcaagaaggtgaagattactacctcttttgatataactagtttctgaggtatttaaaaatttggttttaaaaatattaagctttttgctcatttgcatgtatacttttctctcaacattgttttggtttatttaggttatttgttaaaacttcagtaaatactaaagttacttgtattagaacataataaaagtagagaattaaactacctaaaaaaaaaaaaaaaaaaaaaaaaaaaa

SEQ ID NO: 2345 - DNA, 971 bp, Homo sapiens
gataaaatcttggtgtgtcagtgggtgagacagtgccatatcccactcggtatcatggccctagaaacatgagcttttgatgaaggcaataaaatggagcttagaaaaaacactattttgataatatactatattagcagaatgttgtttttgagatccatcttatggctctcttcattattcttttgtcattttgtacctacatcccattcattgggattccaaaatataacttctgtgtataatgccactctgcaacaaacagtgttccagcatgattctaagacagttactacatgctttacgtgaaacatgatccaaaatatcaatcaccctcaagtcctttgtatttagaatattctgactatatattcatgaaagcayttcaacttagagacatcttcattcaaaaggtgagtatccttccatatctgtctggtgtacacaatgatttacgtgctatgctcgaacaaagataaacaaaattcattaagaagcttccatttcaatagcacakgtttaatttgaatactgagttagtacttgttctgtgsctagtattaaaagcaaagtaataaaggctttgtttcatgatctttggtacatcttaccactctcgccagcaaaattttaaaatattaataaatatttgtaacattttgtttcttttgtcccttttttaaaaaatgttttcttgtctgccttccccagattttgctatctgaggccattttctcagaaggggttgtggggaggaacaggtagtgagtatttagattagactcccctctgtagagcagagccccatgacttctataggccctagacacttttgccttggtgggttcctttctccatagaaaaagtaaaacctttatttcatgtctgcattggtataaagattaataccattattattgktatcctcattttttccttctgattgaaaaaaaaaaaaaaagggcggccgc

SEQ ID NO: 2346 - DNA, 905 bp, Homo sapiens
ccacgcgtccggaaaccgttgtggatctttgttctctctgagccccttcatacttgggggtctctttcaggtgtgcagggaacagcaagatgtgcctcttgttcttgctgccacgcttccctgtgtcctggcgggcgggtgtggatggggctgctccttcctcacaggacctgtggcggatccggagcccctgtggtgactgcgaaggcttcgacgtgcacatcatggacgacatgattaaggtaggcagggccacactctgcatagtccccccgacctgctcctgtatcgcaggcctctcacagggtcccagcttgggcagcacaggctcttctgttgggggcagtgaggtcaggtgctgccattttgtgtggttcaacatgagcattgcttggtaccagccctgttcttggctccgtgctgtcaccctgtgtcagaatctccactgggcctgcacgtcctgtcattgcaactgcccctgccagtgcccacagcttcttttctagtggggctgactttccagaggccatctgggaaccttcttaggcagccatttccatggtgggggctccattcccgggaggggtacctgaggagattcccacaggttatttacatggtaggggttagcaactgggcctacgttctccagaaccatgggctgtcctgacagcgccagtggtccttggattcatgaggactgaagctgagagtcgtgttccatccacatgagaggggcagggtgaggagcatgggccgtgctgtgtattaaggaaatgcacgtggctcctgcttgtcatcccagcactctgggaacctgaggctggtggattgcttgagcccagacgtttgagaccagcttgggcaatatagcaagaccctgtctcatcaaaaaaaaaaaaaaa

SEQ ID NO: 2347 - DNA, 2545 bp, Homo sapiens
tcgacccacgcgtccgagtctctgtccgggggcctggctaaggaaaccctattacctccaggctcgcttctcatatgtgcggatgaaatatcttttcttttcctggttagtggtttttgttggaagctggattatatatgtgcagtattctacctatacagaattatgcagaggaaaggactgtaagaaaataatatgtgacaagtacaagactggagttattgatgggcctgcatgtaacagcctttgtgttacagaaactctttactttggaaaatgtttatccaccaagcccaacaatcagatgtatttagggatttgggataatctaccaggtgttgtgaaatgtcaaatggaacaagcgcttcatcttgattttggaactgaattggaaccaagaaaagaaatagtgctatttgataagccaactagaggaactactgtacaaaaatttaaagaaatggtctatagtctctttaaggcaaaattgggtgaccaaggaaacctctctgaactggttaatctcatcttgacggtggctgatggagacaaagatggccaggtttccttgggagaagcaaagtcggcatgggcacttcttcaactgaatgaatttcttctcatggtgatacttcaagataaagaacatacccccaaattaatgggattctgtggtgacctctatgtgatggaaagtgttgaatatacctctctttatggaataagccttccttgggtcattgaactttttattccatctgggttcagaagaagcatggatcagctgttcacaccatcatggccaagaaaggccaaaatagccataggacttctagaatttgtggaagatgttttccatggcccctacggaaatttcctcatgtgcgatactagtgccaaaaacctaggatataatgataagtatgatttgaaaatggtggatatgagaaaaattgtgccagagacaaacctgaaagaacttattaaggatcgtcactgtgagtctgatttggactgtgtctatggcacagattgtagaactagctgtgatcagagtacaatgaagtgtacttcagaagtgatacaaccaaacttggcaaaagcttgtcagttactcaaagactacctactgcgtggtgctccaagtgaaattcgtgaagaattagaaaagcagctttattcttgtattgctctcaaagtcacagcaaatcaaatggaaatggaacattctttgatactaaataacctaaaaacattattgtggaagaaaatttcctacactaatgactcttagttcatttggacataattaccattttaagaaacctgccacttttaaagaacaattttgagcattaaaaaaaaatggcttcaaattcctgccagttacacaaaactccttccccccaggcctgagaagccatcagtatgtgattactgaagtaatggcaggtgtaggatcaacaggtccccaagatgtcattcctgcccttttagaagccctgttacatctccgaagtacattcattgtgtaactattttgactgactttaaaaaccaatgctgtgaaaagcttcattccataaacatcaacagtgagtgatttgtagatttaccttagccaaaataccaatgctggaagcattgtgtttgcattgaagctgctgttcaacaagaaaatttataaatttactaatgtcttagcatggtaaagtttgcacattaacagaaattaagactgcaaagcaggttaaacttgcttctttataaaacagatgttgggttaatagcatggtttactgtattaaagacttatacacccatttttaacctcattcagacatcaagttatgtgtagcttcacaatggttcaagtggcttacttcaagaaatcttatacttgacagtacaccaattttattgactaaaaatggatgaactttcctaaagattcaaagggcccatcttagtatcacgcagctgactgagcccttcaaaactgacatcttaaggcccaatcaagatccacatatcctgattttgaactatgtgaaagtgggactgttaagtgcaagactaaaataaattatagcagactttttagtaataactttccattttcaaacagtatatcctgtgggccaaagggctatttcttaaagaggcatgtaaatgtatttatttatctaatgtttttttccccatgtaaacttgatatacaaggtttagtatttgctcctctttcatattattttcacacgtatactcagatttggcatgtacctttcaacatctccataaaattaaaccccttttggagaaaagatccactattttctgctcaaaggtttcgcctacctaaagtggaacatgttaaaaatctatgtgaccatcactggacagctttctctcaaaactttccttcaacgccatggattagccccagttttgtttactttaaggtacttttcccattcatcatctggttataataaatggatggaagaaataaaaaaaaaaaaaaaaaaaaaaaaaaaaaaaaaaa

SEQ ID NO: 2348 - DNA, 976 bp, Homo sapiens
  misc_feature (1)..(1): n equals a,t,g, or c
ntggagattaaatgtacttcacagaacctcagcgagcggactccagttatattccgtgctcttgtcggcacgcatttcacttctaggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccggctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatggatccccccgccacagtcctcagacgtggggtctgcaggaaaggaggacccagcacgacagggcagacccccaatacctgctcctccttgaagtccagctccacccgaggacagacgcagccggcctccgccaggccctcctgagcagccatcgcttcagtggtgctgggtcaggcggacccaagagtcagcccgtacggaagccgcgctacgtcaggcgggagcggcccctggaccaggtccacgggatccgctgccttcccgggggaggcccg

SEQ ID NO: 2349 - DNA, 1776 bp, Homo sapiens
ccacgcgtccgctgaccccacaggctctcaagtcttcccaaggccagaatcgaaagaaaattaaaatttgaatgctgaatattctggctctactctggccttttttctggttcccttccaaaatgcacaaatcatacccttgtctgctccaattcagtctccaaacctggtgcctgtgctcctggcccccctagcatcatgctatcccaggagtatcaggaccagacacatccacagccaggctcatgggtctcagacagcaacttgagttaaagctgaaactcatccttcttctctgtgttttctggtttaaaagctgcacttatattttagccttattattttctgtagttccggagagatggtgggttgccattctggtaggaaaatctgagttttcttatctttgacctagaagagattctttttggaccaacctgcgaaattggtagttaggtctatggaaagtggtaggattttttttttttaatcctgtgcaaaggaaaagaggtgctttgtgggaaatcactaatgagaaggctaacctgcagcaccagagaaacctttccaagtgctaggcaggagaactgaagaactctttcagtgaagtgagtcagcctagaagaggcaacccacagtcttgatttttgttgctgtttcctgacctgttcttgcctgtcacctgggcctacacaggtcccgagccaacggggctttcatacccaaggatctgtttccttgctgaaaatgaaaccctatctttcactttacattcctttcaatccaactgatcaaaactggtacccacacttgccctttctccctctctccagcacactcccctctaagaaagtaaaagcaaagctttcttaatggcaacactttgggcctgttctgttgctcctgccttatttctctttcaaccctgtacatgactcgtgttcaccatccccttgatcagtgtccatccgcgctaatttgcatcatgaactgaacagtgtgtgagtggtcacctactaaacccagctctgggggcagagctgtcttccccatctctggtgctcctaacacctgtgagatggtcctgtcgagaggactaggaaccgataggaggagagtccttctcggcagagctcactgcaaacaactggaattgaggttgcacactgtgatttttacaccgaaaagccaaaaggagctggccatccagggcctagggagaccagccttcctcagctatgcttgccgaaaccagcatgatgcttcaaagagccctgctccacccctcatggcatggatccttttcctggtgtggactctgaagggtcagtcttcggggaagagaggtggggtggggctactagcatcccaatttagaaaacagaggagtttgtagccagcagcctgtaaactggaaacactggtctcagccaacctcctcagggcgccctggcttctccccaaggagatgaggagcggtgatgccagcaccgggatgcgcagagcactggaagggctggtgcagatctacttcccatgcagaagagaagtcacatcttccagggaatcgcaatgttgtggcgtctgacttgtatgtcacatttgtgtaaaatggtatattctttaaaatagtgttgataactggaatattgtatgtatgcttggagatgctttgtgtgaacctaagactgtcactcaacagatgttggattggggaaaatccaaagcacaacttcaaaataaaatacatttttaggtttcaaaaaaaaaaaaaaa

SEQ ID NO: 2350 - DNA, 1918 bp, Homo sapiens
tcgacccacgcgtccgagaccctaattttcggcagatccatgccttaaaggatcacagcagagcagagctttaaaaatgagtgccaacagaaatgagaggagatgctcccccaatcaacttaggatgtcttccttttttcttgtgcctcttttttttttgtcatctgaaatattacttgtcattattggggaacttgaggccgatcgatgaagtgtatatgtgtctgtcagacatttgaagaggaaaaacatgcttcaggaataaggaaaatgcctgcagtgaaagcaaagggtcaggatgagcttcagtgactgatgagttcatttcaaaatccaagggcacatagatggtaaattaatacatatggcaaatacagtcaacgagcaaaccccagccactggaaggaaagggaattttagctctgtagtcatcacatgcctgaacagagagtctacatatcttaaatgtagatccgaatcattgctcttttatcccgctaaatgctgattgcaaagaaatatttgggcattgttgactttccgtccataaagaaaggccaccaagattcacaaaatccatcacctgcactcatacatgcatgtgtgcttgaaattcccctaggatgtgaaacagttatgcagagaactgcactgtggtctcccttcctcacttctttccctccctgtttttccttttcgaaaatgtgatacctgatctctaggtcttgcgggctgagaaattttttgtatttgtataatgcagtgtctggccttccccctgacctgctgatgtatttttggcctcattagtagtcagggagatgccttagtgcatccagcactgcaagtcagggatgagacacactacaacaggagagggagcaagcgcgagaggatattagaagagaggcttgtctccaagatatggaaggaagtgagaaatgacagggctgcaagctttgtatgtaggagcccggcagggcgggggagcggcgaggagagccaagtggattctcagaaaaggggggaagccatcgaagagctaaaggtgattagagggggatattgatttcttattctgccagagatttaagcaggcatgcgaggaatctgcaccatggttggcaaaaagagacccgttgcctcctgtaaccagacactcaggctttccaggagcccagggagcaagccgagaagaaagggggcagtgtggtctaggaaaattcaacttgtcgctgatttgtgcctgatgcctgctgtccgtcagcagcctcccttacaatctttttttctctctctccttttttttttccttgccttctccttcttcactgaagcctaggggagccagtaaagattaaatgtgcttctcaaaggcagccacttcatgctgctatgtcgaaagggccattattattattatattttaatggtaaaagagaaaaggagagaggttgagcgagcgagagagaagctaggtgtgatgatgacagactagcttttctgagaggaaaaggaaaagggaagggagagaaaaaggagagcctctgagctcaacggaggattgtgcctgagaagaacccacagaggtgagaaaaaagttgtcttgaaggtgggggtgggggggctgctaaacagacactgtacagagggagaagagacataatttagctgtgttgctagtatgattccatttttaaaggaggggagggggagagtctagagctctaactgtttttagttgcatatggaaatatctaaaaaaatatttagcatttttactaagtgcgttgaggcctctccagtgtcctcctggctgtggctgctttgtcattctctttgactagccagccatctaccttgctcaggcctggaataaaaaaaaaaaaaaaaaaaaaaaaaaaaaaaaaaaaaaaaa

SEQ ID NO: 2351 - DNA, 1181 bp, Homo sapiens
ggcacgagtcgccatctaccctctagaataaagaaatcttatcattcaccgtctaccctctagagtaaacaaatcttatcattcgccatctaccctctagaatagagaaatcttatcattcatcatctaccctccagaataaagaaatgttatcatttgccatctaccctctagaataaagaaatcttattaaggacattttcaaagccttaacagaatatgaatgattacaatattatgttttacctatacagcatcttccaagttctagtttggttgtgccaggccaaacatttgagccagatttcggcaagatcaagcaggagactctggcgtctgtcgctgattaccttcccgccatacctggccaccagcctttcccatggaccccacgtgtgtctccagactcttgggtatgaatcctgtgaacacactgacctctgctttctacatgactgacaagcactatgaaatttgcataaatatgaatagaaaatatactgtccccacatcccctaaaataaaactgagtcctcacccatgggcttttgctggattatactaagaaaaaggcaggtcttacaacacacattcccatagactcacatctcagagaagattccttccacaggctcagggtcctgaacacactgctccactctcagggctcggagacactctgcaggtgggtcttcaccccatccgggagccctaattccttcttcctcggtttttcatacagtgatttttcccagtactgctgtctactttcctctgccagaaattccttgctggatccatggcaatctcctcaggactcctatttcataaaatggaaatggaattcttcatatgccttaaaaagtaaaataattatccaaacaatataaaatacaaacacccatctagcaaaatatttcttagtacatcatgaattcaaatatatatcgtacaaaatgactgaggattttattaattttgagcaatattgaggttttctcataatatctttttattgttaacttcaaactaaataacaatcatgtctgggaataaaatgtataagatagtcatttagaaaaatttggagatttttccttccttgtccagtaaatacttaacattttacgtgcaatgtatgtcataaatatgggcattcccccaaaaaaaaaaaaaaaaaa

SEQ ID NO: 2352 - DNA, 725 bp, Homo sapiens
ggcagagcttccctagcaataattactttgcttaatttacttttttcattcttgtgcgttcctttatatttcatatattaaatatccatcaacattatataggggtctttaaacattatgtaacaagatacatattgaatgtattacactgcagcttgccttttcatttcagtgttgtttttaggtttatctgtgttgataagcgttgctgtagttcattcattttttaaacattgtatagtatttcatgatgattaaaccacaatttatttattctcctgttgatagacaattaggatgttttcagttttttgctgtgacaaatactcccgttatgggcattattttgtctcctttttacatagatacaaaagtttccctacggtatataccaagaaatggaatttctgagtttttagggtatggacattctcagctttactagattttgcctagttcatctccaaaactgtggtactaatatactttcccaccagcagtatataagagggcctgtttctccacatctttgttaaaactatatattgtcaaatttttaaattttgccaatctgggccagacactggggctcacatctgtaatcctgtaatcctagcattttggaaagcagaggcaagaggatcgcttgaggccaagagtttgggaccagcctgggcaacagagcaagaccccgactctacaaaaaaaaaaaaaaaaaactcgta

SEQ ID NO: 2353 - DNA, 2309 bp, Homo sapiens
  misc_feature (13)..(13): n equals a,t,g, or c
  misc_feature (652)..(652): n equals a,t,g, or c
  misc_feature (677)..(677): n equals a,t,g, or c
ggtaagagagaangtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgasttcagatgaggctggacatccgtcactgctgtgcccctccagcagagccccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgnaacacattcaagtctctcgtgccangggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgtttttgtttttgttttttttcatcttaatatgtaccagtggcacttaaccaaaagatacagtgatatagccatgtatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagtaaaaaaaaaaaaaaaaaactcgag

SEQ ID NO: 2354 - DNA, 2972 bp, Homo sapiens
ggcacgagtgaaaatgaccagattgttgccactacttttaagtaaagttaacaacaaacttacatgatgctgtgtaggttatacagcgttttcatgttcatcatggtcagaggcagcctggatgcaaagtggatgttatggggtggtggggggcggtgagtagtttcatgaacttttaaaaagcacttccattaaaaaattcttcctagatcttctgtaaaccttttttaaagacggctacaatgaccctggcttatttgctactatttctctgctttgttatattatcacccaagcccaccatggaccccatgctagagagggctaagacttctttttcctcatgtccacgctcccaagtcatgcttgtgtatcacctgtttcttatggacttccagtgtgttatgttgtgttagaattcccagttcagtttgagacagattttgcacttggcatattagtagttcccaccttgccattcatacttgctttgttgtttcatatttatgttttcttagcatgaaatgtagccgctggaattgtattattggccacattgtctctgattggttcaaagcaaatagagatttgatgggaaaagtcagtggattatgggcctgtacaaaagtgctttgatgaacgtcctgccatgtacatctcctcagggtatgccagaacctctctaggacacattcctcaaactgctgggtcatagcatggacacatgctttattctactagttattgtcagaaagcatttaaagtgttttaccaatttataatcctaccagctgggtatgagagttctagtttccctgtttccttattaatgcatatgtccccaaactttaaaatatttgtcagtttgatgggctgaagaaatgtgatctcattgcttttcatttgtgttttcctagttgagtgtcattttgtatattgattgaccatttgggttttcttttctgtcatttgcccttttttcatttaaaaaaaatgccttgtttgactttttgtattgatttgtaacaattctttatatattttctgcacgtcaatcctttgttatctgctgcagataccctccagtctgtgccattcatttgtttattttgtggctttggtgtacagaagttttttgttttcatgttgtcagatgtatccatctttttctttgtggtttgtgggttttgtgggggtgggtagtttttggattttgtcttatttaagaaatcttctgtaacccgaggtcatttatgcacacctgtttgtttatacttatgtgtattgcttttctcgtgaatcttcccagggcttgttcatgtctgtttagcctgtcattcctcattatgttgtttctcaaggacaaggattatatctccctcgccctttgactcttcctggtacaggccagtgcttagcacattaggtcgtagaacagaaagtaggattggccgggttcagtttgaggtttatcacttgctgtgtgatcttgaacaagttacataacctttctgggcttcagtttttataaaatgaggatgataatggtactttcctcatagggttattgatttggcagagtatcttggatatggtaagcacccataatctgcctatcagtgttattgttagtagttaagatattagaaaccatgccaaaacgtgggacctaaagtgccacatacaaattttacagttcagtgatgctgtcgatttaaatcagttacatgttggcatcagaaaaattgtctttcctgactgaagcgctgtgattactcctgtctcactcatttcctcctcttcctttgataggcaggtccacgagatccagtcttgcatgggacgcctggagacggcagacaagcagtctgtgcacagtgagtaattaactgtggagaccagagtcctttctctgatgacagggtgctaatgggctgggcttcctgactgcactctgccttgggggcttaatgattcagcgtggaatgagttttgttgttagggtggacagaaaaaccctatggcaaagtcactgatttccctgagtgtgccctttggaatcccacaagtcttatcccccattacccctccactcaacctgacatggccctatgggaatggaagcgcttgcctccatctatcttaatctaattacctagtccttagaggaatgtactccataaaaattcagagatgtttaactggaattggccatttcttctgagctgagaactgtggctttttaggaggattattcagaaacgaacagcaatattaattagtttagttcccacagcatggtttcttttgagaagcatgctggttttttgttttttttcatttttttttttttttctattctgaggaaaggtcctttttctgagttggtcatatggacaccacctgcgggggctgcctacccaccccactgctgggctccctcaggacccattcctcctgttctctcatgtctcctttcgcagcttcaaaagcagctctgttcttggttctgtgccccaccttgttctaatctcaactgtctttgttcactgtgggcacaaagggctaggaaggggcagtgtcactgctgtcacttctttatggggcaagaagcagtctggatgctttcttttgtgcacagtttagcttctttgttcatcggactttgtttgccttctcagcaatctcattgttacatgattagaaatggaaagaggtcattttgactgtcttatcgaaagggatagggaaaatgaccgtatttatcgtatctctttacctctgtggattctttcctgggcctttcctattgatatttggtttattttggggacgtcaacattgctcagcccacccattcttacagaaagctttaagggaagaaagccttaagggaactcttctctgtatgtttcacatactaatcttccccttcctttatgctttttttttttaaataaaaaaaaaaaaaa

SEQ ID NO: 2355 - DNA, 1088 bp, Homo sapiens
gaattcggcacgagtgaaattttgtcgatttcaaaaatggaaaatacataatatgccaggcacttcctgggcaatacagatacctgcagtaatggagtgagcaccagcatcttccctgatggcgtgtgcagtgaggtgactcgtctgtagtgtcctcaaggtcacgtagagagcatacagtaaatacttgttgactctttcaaacttaagttaatgatacagtcaggactgatagccattttgttgtctttcttgaaagtttacgtggaaggcagaccttgtgtatgcttttcaaaggggctcmtttagcgcacttggcgcttaagaatttgagatcagtaagtgtgatggtcctaatctttttttaaaagtattggaagtttgaacycmcctgatggggttggttttttttttttttttttccaaaaaaataatcattcaaaataatcggttaacattttcaataagagcattacatacaaggagttagggaacaaagagttttaaaatctggctctttttatctctacttagggcgtgcatcttctcttcttaccccaacatatactgactttttaggacctcctttagggagatctcaatatcccgaatttttctgtgtggagaggggaaggaatatgtctttttttgctttggtcagagtggatacattttatagtttgttttttcaaagacgggtcttctgagtcasttctttcactgctgccgtaaagaaactgtataaaggtgattgagcagtgaaggcatggataaaaggggaaatattcagcagttctgaacgtgcatgtcatcaaatataaaggagtgagaacttgatgtataagaaaaaatggaagttaaaaaaaawaaaaatccaagaatgggctgcttgttgcagtagtgaactcctcgctggaggtactagagcggagtctgtctcaaggatgctattggaagcaccccagctgtgggtggaaaactgcactttctgagcctagtcttttatagcctggrgtttttgatgctgatgcttttactacttgttcttagactwttttgccatacgctgctctgttttctcacctcca

SEQ ID NO: 2356 - DNA, 2157 bp, Homo sapiens
  misc_feature (309)..(309): n equals a,t,g, or c
caaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgancaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcmgaatttctaccacgtttctggatacagtgaaatagctaacctctgtytcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagraagtctaatgttaaaaacaactttgcctttgaamcgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagctttttttttttttttttttccagttaatgctaagaaaagatttggggaaggttataataaaagtattttgtggtgaccataagaatgtccctccccaaacaagtaaacttgtgaaagtttaatttggaattagtggaagctgttcctttgaaagccaagatattatttaagttgtaaagccagctaataaaatgccttagtttgagcataaaaaaaaaaaaaaaaaaaaaaaaaaaaactcgag

SEQ ID NO: 2357 - DNA, 685 bp, Homo sapiens
gaattcggcacgagaaacaaatgagcagttcttgggacaggtgctttgaaagactaatgtttaaaccactgtttctgaaataaattaccctttattcaaactcagactgattttggcatctgtttaatacagagtcaacgtaakkcatactgcctttttcggttactttaaaactcagaagctatttctcattcccccttgaggagatgaactcttgaactatggctttttatttttattcttccttttctgtttttgggtaagagacagggtctagctttttgtccctgagtggaatacagtggcatcatcatagctcactgcagcctcaaattcctgggctcaagcgatcctcctgcttcggcctcccaagtagcagggactgcaggcatggtggctcacgcctgtaatcccagcactgtgggaggctgaggcgggcagattacgagatcaggagatcgagagaatcctggccaacgtgatgaaaccctgtctctactgaaatacaaaaaattagctgggcatggtggtgggtgcctgtagtcccggctacttgcgaggctgaggcaggagaatcgtttgaacccaggaggcggaggttgcagtgagccaagttcacgccactgcactctagcctggcaacagagcaaacttcgtctcaaaaaaaaaaaaaaaaaaaactcga

SEQ ID NO: 2358 - DNA, 1800 bp, Homo sapiens
ggcacgaggttggcctaagagtgaatgctgcaagatctgtgtttatgcctcttttcctcattcttcctcagtttgttcgtctgcttgaaagttggccaaaaaatcctgctgctcaccgacttcccgtggtcagctgctgtcaagcgttcactttctcttctgtcattcctcatggaatgagggtggttttgtcttcccgcttcccttgacctcaaaatcaggattaaaacctggggtagcctctgtgctcctttcttctatgccctggtttgttctgtggttctgggcttcttatatccgtgtgcccagggctgaactccttattttcctttctccaagggcagagccgagtcttcagtccctgttggtctttccccacccccacttccagcccaagagccaggaaagggctggtgccacactgtctgctgggatcagcggtggttctttgagctgctgatttgggtgttaggctcttgagctgggatgcagatgtaacagtagctccagtgagtcagacactctgcccagcacattagactgtgtttgaccacttcttccagttcatagtattgacttcagcccaaacggagataactccctgtgtgtccttgaggtattgagctgggctggacagctccccttgagccaactctaggagtacaatgtcaggggaaccccagtttgtgaaaaggacttagactggaggatatttgttatctggggatatgatgcggtggcggcggcgcctcaagataaggggctggggtttctgggtggggggccaacagagtggtgccagtaacagccccagatagaggagtacgcaggcccagcatgaggcaaccttgacccagaaggtggcccagctacccttgatgaaggtcttttccagttctgctccctcatagctgtgtaaccaaaggctctggttagagaatatgaagggccttagcttttagacctgttctacctcctcaccaaatataatggcagacccatgtgtgtctggaatggccttgaattgctctttccttaaaatagctagctcttcaggagagtatctaaggcccactccatcttacctgaaccagttggtaagggtaaccatgacatagagtgaggcaaggaagaagacgaagtggaaggcagaatagttgtaggaaagatgctggacttggactggaggagctggaggggtttcttggtcagctggcctcgcagccccacccctttgccctggagagaggaaatggctgctgggagcagagctgctgaaacacctcttcccctctcccccaactacctttgttaaggctcttgagggttcttatggcactccacagagatctaccacttcttatggttcctcacttggcactcacctttgtctgcctccactgtttcagggcagcagaaacacagtgagggcttctgcaaaacagaacgcaggttttggaatggtcttaaaagatgtgagggtgttaatctaggaaacttcccccgtgaaaagattggtctagtattaaaaagtggaggcacacctgggttcaaattctagctccagcatataagtggctgtgcagactttggtaagatgtttaatcttttgtgcctcgatttctccatttgtaaaatggagcaaatacctacctcacagggttgttgtgagggttaaattaaatgagattatgtaaaagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2359 - DNA, 980 bp, Homo sapiens
ggcacgagcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcagataccatgctgtgaagtccaggccacatggaggtgtcctgtgtagatgctccagctgaaatcccaagctaagctcccaactgacagccaacatcatttccagccatgtgtgggagccatcctggatgtccagccttaacaagccttcagatgacttcagccacagctattatcttactacatccttgtgagactctaataaagaaccaactagctgagcccaatcaacctatggaactggtagaaataaaatgaattgttgttttgtgccgctaaaaaaaaaaaaaaaaaaaaaaaaaaaaaaaaaaaaaaaaaaaaaaaaaaaa

SEQ ID NO: 2360 - DNA, 1702 bp, Homo sapiens
ggcacgagcgagcgcggcgagcaacggagaggagcgcgagcagcagcatggcggggctccgacgcccgcagcccggctgctactgccgcaccgcggcggccgtgaacctcctgctgggcgtcttccaggtcctgctgccctgctgtcgcccgggaggggctcagggacaagcgattgagccgttgccgaacgtggtggagctgtggcaggcagaagaaggggaactcctgctgcccactcagggtgattctgaagagggtctggaggagccttctcaagaacagagcttctcggacaaactatttagtggaaaaggcttacattttcagccatcagttttagattttggaatacagttcctgggacatcctgtagcaaagattctccatgcttacaaccctagtagggacagcgaggttgtggtgaattcagtgtttgcagctgctggacatttccatgtaccgccagttccctgcagggtaattccagcaatggggaaaacttccttcagaattattttcttacctactgaagaaggaagcattgaaagttccttatttattaatacctcttcgtatggagtcctttcctatcatgtatctggaattggcactcgcagaatctctacagaagggtctgcaaagcagctaccaaatgcttattttctgcttccaaaggtccagagcattcagctgtctcaaatgcaggcagaaaccactaatactagcctcttgcaggtgcaactggaatgcagtttacataataaagtgtgtcagcaattaaagggttgttatctggaatctgatgatgttttgcgtctacaaatgagcataatggtaacaatggaaaacttttcaaaagaatttgaagaaaacacacaacatttgttagatcatctctctattgtttacgtagctacagatgaatctgagacctcagatgattcagcagtaaatatgtatatattacattcaggaaacagccttatatggatacaggatatacgccatttctcacagagagatgctctgtctctgcagtttgaaccagtactactacctacttctacaacaaactttacaaaaattgcttcttttacctgcaaagcagctacatcatgtgacagtggaattatagaagatgtgaagaaaacaacacacactccaacactaaaagcatgcctcttctcttctgtggctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaaaaaaaaaaaaaaaaa

SEQ ID NO: 2361 - DNA, 1126 bp, Homo sapiens
  misc_feature (206)..(206): n equals a,t,g, or c
  misc_feature (1059)..(1059): n equals a,t,g, or c
  misc_feature (1077)..(1077): n equals a,t,g, or c
ctgcaggaattcggcacgaggaactagggtttcagtttctccacatccttgccaacacttgttattttctgggtatttttgataatagccttcctcatggatatgaagtggtttctcattgtagttttgatttgcattcccctaatgactagtgatattgagcatcttttcatgtgcctattgccttttcatgtatcttctttggnsaaatgtctattcaagtcctttgctcatttttcagttggtttgtattttgttgttgagttttagttctctacatattctggatattaaatccttattaaagatatgatttgcaaatattttctcccatcctatgggttgcttttttactctgttgactgtgtcttttgatgcacaaaattttttaattttcatgaagtctaattttctatttctcttttgttgccatttccaagaaatcactgccaaatccaatgttgtgaaattttgccatttttttccctaatagttttattgctttaggttttacatttaggtctttcatccatttggagttcatttttttacatgacattaggtaagggtccaaccacattattctgcatgtggatatccagttttcccagcactacttgttgttgaaaaggactgtaaggtcttggcacccttatcaaaagctatttgagactagatgtggtggtatgtgcatgtaattccagcttcctgggaagctgaggcaggaagattgctggagcccaggagttcaaaaccagcctggacaacctaaggagaccctctcaaaaaaaaaaagaagaaagaaagaaaaagaaaaggtgaccaggcacagcggstcattcccctgkaatcccagcactttgggaggctgaggcaggcggatcagttgaggccaggagttcaagaccagcctggscaacataaccaaaccccaaccccatctctactaaaaatacaaaaattagctggatatggtggcatgcacctgtatttccagctacttgggagactgaggcacaagaatcacttgaacctgggaggcagaggttgcagtgagcnaaaatcgggccactgcantcgagcctgggcaacagagcaagactccaactcaaaaaaaaaaaaaaaa

SEQ ID NO: 2362 - DNA, 1861 bp, Homo sapiens
tttgcaatcctggaggagcccttgctggggctcggtccggcgggagcattgcagtggcggagccggcctgccacccgctcactcgccccaagtctgagaaataaatacattcatcactgcacaaacatattgatacaaaaacaacactgttaagagtgtttgcaccgtctatgttggtaaggaccagacccagtcagccccttccgctgcctggggtggggttagggggccccaggagtggggacccaccagagtcgacagagctgcgcaaaggtcccggctttttggcttgagtgggaccctcgcatcaacccatccccaagggtcacgggcagagcagcagggggacccaagcccagactcgggtcctgtggccagaactgacggccatccccgcgtaggctagctggtcaggaccagcatggtccggccagagggccttgggggctggtcagsacgggcccaagctytttggtgccagctgggcttggaggggccctgggaatggggacgagggctcaggtgactccagggaggcttccaatccctcccccagccccagggctacccttctctgcccstgagccactccagggccaactcagaagggtttccagcagcaggggagggttccctggactggccttacagctgctgaggtctgaaactgtaaaagcttatgtaaacaatgagataaatatattagcatcttttttctgagcccatggaggttccatactcattcaaaatgtgctttggtttaaaaaataggctttgtgaatttgggtatgagcttatttttttttcttttttctttgtttatcctctctttcctacatgatatctgctattttctgattcctgtttctctgaaacattcaggaattaagtgacgaacgcagagaactgtaagccgccttggcctccaataacccagtttccttgtgaggctcttaacatctccacacacacacactcgcacacacctgatgtggaaatcaaaggaaaaagaaaacaaagccaaatgttgtgttaatcccgccccgccccacaaacccttaaagtcttaaataggaaactagtgttctgctttctcattaaaacacagaaaaggctcgatacaatactaaggtggatacaatactatgtcgcacaaacgtcgttgagtgaggggcctctgctcccagtccctgaagttctgcaarggaatcacctactttcacgrgtcacctcacagatgcggctgccccacagcccgggaggccatgcacacggcccaggcgcgtgaacatttcccgtgcggtacagactttgtgtcatgtggcttaagtgctgatggggcggggtggcgtcaggacggcaggagccccctcactgagtatgggtgaagtccatgggtctcctccccccaggtccctagcctgacttgctggaacctgagacccagggtccagtcctctgtctcccaccaggagggaagaggggccatcttaggctgggatcaccacagggagggctcagccaggagcctcatctacccaagctccctcacccccaaaagacgccgctcaccacttgggtccctgaactcaggctctgtttttagctggagggtctctagaggggtgggggtaggggatgactctgtatttttttggtctaaacttaaaatagaatgaaaagagagagaaaaaaaaatggtgaagcaagatgacaataaagctgccagcccagccccacagcttcagctggctgaagacagtgggactgagatcagcaaccttggtctgaccttgagagtccacttcagggcccacagaagtatctgaggctggctaattaccaagatgaggggcagaga

SEQ ID NO: 2363 - DNA, 881 bp, Homo sapiens
ggcacgagtatgactaataaggtaatctgtccttgttaacaagcctgtatttgttatacctgtacttaaagtaaaattcaaactccttaccctgtcctacaaggctctacctgatctgggccctacctcatctctaacatcatcttatgctattttctttcttgttcaccagagccacaccagctacctttctgtccctccttgttagacttatttctgctttagagcacccttgctgctgccaccacctgaaatgcttctcttctggtattttattttggtgagaacacctggcatgagatctaccctctaacagatttttaagtgtataatacagtattgctgtctgtaggcacaatgctgcacagcagatctctagaacttaccttgtataactgaaattttatactcattgattagcaacagccccaaattattgaaacctccttgaagcctaaatttcagaaatgttcaaatgttttgaaaatggatattctgaattatcttattagcatctacctataattagcactgaaaatagtaatttttttaataaagaatcagttaagggccgggtgtggtcctcacgcctgtaatcccagcactttgggaggctgaggcgggaggatcacaaggtcgggagatcgagaccatcctggctaacaccgtgaaaccctgtctctactaaaaaaatacaaaaaaaatcagctgggcgtggtggcaggtgccaatagtcccagctacttgggaggctgaggtcaggagaatggcgtgaacccaggagggttgcagtgagccaagttctcgccactgcactccagcctgggcgacagagcgagactctgtctcaaaaaaaaaaaaaaaaaaaaaaaaactcgtag

SEQ ID NO: 2364 - DNA, 782 bp, Homo sapiens
tacgagttttttttttttttttttgagaaggagtctcgggctctgtcacccaggctggagtgcagtggcgagactccgtttcaaaacaaaaacaaagcatcaattcctgatcatgacccactgtaacttcaagcaagctacaagaatctatactagggttcagacctttgaggctgacagcgagctttgagtttgatgacagtacctaaaatatattaagtgtactcaggaactggccaagcatggggtggggcttgtcaggaaactggtatttctttcttctatttgtagtgaataagatgctcaatagacgacttttactcctcgtcaatggtcgcataactgtctctttttagacacttatgaaattgtctgaacttcctcctctacttctccaactcccagaagagtgaaggtaacaaatgttatgtccaaaccacggtttgttcccagaccctggtttccaatgcccacctcttttccaagaagtccaaagagacgcccctcatcgcaaaggaagtgctaccgtgctgcctcgatgtcccccttgggtgccatccctgaaacatcgaacctcccatacctcttctccagccgtccccctcatcctcgttccccgcctaccctctcttcaacttcattcattcatccaacattcgctgggggatttctacattgacacgccccggacagaagcctggggtaaagatgatcaggaacacgttccctcccgctaagcggcttggcagagtaagaggcatcccaaaactcgtgccgaattc

SEQ ID NO: 2365 - DNA, 1915 bp, Homo sapiens
gaattcggcacgagcttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagctttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaagacttcawctcttcctaaccacagtgaacctgatcacgacacagatgctggacttgagagaacaaacccagaatatgaaaatgaggtggaagcttctatggatatggatcttttggaatcctcaaatataagtgaaggggaaatagaaaggcttattaacctcctagaagaagtttttcatttaatggaaactgcccctcatacaatgatccaacaacctgttaagtctttcccaacgatggcacgaattactggacctccagagagggatgatccataccctgttctctttagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttytaatcctgtgggaagatcagctgttggccatgtttttagtctggagaaaaatctccaaagtcttattactctaatggagtactattcctcaagatggaatacctccaccaaaacggccactcaaagtatcacagaagatttcttcccgtggtgggttttcaggcaatagaggaggacggggtgctttccacagtcagaataggtttttcacaccacctgcttcaaaaggaaactacagtcgtcgggaaggaacaagaggctccagttggagtgctcagaatactcctcgaggaaattacaatgaaagtcgtggaggccagagcaattttaacagaggccctcttccaccattacgaccccttagttctacaggttaccgcccaagtcctcgggaccgtgcttctagaggtcgtgggggacttggaccttcctgggctagtgcaaatagcggcagtggaggctcaagaggaaagtttgttagtggaggcagtggtagaggtcgtcatgtacgctcctttacacgataaaaatccttttgggaacatcttaactgtatatgaacatttcacgaggacaataaaaataagacattgaaggaccaatttagacttagcagttatctggagacatctgagagaatatttttatctgaagaaagcagaatttgtttgatacctaacaagatttcaataaaaatccaaactttgtatgtacgtttgtatatattttcccttttttgtatgactatttatttagaaaatttctaggtgaaaaactaaatgatgttttgtatttttcttgcctatagcacagatattctcaaactttctcagctcatg

SEQ ID NO: 2366 - DNA, 1003 bp, Homo sapiens
gaattcggcacgaggtcggtgagcatcgggtactggatggggatgttgcgatgcgcctgggcgttggcgccgcctgttcccccaccactggtcactgacttgccgttctttttcaccttgtcgccgttcttgttcgccttggaaccgcctttgccggacttgaccgactcagcatcgatgtccgtcatcgtagatcgtagatctcgaggctctgataccaattgttggcttttaaaccgtagatcaaaacacccaggagcaccacgtatgtgtacgtgcaaagctaactcgaacaagtacactagcagcttgaccgattagcccttgtacacacgtatgtgcaactagctagagacttgcgtatgaatacggttcagccgactagcttcggttgattggatcaatcacgcggcaatggatcaactcggstctctcaacaagaacgtaaaamgcaargcactgaatcgttgatggcacaggccgtgtcgagcttctcgtaatactttgtattgctttgcccatctgatctggtgttacaagcaccacccttagggtgccttttatacacatcccacaagggactatgggcggtgatgaagatgaagattattctccgaaccctcctagtgtggcacgcaatcacggacgacgacgtcgatgacgactccgacgaaggtgccatggccgccatagcccggtacatgccggattccgtgctgatgacattggcggagttcgagacagcaagagaggcgtggaacgcactcaagaagatgaggatcggagaagatcgcgtcaccaaggcttggacacaagtgctgaaacgccaatttcacaagttgcacatggaggaaactgaatcggtgaacgactacgccatgtgtcttactactttggtgggagagttccgcgcgcttggtgcaaagctcgatgagaccgagattgtggagaaaattttcagttcagtgactgacaaattcacgtacatcatcggcacgctcga

SEQ ID NO: 2367 - DNA, 733 bp, Homo sapiens
  misc_feature (3)..(3): n equals a,t,g, or c
gcnggtggcggccrcrtcgtagaactagtggatccccckgggctgcaggaattcggcacgagggcggattcatcatgaagcaaacgcggctgaaccccccagtggtcttcattcttctccaacccctttcaagacccagggatgggctcagcaattctgttttaataattttgcattctgtcccttaaatcataaagagagcccccaatctgtaaagcttctgatcccacacaacctctcagggctccagggtcctgaggaggatggccaggtcactgtgggcctgtggtggagccagcgggcacccagggcttcctggtgggccaggtccctggtcatagactgagccagammagcatcagcytccgatctccaggcccctgcggtgagggccccaatgcccctgataaggctctgctcctaaagggctgttggccttgaacaagctgctctcctgcctcagtttccamttcaggatggagacatgaatgagagaagtgtccctgaaactcctgatggctttccatttcctggtttcctgtctttcctgaggctgaattcttcgcctgctttctctgagatccctcactttcctgccaagaaatttcctctttagtctgttcagagtgaagtgcaaatcaaaataaaaaagtgcaagttcaaagtgcaatcaaaacaaacaaacaaactttggctaaggcaaaaccaaaccaaaaaaaaaaaaaaaaaactc

SEQ ID NO: 2368 - DNA, 670 bp, Homo sapiens
gctcgtgccgaactcgtgccgacgaaaagctgccaagttgaaaatggacgagtaatcgcctgctttgattcattgaaaaactaaatctccatacccacttcatccgtgtttttggcttatgtatgggatgctagaatggcctatctccatgtattttgttgcatttctccattgcttcttgtgttctggcgggaatcttggtgattcttttcaagcactacctgagctctgtgccaattgttcctcttctcccagggtgttgtgctgcgtggtcatgtctccacttccttagccctgtccattgacagaaccttgggttctgtgatggctgcctctaaacccttgtgaaagcggggaatattcctccccctgctgctacagttgagcaccgtgctgggtaccatgttgccctctacacttgctttcagttgttaaggcttcccaagctttggctgtggctcagtgatcctgctgtcaaaaccctgaaactttcctagcctggacactcagtggtagcagcaggtgttgggatttctccaagcccctaagactctgggaggaagagaatggctgtttgacatagacctcaggagttttcaaagcaccaagaaacctctccagaagatatgtaaagattttaaagggaaaaaaaaaaaaaaaaaaaactcga

SEQ ID NO: 2369 - DNA, 1020 bp, Homo sapiens
  misc_feature (20)..(20): n equals a,t,g, or c
tgcacgctggccatgtgggngttgggccactgcgacccccggcgctgcacgggccgcaagctggcccgcctggggctggtgcgctgcctgcgcctgggccacagattcggcggtctggtgctgagccccgtgggcaagcagtacgcgtcccccgcagacagacagctggtggcgcagtctggggtcgccgtcatcgactgctcctgggccaggctggacgagacaccgtttgggaagatgcgagggagccacttgcgcctgttgccctacctggtggccgccaaccccgtgaactatggccggccctacagactttcctgcgtggaagcgtttgctgccaccttctgcatcgtaggctttccagaccttgctgtcattttgctgcggaagtttaaatggggcaagggcttcttggacctgaaccgccagctcctggacaagtacgcggcctgcggcagcccggaggaggtgctgcaggcggagcaggagttcttggccaatgccaaggagagcccccaggaggaggagatcgatcccttcgatgtggattcagggagagagtttggaaaccccaacaggcctgtggccagcacccggctgccctcggacactgatgacagtgatgcgtctgaggacccagggcctkgcgccgagcgcggaggagccagcagcagctgctgtgaagaggagcagacgcagggacggggggctgaggccagggccccggctgaggtttggaaaggaatcaagaaacggcagagagactgagggttgcagacacatatatttttgaggctgggtgacgagaaaatctagagacatgagggacataaatgggcctggcagcctcggctctttgcggctgctggcaggactgagctgtccgggttctccccacacttccagcacagctgtgctctgtgtcctgcctcggcgctctcgcaaatgaagctgcaggccaagaaaaaaaaaaaaaaaaaaaaaaaaaaaaaaaaaaaaaaaaaaaaaaggggggggggc

SEQ ID NO: 2370 - DNA, 886 bp, Homo sapiens
  misc_feature (92)..(92): n equals a,t,g, or c
  misc_feature (886)..(886): n equals a,t,g, or c
atttcattttagggcatactgggcttactctcctcccagctgtctgtggattgatttgattttaatgttcgagttttacagcaacagctganaaaccatgaactattctaggaactgtgttggaactctttaaaataaagaaaagaggaggaggagaggaagaaagaaaaccaacttaagaagccttggactttggagggacagaaagccaccagccaatggagaacaaagagatgtttccctttcctttctttcaccttgtcattctgggtttccttctgcttcactctttccttcccccttaaaagtggtattcctggttggtctgtctgtctgtccttgtccttgtggtgatcctggcatggtgatatgctccactttgcattatccatggtctcttaccagcgcacaagtcagtggggaggatctaaccacgcctggtggtgaggaagctgaatttccaggcctgcgtcccatgtagcctctccatgaactgcagaaggcatgttctgcatggttaccagtaagtggctccctctcaccgtgttcattgtcaaatgagagcaaactttaggtgttggctccattgtacactctacttgctctgctcccctccctccaaccagggttcatgtcagtgcacaccccatgtgccctggcgaagctggtgctgtgagtgatgtttcccatacaactcagggatgccaggtggcttaccctgagatagtcattttgggcacataacagtgtaggaatgaaacatggatttcattgatatttaaatctgtcaatttcattttttgttaatgttttcccctgatgactttttagcaatttaacaaataaaatggacaattgtcttaaaaaaaaaaaaaaaaaactcgan

SEQ ID NO: 2371 - DNA, 1066 bp, Homo sapiens
  misc_feature (570)..(570): n equals a,t,g, or c
  misc_feature (928)..(928): n equals a,t,g, or c
  misc_feature (984)..(984): n equals a,t,g, or c
  misc_feature (1011)..(1011): n equals a,t,g, or c
gggccgcgtccaccaagcagaccatcactgagagcagcagcctcctcctgtcgcagctcaccagcctggacccccakggyccccccggaggcmtccccctcacatcctggatcaagtgaaaagcctcaaccagtccctccgcctcgrgcacctcttgtgcgcagccgaaaccctgactttctcctccacatcatccagcggcaggcctcctcgcagtccatgccctggctggcggacctggtacagtccagcgagggctccctggacgtgctgcccgtgcagtgtctgtgcgagttcctgctgcacgatgctgtggacgatgctgcttcckgggaggaggacgacgagggcgagacaaggagcagaaggccaagaagcggcagaggcaacagaagcagcggcaccgtggwgccgcctgcaggacctgctactgggcccgaagctgatgagcagaccacgtgtgargtgctggactacttcttgcggcgcctcggctcctcccaggtggcctcccgcgtgctggccatgaagggtttgtcgctggtgctttcggagggcagcctgcggganggggaggagaaggagccccccatggaggaggatgtgggggacacagatgtgctgcagggctatcagtggctgctgcgggacctgcctcgcctgcctctgttcgacagcgtcaggagcaccacagccctggccctgcagcaggcaatccacatggagactgatccccagaccatcagcgcctacctgatctacttgtcccagcacacgcctgtggaggagcaggcccagcacagcgacctggccctggacgtggcccggctggtcgtggagcgctccaccatcatgtcccamctcttstcgaagctctccccgagtgccgcgtcggacgccgtgctgagcgctctgttgtccatcttcncacgctacgtgaaggcgcatgcgggcagagcaagggaagggcgaagaagtctacanctggtccggaagtcttcaaggaccaangtctttccttacgctggaagcaagcgggggaagacagcccaaccatggcaacatt

SEQ ID NO: 2372 - DNA, 1276 bp, Homo sapiens
ggcacagtgaaaacttggtatttaaggaaaatgttgggagaagcccacagataacacacttgctctgtttaatgctaataaattgcattttttctttattgttattattgtcacatgcagatgggatgcatttatttataagttctggggataggatacttttttgcctgtactttttacattccagagtttgtgcttgacttcatcttgactaagacagatgagaatatttcctagaatttgtttttagtcttatttggatcctgtcacactgcagcattttattgtcctcagctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtaccagtattttacttaaatccaaaatgtcccatataataaccatatttggaagtcaaatgtagtcaatattaatatcatttgtaaagtctagaagtagaggaaaagaacatgggtaacttgtctaaggctatacattgagtcagcattggaactttgattttaaaaagctctaaagtcagtagatcatgggatttaaaattcaaatggaatctagcagttgaggtttaagaatcttctgtgctgtttgactattcattcactaatgaagctttaaagacttactatataaataaaaccacattttaatgaacttgaaaggttaataatatctagagaggagctccctcttgtttttttgtttgtttgtttccagttagaaacagtgtggaggccaggcacggtggctcgtgcctgtaatctcagcactttgggaggctgaggtgggcggatcacctggggtcaggagtttaagactaggctggccaacatggtgaagccctgtctctactaaaaatacaaaaaaatttgcgagacgtggaggcacatgcctgtgatcctagttactcgggaggctgaggycaggagaatcgcttgagcctgggaggcggaggttgcaatgagccaagatagcgccactgtactccaggctgggtgacaaagcaagactctgtctcaaaaaaaaaaaaaaaaaaaactcgta

SEQ ID NO: 2373 - DNA, 1751 bp, Homo sapiens
  misc_feature (1520)..(1520): n equals a,t,g, or c
  misc_feature (1557)..(1557): n equals a,t,g, or c
  misc_feature (1689)..(1689): n equals a,t,g, or c
  misc_feature (1729)..(1729): n equals a,t,g, or c
  misc_feature (1735)..(1735): n equals a,t,g, or c
  misc_feature (1741)..(1741): n equals a,t,g, or c
gggtgcagcctgatggcgcaggaggtagacacggcacagggcgccgagatgcggcggggcgcgggcgcggctcggggacgcgcttcctggtgctgggccctggcgctgctttggctcgcggtggttccgggctggtcccgggtctcgggcatcccctcccggcgccactggccggtgccctacaagcgctttgacttccgtccaaaacctgatccttattgtcaagctaagtatactttctgtccaactggctcacctatcccagttatggagggtgatgatgacattgaagtttttcgattacaagccccagtatgggaatttaaatatggagacctcctgggacacttgaaaattatgcatgatgccattggattcagaagtacattaactggcaagaactacacaatggaatggtatgaacttttccaacttggcaactgtacatttccccatctccgacctgaaatggatgcccctttctggtgtaatcaaggcgctgcctgcttttttgagggaattgatgatgttcactggaaggaaaatgggacattagttcaagtagcaactatatcaggaaacatgttcaaccaaatggcaaagtgggtgaaacaggacaatgaaacaggaatttattatgagacatggaatgtaaaagccagcccagaaaagggggcagagacatggtttgattcctacgactgttccaaatttgtgttaaggacctttaacaagttggctgaatttggagcagagttcaagaacatagaamccaactatacargaatatttctttacagtggagaacctacttatctgggaaatgaaacatctgtttttgggccaacaggaaacaagactcttggtttagccataaaaagattttattaccccttcaaaccacatttgccaactaaagaatttctgttgagtctcttgcaaatttttgatgcagtgattgtgcacaaacagttctatttgttttataattttgaatattggtttttacctatgaaattcccttttattaaaataacatatgaagaaatccctttacctatcagaaacaaaacactctctggtttataaaacaccttaattctactgctcttttttctccaatcaccagcatctgtttttcagggggtgattttacttttgtgaattccttagcctttcttccttggtgcataaagttaaaatgcacatcagcagaattgctgcatattaacatctcaggactcttctcttgtaaagaagctgaaattcgtactatattggccaaagtgagcgagttaggtgatcttggtttcaatttccgagcctttgttaatatggagaattatggttcatatcagttatgtaggacctttggacccagggtcctacagatagatatggtgtgcccagattttaaaaataccttcaaaaataaaaaatacattcagtgacattttcatggtgggagctcttctttctgatatggcagttacactttttcacttaagtgctttagtttnagactaactttacaacttctataacttttgggaaccnagtttagtatagtctgattacattccattcacctaactttaggcattcggtttagacaccataactggrgkgratkgkgcytccyagratgtgggcaaatcccagtggttaacaccatatttctgggctggngattttggggactagctaggtaaacgggcttggtggttcntttaancatacntaaccaccac

SEQ ID NO: 2374 - DNA, 383 bp, Homo sapiens
ccacgcgtccggaaaaatatgttaattaccatatccctggaactccttctcaggctggtgggggcagccttgcaagagaaacagcagcctttgtctcttccctcttgtggggagcaaggaggggatgagcggtaccttgggagacccggtaaaagtctaaagaattgagaatttgactatcttgggggtaaaatgctgtcataggggcagcagtctcagggggtgtaaactctggaatccactatggtttaccttgagtggcctgcacgaacatgacagccctgatctgtatttcctttccattcagaaaaccttaaaaaaaaaaaacttgttttatgataatattataacaatcataactaaaaaaaaaaaaaaaaaaaaaa

SEQ ID NO: 2375 - DNA, 1069 bp, Homo sapiens
  misc_feature (1030)..(1030): n equals a,t,g, or c
  misc_feature (1057)..(1057): n equals a,t,g, or c
  misc_feature (1060)..(1060): n equals a,t,g, or c
gaaagctggtacgcctgcaggtaccggtccggaattcccgggtcgacccacgcgtccgcccacgcgtccgctttttaaatacttgtattaatctttatatgacctgtaggaatgctcatattttcattcttatcgttttggttctttcagtcttgccagggttttatatattttatgagtatttttgaagaaccagttgctgactttgttcatctctattgtgttttctatttccaaggttgctcttacctttagtagttccttttttttttttttggtttccattttgttattgtttaactttgtgtattgaatgactcatttttagtctctcttttctaatatgcacatttctaagcaggtctgcctatatgctctctaaatactgctctagctgcattccacatattttaataggatttgacagttttaatttccatgactttttcccatgactaattagaaatgtttattaattctcaaatacatggagctttcctaaagatgccttttatactgatttctatctgaaatccattgtggtcagagaatactgtgtgttttgtagcaatcctttgaaatacattgagacttgcttaatttgcaagtacaggttttcatatttttccatatgtgattggaaaaatattaatttgacaatttggggatatagtatacacacaatacacacaaacatatatgtattttcagtacttcaaaatttctacatatttcctggtatttgtctgcttgcttcattaattactgagagatgtacgattttgagttgtactttcttttgttgctctctcatttttctttcatatccttatggcaattgtattaagtgcataccaatttaaaattatttcaccttcatgaatgtcaccttttattacacaaagtgatattttctattaattcgcctaaataaactttgcacttgaaaaaaaaaaaaaaaaaagggcggccgctctagaggatccaagcttacgtacgcgtgcatgcgacgtcataactcttctatagnggcacctaaattcaattcactggcccncgntttacaacg

SEQ ID NO: 2376 - DNA, 891 bp, Homo sapiens
gaaattatgcatgagctgtgattgcaagtaatttttaaacgtctgcatgtggacaaagtaaatacataaaaatgaaaatggctgtgtaagagagtaggatgaacaataataattgttttccccactgttgtgaattatgatgttatcttttaacttcacatggatggtttgggtttctctagttcttaaaagtcaaagagccaagttagccctccattccctccatcttcatcaagaggtcaggctcagaatgtcacggagagagtcgcctggcaggcctcttcgttgtggggtgagagggaacatgggtgccagaaccccagtgccaaccgctgactatccttctccctacaggacattgccgagaatggctgcgcccccaccccagaagagcagctgccamagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcaaaacaccattgcaacaccagctacactccacatcctacagaaaagcattacccattttgcggccaagttcccgacgagaggctggacctcttcatcacattgacttacgccgttgcttttccagactgggcagaggggctgacttcgcagtgtgtgccaaagarccggtgtctgataatcccattttcctgcttatcacctgaactgtgtcagtatcacttttagttttgttggttggttggtttgttgtttgtttaatatgccctgttttctacttctgttggaaaatatttggggttgaaataaaccagtggga

SEQ ID NO: 2377 - DNA, 497 bp, Homo sapiens
ccacgcgtccggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaagggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccacccctccccgatgtggtgcgctcaataaaaatgctggaattcaaaaaaaaaaaaaaaaaaaaaaaa

SEQ ID NO: 2378 - DNA, 2808 bp, Homo sapiens
ccgggtcgacccacgcgtccgcccacgcgtccgcccacgcgtccgcggcgcgcggagacgcagcagcggcagcggcagcatgtcggccggcggagcgtcagtcccgccgcccccgaaccccgccgtgtccttcccgccgccccgggtcaccctgcccgccggccccgacatcctgcggacctactcgggcgccttcgtctgcctggagattctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttgttatggttgcagtttgggtctggctttacgaagatggcgaccgtaacactccttagaaactggcagtcgtatgttagtttcacttgtctactttatatgtctgatcaatttggataccattttgtccagatgcaaaaacattccaaaagtaatgtgtttagtagagagagactctaagctcaagttctggtttatttcatggatggaatgttaattttattatgatattaaagaaatggccttttattttacatctctcccctttttccctttccccctttattttcctccttttctttctgaaagtttccttttatgtccataaaatacaaatatattgttcataaaaaattagtatcccttttgtttggttgctgagtcacctgaaccttaattttaattggtaattacagcccctaaaaaaaacacatttcaaataggcttcccactaaactctatattttagtgtaaaccaggaattggcacactttttttagaatgggccagatggtaaatatttatgcttcacggtccatacagtctctgtcacaactattcagttctgctagtatagcgtgaaagcagctatacacaatacagaaatgaatgagtgtggttatgttctaataaaacttatttataaaaacaaggggaggctgggtttagcctgtgggccatagtttgtcaaccactggtgtaaaaccttagttatatatgatctgcattttcttgaactgatcattgaaaacttataaacctaacagaaaagccacataatatttagtgtcattatgcaataatcacattgcctttgtgttaatagtcaaatacttacctttggagaatacttacctttggaggaatgtataaaatttctcaggcagagtcctggatataggaaaaagtaatttatgaagtaaacttcagttgcttaatcaaactaatgatagtctaacaactgagcaagatcctcatctgagagtgcttaaaatgggatccccagagaccattaaccaatactggaactggtatctagctactgatgtcttactttgagtttatttatgcttcagaatacagttgtttgccctgtgcatgaatatacccatatttgtgtgtggatatgtgaagcttttccaaatagagctctcagaagaattaagtttttacttctaattattttgcattactttgagttaaatttgaatagagtattaaatataaagttgtagattcttatgtgtttttgtattagcccagacatctgtaatgtttttgcactggtgacagacaaaatctgttttaaaatcatatccagcacaaaaactatttctggctgaatagcacagaaaagtattttaacctacctgtagagatcctcgtcatggaaaggtgccaaactgttttgaatggaaggacaagtaagagtgaggccacagttcccaccacacgagggcttttgtattgttctactttttcagccctttactttctggctgaagcatccccttggagtgccatgtataagttgggctattagagttcatggaacatagaacaaccatgaatgagtggcatgatccgtgcttaatgatcaagtgttacttatctaataatcctctagaaagaaccctgttagatcttggtttgtgataaaaatataaagacagaagacatgaggaaaaacaaaaggtttgaggaaatcaggcatatgactttatacttaacatcagatcttttctataatatcctactactttggttttcctagctccataccacacacctaaacctgtattatgaattacatattacaaagtcataaatgtgccatatggatatacagtacattctagttggaatcgtttactctgctagaatttaggtgtgagattttttgtttcccaggtatagcaggcttatgtttggtggcattaaattggtttctttaaaatgctttggtggcacttttgtaaacagattgcttctagattgttacaaaccaagcctaagacacatctgtgaatacttagatttgtagcttaatcacattctagacttgtgagttgaatgacaaagcagttgaacaaaaattatggcatttaagaatttaacatgtcttagctgtaaaaatgagaaagtgttggttggttttaaaatctggtaactccatgatgaaaagaaatttattttatacgtgttatgtctctaataaagtattcatttgataaaaaaaaaaaaaaa

SEQ ID NO: 2379 - DNA, 3108 bp, Homo sapiens
cgagtggctggacagtttggagaccaggtaacccagcgtggggtcctccctggagaaacccccagtgctcctgcgacatcggcctggcttcagggctctgctatttgaatgtgatgctcaactctccaataaatggtcgtctgtgttaggcttgcttccagaaagagctcagggatggttttgggttttgttctgcttcttttcaatatgggaggaaccttctctgatgggagaaaagagaggaggagaaccacattcctgagatgctgtgattttatcatgaaaccatccccagccctcatcctggtgacgtcagtcggcccagtcctactccagaacgcttcttgggtgtctgtctgcaggactttgctcagttaatttttgtctcctctaaaacagaccccgttgctctgggaggagagccgagctgcggctcaggggccgtcactggtcatttttgccctgatgtatttttgcctctacatttcttgatctctggaacgttaatcccaacgatgcctggtctgcggtgctcacagtctgtgtctgtgctttctacacctgtcctgctcagatgcacatgatgtcacacccaggtctccatcctggctcttgttggctgcggcggcagccctgactgtcggagacgcctggctcagcatgcccaccttgcaacagggagcaccctgtgctgctcacagaactgcccatccactttcttttcctttcctgggtgccaacatcttcctctgccccttctacgccggcctggcgcatttctctgatttctgtgttcccgggtagcagttgtaaaaattcaggcttgggagttgtcttgagataggacttggaaggaatcttttaccatcgttgaaattggctagatttgtggattccttcccgaccctggcaggcacggtgaggggaggaggtccctcctttttattgatcaggatgcactgtgtgcggggtaagccaggaagccacgcacctgatgctatctctgccatggggaggaggacagaggatgggaagatgctgtgaacttttatgattcgtttttcactctcggtgagaaaaggagctagcaggatgggtgagggagtggagggtagtaatatatagttgtggcctgggcccaaacgcatttagtcactgcctcgacagcctttatatagacaccaccagagtgactcagcctggaaaaagagagtcacttaaaaataaagttgcgactccagtggacacgtggtgcacaggctgccctgagatagtcaccagggctccatggccctgcacaccccccaggaccctgggcgagtcaggtggtgaagtgagggtgatcgttgtaaccccatcttggcattgacgtgaggatttagcaaagtcacatatcatcccaattacttttttcctttttttttttttctttttggagacagggtcttgctctgtggcccaggctggagagcagtggcatgatctcagctcactgcagcctcaacctcccagcctcaaatgatcctcccacctcagcctcccgagtagctgggactacaggcgtgcaccaccacacctggttatttttttttattttttattttttgtagagatgggggtctcactttgttgcccgggctgatctcgaactcctgggctcaagcgatcctcccacctcagcctcccaaaatgttgggattaccggcgtgagccaccacacctggcctttgatgctttctaaacatgaaacagcatccaggcatcatcggctactccttgatatgtcagtgttacccactggactctcaactcttctctgttatcaacaaatcttgttttactcctcattagaccctaaaaccactgcacacagaaaagtgaaaagcccagcctcattttcctttcatcacgttgagcccattgagttggcttcattgaaggcccacagccctgatgtgacacaatggggcctttttttgagctagaattccactccgtcacccgggttggagtgcagtggctcgatctcggctcactgaagcctctgcctcccaggctccagcgattctcctgcctcagcctcccagatagctgggactacaggcatgtgccactgtgcccagataatttttttgtatttttcatagagatggggtttcaccgtgttggccaggttggtctcaaactcctggcctcaaatgatccacctgcctcggcctcctaaagtgttgggattacaggcatgaggcacagtgcctggccaaaagtagatttctatagagatagaaacccccaggggtgaggggatagaggaatgaggaatgactgatagttggtatgaggtttctttttggaatataaaaatgtcctagaataagacagtggtgatacttgcacaactttgaatatgccaaatgccactgaactgtgtactttaaatgggtgagttgtatggtatataaattatacatcaataaagctgttatttaaaaaaaaaattcagccaggtgcagtagctcacgcttatagtcccagcactttgggaggctgaggcagatggattgcttttgctcaggagttggagaccagcctgggcaatatggtgagacctcacccctacagaaaaatagaaatattagctgggagtggtggtgcgtacctgtggtcccagctactcagaaggctgaggtgggagggtcgcttgagtctagcaggagattgaggcttcagtgagccatgattgcaccactgcactccaatgtgggtgacagagttataacccccgtctcaaaacaaacaaacaaacaaacaaacaaaaaacctaaactaaattaaaaaagaattcctctcttcatgggggtgtcagaaacccccgaagagatttcttattcagttgttctctcatcctctaaagaaactccccacagaaaagtatcttgtgaattttcatttttgcagggggcagtttggttttaaaaagtctactccaggatttggcaaaatgagaaaaccccagtaatcaacttgtgtgtttaatcattctagaatcacctactgttaagttataataagccggaattcgatatcaagcttatcgataccgtcgac

SEQ ID NO: 2380 - DNA, 1953 bp, Homo sapiens
cccacgcgtccggcggctcttggctcacagccgtcccttcgctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccctgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtgcaaacaaggaatccttgcctttaaggtgacaggctctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgaaaaaaaaaaaaaaaaaaa

SEQ ID NO: 2381 - DNA, 775 bp, Homo sapiens
tcgacccacgcgtccgaaaaaggaaatgatacatgtcttgacatttctattgcagtwttacatcttaatttctaagggcaaaggtgatgtttcccagttcgtaaagtctcgagagtactaatgctatcaaaagtaattaatttcaagtgtaaataagaccaaacaaaaacgatcagatgcgacattgtctcataaacatgatagactattaaatcactttgtgttttttggaaacagctataactattaatatatacagtaatctagtaaatttccttcagatatgctattgcggatacaacagatcatctattgtcacaagctaaccattatcctaacaaaatggcggaatacagcaagacataagagtaaaaagaaagaagatgagctgatattaaaacatgaacttcaattgaaaaaatggaaaaataggttaatactcaaaagagctgctgcagaagaatccaattttcctgaacgaagttcttctgaagtctttcttgtagatgagactctaaaatgtgacatttcactgttacckgaargrgcaatattacaggtttgtatgaattcagtatacattatatactataatctgccaagtgtggtggtgcatgcctgtaatcccagctgcttgggaggctgagacaggagaattgcttgaacccaggaggcagaggttgcagtgagccgagatcacaccattgcactccagcctgggcgacaatagcaaaactccatctcaaaaaaaaaaaaaaaaaaaaaaagggcggcc

SEQ ID NO: 2382 - DNA, 1142 bp, Homo sapiens
  misc_feature (39)..(39): n equals a,t,g, or c
tgaacagtgcaggtagatactggactgggggcagatctnagggagaggggtttaagtagtgggaggacactggggataggggcttggggctatttacctgccattttaagtagtttgctattttagcagccaacaataactattggtgctgaataccagccctgcagtgtagcatgagacaggtccatgcacacatgcattaggaaaacaccttcatgaagcaggattctgcctgggctgatgcacacaacctctatggagggtgaaacagtgtttctgaagaccgtagtttgggaacccctgacatatgagcaatgcccccttagataagctcaagttacaggaatgtytgagggtggaaggtgtggatatgtgcttttgcctgtytccctcttacagtgtctggccatggggcataaacactacccagcagtaggtaggytggccaagagaagccagcttgcatcaccagcatcatctagggaatggaatcatggcagtaatacgttgcttaggaaacaaaagctctatggacacatcttccaccttctcagtcccagaaaccrtatgtactgtgaccccgctcaytaggcccagccctcgggaagagtgtgggcccttgaaaagggaagactgagtgagcaaaatgatgagaaaactacaaaatgggcagaggtcagtctgacacattcattctctgtcaagctcaggaagtactggtccctgatcttggagatgctgtgtgagtggcagggggactcctgctgggtaaatattctatatgtggatgcctggacaggcccctatcccaggccctgcttgtcagaagctccccttgggccgagcgcggtggctcacacttgtaatcttggcactttgggaggccgaggcaggtggattgcctgagttcaggagttcaaaaccaggctgggcaacatggtgaaaccctgtctctactaaaaaaaaactaaccaggcgtggtggtgcatgcctgtaattccagctactagggaggctgaggcaggccaatcacttgaacccaggaggtggaggttgcagtgagctgagatcacgccactgcactctagcctgggcaacagagcgagactctgtctcaaaaaaaaaaaaaaaaaaaaactcga

SEQ ID NO: 2383 - DNA, 1732 bp, Homo sapiens
ggcacgagcagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccagccgggcaggaagaaggaccacagcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgcaaaaaaaaaaaaaaaaaa

SEQ ID NO: 2384 - DNA, 758 bp, Homo sapiens
gaattcggcacgagacasggtttcaccctgttggccaggatggtctcaatctcttgacctcgtgatctgcctgcctcggcctcccaaagtgctaggattacaggcatgagccactgtgcccggcctttgttttttgagaccttttttattttgttgtcacccaggctgaagtgcagtggcacaaacacagttcactacagccttgacctcctgggctcaagcaattctgcctcagtcccacaagtaggtgggcttacaaatgcacagcatgacacctggcttatttttgtattttgtgtgtgtgtgtgtgagccactgcgcaggccttgggcagctttcttgatctctgttacctcatctataaaatgatgataataatagcttctcccttattggggaattgtaatgattaaatgagataacatgtaaaatgctcagtacaggccaggcatggtggctcacgcttgcaatcccagcactttgggaggctgaggctgctagatctcttgaggccagcagttaagaccagcctggccaatatggtgaaaccctgtgtctaccaaaaaatacagaaagtcagccaggcatggtggtgcatgcctgtggtcccagctactcagaggctgaggtgggagaatcacttgagcccgggagacagaagttgaagtgagccaagatggcgccactgcactctagcatgggctacagagtgagagcctctctcaaaaaaaaaaaaaaaaaaaaaaaaaaaactcgta

SEQ ID NO: 2385 - DNA, 1455 bp, Homo sapiens
  misc_feature (390)..(390): n equals a,t,g, or c
  misc_feature (456)..(456): n equals a,t,g, or c
  misc_feature (1100)..(1100): n equals a,t,g, or c
  misc_feature (1293)..(1293): n equals a,t,g, or c
  misc_feature (1409)..(1409): n equals a,t,g, or c
ggtccaccctcccccaggggcctccccagcctccctctccacctccctgccccccggagatacctccaaagccggtacgcctgttcccagagttcggtgagtgctgcagccaggagatggggctctgggtggatggcctgggatccctggaatcaggcctctggaaggtatgcaaggatcacactcctttctgtgcaagcctgccaccagcccactgtgtggccccgggcaggtcacagcctccctgagcgctattctcttcatcctcacaatggagacagcacccacctctctggcctcctgaccgttaagtgtggggccatggccggctttgccagttacccatggtctgattttccatggtgttgggtggtttgcttttctttttkntttttttttttgagacagagcgagagtctgtctcaaaaaaaaagacaagttgcagatgagctgagntttgggcagagcaagcgggattctgatggggggtggatgttgcgctcgtcagcaggcaatagttagttggttgagggttttgatcamggggtagctactgcctgccccattttatccagctctgtagttgctatagagttgctagaaccttggcacatcacttatcagttttgtcacctcagatggcttcttcactacttggggtgtctcctgggtgtggggctctccttcctgtggcctctgctgactgcctggcactggcacacatgctctggtgaggggaggaccaacggtttttcccgtttgttttctgcttcctcgtttaaccctcctcgtcttgtaagatgaatgtwcttgtctctgttcactatgcagatgaggactttgaggctcagagacgccactaacttgcctggtccaagccttttgggcctctcaggctgcagccagcaatgctgcagtgaagtttgcctgggaggctgaccctaggagtctgcaggcgtgttaggacccccgatctagaagacagcagagatgtaggccagggaggaccaataccgagcatctgagggcaggcacacctcagactgaccagaatacaaatgaattcgagtcacttacaaacaaagtggcataaggccagncacagtggcccatgcctataatcccagcactttcggaggccgaggtgggaggattgcttgaggccaacgatgtgagaccagcctgggcaacatagcaagaccttgtctctacaaaaataaaaattcaaaaaagtggcatttaacacatactttttttcttttttttgagacagarttttgctctgtcccccangctggagtgcaatggtgtgatctcggctcactgcaacctccacctcccaggagaactgcttgaacctgggaggcggttgcagtgagccaagatcgcaccacttcactccagcctgnacaacggagcaagactccatctaaaaaaaaaaaaaaaaaaactcga

SEQ ID NO: 2386 - DNA, 921 bp, Homo sapiens
ggcacgaggacgatgatgtcatcaaacacttatatagtgcttgtatgccaggcactcctcatcacagctatgaatcgtggtccaccaaataagtgcaacagagtttatctatttttaaatctttgccatcactactaatgttgcagcgagtgttttcttgtacatacatccttgcggaagtgtttgggtatatacctacggtagagttccttggttatgtggtaccagcatcttcacctaccaactctgtccaaatggttaccccaagtgtttgtatgaccctgtcagtatgtgcgaggggttttttactccacatttcctcccaaacttttttttttttttttgacagagtctgggctctgtcgcccaggctagttgcagtggagctggaatcgcgccatggcattccagcttggggcaacagagtgaggcttcatccccctccaagagaaaagccaaactaataagattcaaaatgtaaaataataaattggtgtttttttatactttgcccctatagtagtttccttgcctcttccagcttctggtggctgccccagcattccgagcgtgtggctgcgaaactccagtctcccccaccttcacatcatcttctccatgtctccttaccttcctttgcctctgtcttgaaaagacactgtgatggcatttaggacccacccagctaattcagtgtgttctcatctgcagatccttgatcaagtcacatttgcagagacctctttttcaaataaggtaacatttccaaattcctgggattaagacttgatatctttgggtggtcattatttaacctactacaattgggcctatccctaggccatgccagcctgggtgataaagcgagactctgtctcaaaaaaaaaaaaaaaaaaaaaaaaaaaaaaaaaaaaaaaaaaa

SEQ ID NO: 2387 - DNA, 1668 bp, Homo sapiens
ggtgggttatggtgagagatttatgtgaatgctgtggctgggaactagtctcatattctcaagtttttctgcaagttttgatggcgtcccatttctctcttcctggctcttttggtcttcaggcagcagtccaaattccctcattcctcccttctagccctctcccaggatccaggccctagactgggccacttgctctgtcccagtttgattttttcatcctaggccccttctcctccctgtccgcgcccctctccctttccccccgcccgctgtcataataagagattcaggctctgaaggggcttctggaaggtagcaaaggtgcgtcgtgttctctcccagagacaggacctccaacttctccgccctgggtctttggtaccaggccagcagatgtgtacagtttgggagagaggaaaagccagagctgcaggaacaagctgaggagcgggcagatgggagtcctgaaaagagagccaggcgtggtggggggaggtgtggggagggggcccccttcctactaatcctctctccaggaatccctggctttgggacaggacggctgtcgttttgttgggggaggcgcccaggctgggtgcatgtcctgggccaccagccaagagaacatgatgttcccaagtgcgctggccgccgccctctcgggctggccgcctcccaaaccgctgcctctccagtctctccagcctccctgccccacattccgaggcagcttcgccccgcccccttcttccgctttgacgtcactgctgtctcccgccccctcgcctccattgacggcagcagggcctggttactgtggggacggtgaagcaggacaacaggagtcttgggagcaagcgggggctgctggagggctggagccttttgtctatgcaaaagacagggagatggaggcgggagatcaaggactgcctgggttaggggagatcacacctaaatccctgaagggggagaaaaaccatgtttccagggaagaggtatctgcaaacgagataaggccaaagccacagtatgagttggggtggggaggatcattttcagggagaggagactgagaatccaagctcctgaatctttttttttttttttttaatagagacggggtttctccatgttggtcaggctggtctcgaactcgctacctcaggtgatccgcctgcctgggcctcccaaagtgctgggattacaggccaccgcgcccggcctccaggctcctgaatcttttgttttcctgtttcgatttttctgggttaatttataacacgatcttgtctcagcttttccacagagccctccccttcacccttccctcattgttcaggaaagcttaggccacgtgacagtgaggggagtgcccccacaatgattatgtcagcagctgcttggaggcctgttcatctactacccacgtttccagggagccctgcgaggaactactcatcacggtcctggatggagggggctgtgtaactgcagctctcctgagcccagactaacattttattgcctgcaaatcgtgcccctgttctctttctaggactactcatctcttttagagaatcagaattcccagccccctttctcctgttgacactcttttcccacctccccaacctatccttgtttaaaaaaaaaaaaaaaaaa

SEQ ID NO: 2388 - DNA, 1020 bp, Homo sapiens
  misc_feature (18)..(18): n equals a,t,g, or c
  misc_feature (26)..(26): n equals a,t,g, or c
  misc_feature (1014)..(1015): n equals a,t,g, or c
  misc_feature (1018)..(1018): n equals a,t,g, or c
gtataattataaatttgntcggttcnaccggtcctgtgttgcytaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgcaaaaaaaaaaaannaangg

SEQ ID NO: 2389 - DNA, 1292 bp, Homo sapiens
ggatgatagatgatctgtaaatattttctctcattccatattcctctggctccttttaagatttttctttatgtctggtttcaaggaatttgattttgttgtgccctggtggagtataagctttcttttgagttttttgctcttgttgttaagcttttggagtttgtgggtttatacttttcatcagatttggaacatctttggctattatttctccaaatagtcacacatcgctcctcggattccagttacatatatattattaggttcttgaagttgtcccataccttactgatgctctgctctttttctttggtcttatatttgggtttcatttggatagtttttatttctgtgtctttacattcactcgtctttccttctgctgtgtcttgactgctgctagttccatccaatgtatttcatttatatatctataatttgtggtttgatagaaatgcagtgatgtagcaggtatcaataaatactgccttaatttgttgcgaaaatataacagattcctgttctgtatgttagctaaaaaggtatgcaaaccaccctgtatgtcatattaacatttatgtccctttgtttccatgtcaacttttagtttctctgccaaaacctacatatgttttttttatatgattattctacattttctgctgagagtggacatctgcattagtagttctatgatatttgttttataagttgccagaatggttgctctgtttggcagactgcagacaaatatttatctatgattcgttgcatgatatgaccatgattttgctacaaaaaacttgaaatagattttaatattttctttactattatcagagagagagctggattacctgcaaaagtgtacttttgcttattgctgtcattgataactcagtgccagctgggcgtggtcactggtattacctccatgtgatcactttttgttcactaatgttaatttaaaaaattttaggctgggcgcaggtggctcacacctgtaatcccagcactttgggaggccgaggcagggggatcatgaggtcaggagatcaagaccagcctggccaacatggtgaaacccagtctctactgaaaatacaaaaattagcctggcatggtggtaagcgcctgttatgccagctacttgggaggatgaggcaggagaatcgcttgaacctgggaggtggaggttgcagtgagccaagattgcaccattgcactccagcctgggcaacaagagcaaaactctgtctcaaaaaaaaaaaaaaaaaaaaaaaaaaaaa

SEQ ID NO: 2390 - DNA, 1533 bp, Homo sapiens
  misc_feature (12)..(12): n equals a,t,g, or c
  misc_feature (123)..(123): n equals a,t,g, or c
  misc_feature (1522)..(1522): n equals a,t,g, or c
  misc_feature (1527)..(1527): n equals a,t,g, or c
ggcacgagccgncacgggcagcgccccatagcgccagggaccccctggcagcgggagccgcgggtcgaggttatggatccagcgggcggcccccggggcgtgctcccgcggccctgccggtgnctggtgctgctgaacccgcgcggcggcaagggcaaggccttgcagctcttccggagtcacgtgcagccccttttggctgaggctgaaatctccttcacgctgatgctcactgagcggcggaaccacgcgcgggarctggtgcggtcggaggagctgggccgctggracgctctggtggtcatgtytggagacgggctgatgcacgaggtggtgaacgggcttcatggagcggcctgactgggagaccgccatccagaagcccctgtgtagcctcccagcaggctctggcaacgcsctggcagcttccttraaccattatgctggctatragcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccaaaaaaaaaaaaaaaaaaaaaaaaancccgngggggg

SEQ ID NO: 2391 - DNA, 2110 bp, Homo sapiens
  misc_feature (750)..(750): n equals a,t,g, or c
gcggccgctgcagcccggagctgagctagccgtccgagccgagccgtccgagccggggaagccggcgcgtgctgccgctcgtggcggccagaggagaggagaggcagcagcatggcgagtgtcctgtcccgacgccttggaaagcggtccctcctgggagcccgggtgttgggacccagtgcctcggaggggcctcggctgccccaccctcggagccactgctagaaggggccgctccccagcctttcaccacctctgatgacaccccctgccaggagcagcccaaggaagtccttaaggctcccagcacctcgggccttcagcaggtggcctttmagcctgggcagaaggtttatgtgtggtacgggggtcaagagtgcacaggactggtggwgcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcatggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcancagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcagacccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctmtctccggtccggagccggtcgctaagcttcagcgaagccccagcagccagcacctgcgatgaaatctcatctgatcgtcacttctccaccccgggcccagagtggtgccaggaaagcccgaggggaggctaagaagtgccgcaagtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaaaactcga

SEQ ID NO: 2392 - DNA, 632 bp, Homo sapiens
tgacgtccactgccttgtcaccagcgacctgcctgtcatgcccaccccctgaggaagcatggggaccctaacaccctggtgccctgcaccagacaggccgtggtcaggcccaggccaccggccgggttctgccacagcttcccacgtgcttgctgacatgcgtgtgcctgtgtgtggtgtctgttgctgtgtcgtgaaactgtgaccatcactcagtccaaacaagtgagtggccctcgaggccacagttatgcaactttcagtgtgtgtcataacgacgtcactgctttttaactcgataactctttattttagtaaaatgcccaggagtcctggaagctacgcggacttgcagaggttttattttttggccttagaatctgcagaaattaggaggcaccgagcccagcgcagcagcctcgggacccggattgcgtttgccttagcgggatatgtttatacagatgaatataaaatgtttttttctttgggctttttgcttcttttttcccccccttctcaccttcccttctccccgaccccaccccccaaaaaagctacttcttcattccgtggtacgattattttttttaactaaaggaagataaaattctaaaaaaaaaaaaaaaaaa

SEQ ID NO: 2393 - DNA, 1101 bp, Homo sapiens
ttgtttgccgaccgtcaatattcccgcgcctggacggttaaatagctaaagctggcgcggggctgtcacctccgcctctgctccccgacccggccatgcgcggcctcgggctctggctgctgggcgcgatgatgctgcctgcgattgcccccagccggccctgggccctcatggagcagtatgaggtcgtgttgccgyggcgtctgccaggcccccgagtccgccgagctctgccctcccacttgggcctgcacccagagagggtgagctacgtccttggggccacagggcacaacttcaccctccacctgcggaagaacagggacctgctgggytccggctacacagagacctatacggctgccaatggctccgaggtgacggagcagcctcgcgggcaggaccactgcttytaccagggccacgtagaggggtacccggactcagccgccagcctcagcacctgtgccggcctcaggggtttcttccaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggactctctgccatcccgagagacccgctacgtggagctgtatgtggtcgtggacaatgcagagttccagatgctggggagcgaagcagccgtgcgtcatcgggtgctggaggtggtgaatcacgtggacaagctatatcagaaactcaacttccgtgtggtcctggtgggcctggagatttggaatagtcaggacaggttccacgtcagccccgaccccagtgtcacactggagaacctcctgacctggcargcacggcaacggacacggcggcacctgcatgacaacgtacagctcatcacgggtgtcgacttcamcgggactactgtggggtttgccagggtgtccaccatgtgctcccacagctcaggggctgtgaaccaggaccacagcaagaaccccgtgggcgtggcctgcaccatggcccatgaga

SEQ ID NO: 2394 - DNA, 911 bp, Homo sapiens
gaattcggcacgagacgacaatggggaacgcggtgtttcccacctcttgtgggtagaaagcagtctgctttgaggaggcgagaaggcaaagccagggcagggcgttgctgtgggaagcgttcggtgaaagcrggtttcgacgcttaggagggccgagggagaagattccaccagcattgtccttgcttcaagttttaggatgtctgaactttcagctttcatgttttcaaccatcatttttttaatggcacaacctacatcttgtttttaaaagaagtagcctcaaattaaactcctaaactctgatgccctggggatgagaacaactagctkggatctcgtgccgtgtaatcaatgtttcattccgctgcctccatcatgtaatagaatcgcttccagaaaggcagttaactggaagcagcagaggctcccagccgtgagaggactgctcaacaatgccccccatcgccgcccccccacccctcgcaccccttgtgttttcccctctgaggggcccaagggttatggctttcatgtctaggtgtggggacagaggagggagaggcagatccygggccgggagaggatggccctggtctgaatctggagtaattaatgcccacccaaagaaaaggccctgcccaggtccaatgttgtcttagatctgatgatgctgctatttacaaaacactgatcgtccgaaagcttgaatctgttcctcctcgaatgaccctgtagatgcctgacctccaccgtacctccacatcactattcatgtccttctaggaaaatgtgcacatgcctcacgcactatgtgggaagggcgtgtttttaaattaataaagtgtgtcaccattagccatamraaaaaaaaaaaaaaaaaaaaaaaaaaaaaaaaaaaaaactcgtag

SEQ ID NO: 2395 - DNA, 661 bp, Homo sapiens
  misc_feature (25)..(25): n equals a,t,g, or c
  misc_feature (478)..(478): n equals a,t,g, or c
  misc_feature (661)..(661): n equals a,t,g, or c
tttaagaaattagtgaatccccggntgcagggaattcggcacgaggaggaggccgtcagctggcaggagcgcaggatggcagctgytcccccgggttgcacccccccagytctgctggacataagytggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctmtccgagctgctggagcatggagtgtgtgaggaggtggagagagttcggcgctcagagaggtaccagaccatgaaggtgcgcagggcagggctcggacctaccccaggaatgtcctgccctgggaatgacaacacagtccacaccatgcacggggaggcaaacaggggcagctgacccagcccaggggtcagangaggtcttgccgaggaagtggcagctaagctgatacctgatatgcacwagkcagccargyggagacaggcaaggaagaagcttgttttgaggacagaattttctagatcactcagcaccatctggcttttggggctttttgttttattttgtttttgagacggggtctcgctctgtcgcccan

SEQ ID NO: 2396 - DNA, 418 bp, Homo sapiens
  misc_feature (72)..(72): n equals a,t,g, or c
  misc_feature (417)..(417): n equals a,t,g, or c
aaaatgttcaatcatctatgtcatttaaaaatgtttaaaacacttttatgctttctaacatattccccatgnaaataaaaaatgtacatgtcttatctgtttttactctttggatgtcacgtttttaaacttaatttttcttttcctttaaactactgtgtggacttttatcaactactgttttatattcacctaattgtgtagtaaatattttaagataataacctggagaatttgaggaaagtcaaatatgtgtgaaactcttttttcttcccctgttgctttaggtacaaattatttggctcgacttctagtttttgtcttatttcaggcagctctgtccagtggagtgacccgktgccagagtgcagaggtaagagttaaaaaaacctaagcacctccaggatggtgaaggcng

SEQ ID NO: 2397 - DNA, 1490 bp, Homo sapiens
ggcagaagttcctctgcgcgtccgacggcgacatgggcgtccccacggccccggaggccggcagctggcgctggggatccctgctcttcgctctcttcctggctgcgtccctagacatcacggctgcagccctggctacgggtgcctgcatcgtagaatcctctgcctccccctcatcctgctcctggtctacaagcaaaggcaggcagcctccaaccgccgtgcccaggagctggtgcggatggacagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctggaccctgtccctgactctccaaactttgaggtcatctakcccwkctgggggacagtgggctgttgtggctgggtctggggcaggtgcatttgagccagggctggctctgtgagtggcctccttggcctcggccctggttccctccctcctgctctgggctcagatactgtgacatcccagaagcccagcccctcaacccctctggatgctacatggggatgctggacggctcagcccctgttccaaggattttggggtgctgagattctcccctagagacctgaaattcaccagctacagatgccaaatgacttacatcttaagaagtctcagaacgtccagcccttcagcagctctcgttctgagacatgagccttgggatgtggcagcatcagtgggacaagatggacactgggccaccctcccaggcaccagacacagggcacggtggagagacttctcccccgtggcacgcacttggctcccccgttttgcccgaggctgctcttctgtcagacttcctctttgtaccacagtggctctggggccaggcctgcctgcccactggccatcgccaccttccccagctgcctcctaccagcagtttctctgaagatctgtcaacaggttaagtcaatctggggcttccactgcctgcattccagtccccagagcttggtggtcccgaaacgggaagtacatattggggcatggtggcctccgtgagcaaatggtgtcttgggcaatctgaggccaggacagatgttgccccacccactggagatggtgctgagggaggtgggtggggccttctgggaaggtgagtggagaggggcacctgccccccgccctccccatcccctactcccactgctcagcgcgggccattgcaagggtgccacacaatgttttgtccaccctgggacacttctgagtatgaagcgggatgctattaaaaactacatggggaaacaggtgcaaaccctgaaaaaaaaaaaaaaaaaaaaaaaaaaaaaaaaaaaaaaaaaaaaaaaaaaaaaaaaaaaaa

SEQ ID NO: 2398 - DNA, 781 bp, Homo sapiens
aactcctgacctcaagtgctccacctgcgttggcttcccaaagtgctgggatacaggagtragccactgcgcctggctgatcccagcacttttmaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaagccgaggtgggaggatcccttgaagccaggagtttgagacaagc

SEQ ID NO: 2399 - DNA, 1659 bp, Homo sapiens
ccgggctgcaggattcggcacgaggtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaattgcagttgaaggagtataacacaggttacgactatggctatgtctgcgtggagttttcactcttggaagatgccatcggatgcatggaggccaaccaggctggtgattagtaactaaagcatatgctgtggaacatccagcactgatgccagattacctgtccctaatactgagcagaagctggtgaatgaaacaggagatccctcagtcaaaacaaaaa

SEQ ID NO: 2400 - DNA, 564 bp, Homo sapiens
tcgagttttttttttttttttttttttgagacagagtcttgctctgtcgtccaggctggagtgcagtggcgcgatgtcggctcactgcaacctccacctcccgggttcaagcaattctcccacctcagcctcccaagttgctgggattaccagagaagaggctgaagggcaaggagggaaaggaattggttcccaggtccatggacctcttgtgaagcccccattgctgtggggtctgaggaaacacagaggaggtgtcagctgctctgcctgcccccactcccctgccaacaacgtagtaacctctgtgcctaacctctgagccctggcctccaaccctgggagggaggtacttatgttatccgcattgtgcacgtggagctcagaggggcagccacttgccaggccagcaatccaggctgtctgtctccagagcccaggcccccagtcaacaacttgccaggtgcccctctccaggcctcggcttctccacctgtgggtcaagagcaccaggcttgttctagagctatcttctcagacctgatgtgggctcgtgccgaattc

SEQ ID NO: 2401 - DNA, 933 bp, Homo sapiens
  misc_feature (425)..(425): n equals a,t,g, or c
gttgggttttaatcctgggtttgacacttaataaactgcatgatcttggaaaagacatgtaacctctctttcaatttccttatgtgtaagatgcttataatagtattcactttgtagatactattattgcaaggactaaaattatgaatatgtgctggcaaataccaaactttatattaatacaagtgtcatcagaatatgtacatatattaatagtaattgttaccaaaacaccaggggttcaatctgggtcctgctgctcactgcacagaaagccaatgcctgagacaacaagtgttgccaaggaagaaggcttaattgggtgctgcagccgaggagatgggagctcagtctcaaatccatctctctgacagaccaaaactggctatatagcarggaagaaatgtaatcatgtgtgggaaaancrggaactcagaaggggcttggaagcaatcatgttgaatcagcgtccacattttattgtctggatgtgatctggtgagtttcatttctttgatactttttttgagaggcctgaaggtcatttcctgaggaaggatctcagataaaacaaatataagtttcaaatgttaagaccagaaagttcaatttctatgtttatttattcttttttttaaaaaaaaaagctatatgggactgttgggttggtttcataatggctgagtactttgaaggttctgtggttgcatgaatggagaagatagagtgatgggtggggactttaaaataggatgatccaggaatgccctgaagtagagacttgtaagaatgagaaatagcaagttatgcgggtggcatagaaaaagcttccagattgaaaagcaaaggcaaagaggatgtcttgtgcagagaaagcatttgacaaaatcgaatgcctcttcatgtttttaaaaaaaaaaaaaaaaaactcga

SEQ ID NO: 2402 - DNA, 1321 bp, Homo sapiens
  misc_feature (1314)..(1314): n equals a,t,g, or c
ggctggagtgcagtggcgtgatcttggctcactgcaacctctgcctcccaggttcaagctattctccagcctcaaccttccaagtaactgggattacaggcatgcaccaccacacccggctagtttttgtatttttagtagagatgggktttcaccatgttggccaggctggtctcgaactcctgacctcaagtgatctgcccgccttggcctcccaaagtgctggaattacaggcgtgagccactgcgcccagcttccatttcttctttgaaaagtaggaggggttggaattgtcaccctggaggttcatggttgctarattattgattctgttgctggattcaggaracctgttagctggctagttcacagcaagtattgggtgtttggaggggggctgcagagccccttctcaggccccaggagggccagctgccctccctaccccctcttttggacactagcgggcatgttctgctgggaaaacagacagtgtaacctgacttcgagggctgcaggctgaatctctttcagatgtactggctccttgagaggcctagcagatctctactctgtgggtccctttcggagctggggctcaggtttgacccagccactctgaccggagacagcgcagaaatcaccaggagcatttgtttgttttcctttgctgtccagacagtggcccaccgtctgcttcagtctgagcgtggccctgcactagtgagactgatgtggccacaggttcagagaatcagtgcgcctgagtgggagagcagagcgggaggggatttggaggcaggcgggctgtggacagggaggggggaggacatcttccgagctgtcagcgggaggccttcttgaaggtctttcaggagcaargccagaggccgtgggagtkggcggggcctggggctgggagtcaggggtctgargcctcatcttggcccggcctctgcttccgggagaacttggccaattcccttctcctttctgaaccttggtggccccagctgtcacttgagattagcaaggacctccctggtcccagcaggagtgagtggctttgggcagggggtggagtgcagattgcactgccacgtcacccagctcagaaggcccaggtgtggtccagctgtggacttgattgtgaactcctggggaagggctctggtcctttgmctcarktagcgggacccccaccagtgccctgggtgcccctgctggccctyctctcgctgacccmagccccaagttctggctgaactcacagargccccargctyctggggcccatcaccagcagcttctgntgcaatt

SEQ ID NO: 2403 - DNA, 2838 bp, Homo sapiens
ctgcaggccccgcaaacccacccctcctctccattctcacgaccaccacctcactcaggccccagctgctgctgcctctccctggaccccacccgaggcccctgcagttcctgcgtcctgatggccccttgcaccacgctccacatggcagctggagggaggaggcttgtcacaatgcccgttgtgctatttcagctttggttatttatcttaaagacagataatgcatttgcgtggttgaaaatcaggaggtgagaagcctctgccctcttcttgggtgtccccatccccggaggtgctgttcatgagctcctggagggggccttccagaaaggttgatgcataccacacataccctccccttcccgttcgcacaaatgcagtgtgctcatgtcccactgtaaggcaaagcacacggcgccatcccgttccatggccaaggagcgtcccacagtgtgggctgtgctggaaccttccagccagcacctcatggacatctgcattgtttacggattttgctgtcatagacgttgtatacctctgcacacgctgtatgcttccaggatgcttttcttggaagtggaatcatggggcattggagcctcgggctgaccatctggatccatcccacggggtcagagagagcttcagaaacagaatcatgatgtcccgcctcccacactcacacatcccaccgggctccccaccacagagcccagcgcagtctccttggcgtggcctgtggggtgcagcctctgatgcctccacccattcccttttgctctagctggagtgcgacaccccccgaccctggggtccctgtggttccctccgccaggctctgtccctggctcttcacctgcctggcacctgctcacctgttggccccatcctaaatgctgcttttgtgggcatcttccctgcccacaaggtgtgactgtagtttccctgtgacccccttggtgccacttgtccacgttatttgcgtttgggtgatgttcccctccgcagccacagctgcatgtcatccgggagctggggcctttttctcacagggacccagccccttctctcgcacctggcctctgttaggccatcgggaaatacctgctgagggagctggtgagacagtggccctgggcctccagcccaagaggcacacattggccgtgggtgtgcacggaatgctggccctgagcacggtcacagtgggtggtttcggaggcttcccctggacttctggcccaggctgccccccgttatcttggacatgcttcatttttcccatcctcacgtaaacccctgcaactcctccctaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaaggtgagtggggtgggacgttgcccgggagagctgcgtgcctgctctgtgtggtaagggtggcgcttcccgaaggcccccttcccttcgtggagcgtacatggtgcctgcgagtgtgggccatggtgtctgttctccgggagctggtatcccaggctgatttcattcctgctgagtgagggagctcactggcctagtcactgcagtgacatcctgtgagccccaaggtgcagttagcagtccagtggccccacatcagggcaaggaggatgtcacccatagttcttatttctctatccccattcctacccctcaactctagtcatctgcccccactgccccttcatctcccaaaaaagactaaatcacacaagcaccacatgctcgcatggacccggccaccctgcacggtccttgtaacacacagcactggtggggactagagtcacgtttggtaggtgctcccgtcacggcaggagtaagtgcaggcgtctcagcccggctgccttgcctggtgtctcctgagagcatcagccaactctgaccctccagtttccaactccagcatacctgtactcccatccccgggcgtggcagacaccgggtattttgcatattatgcccaagagattgggttaaataggtgtcaacttggatttcaaaaccaaaaaaaaaaaaaaaaaaa

SEQ ID NO: 2404 - DNA, 2495 bp, Homo sapiens
aagagcctggggccagagggccagacagccacagagctcctggcgtgggcaaggctggccaaggatggcgacgcccaggggcctgggggccctgctcctgctcctcctgctcccgacctcaggtcaggaaaagcccaccgaagggccaagaaacacctgcctggggagcaacaacatgtacgacatcttcaacttgaatgacaaggctttgtgcttcaccaagtgcaggcagtcgggcagcgactcctgcaatgtggaaaacttgcagaggttccgaggcaggtgatgaaggacgaggacaagccccctgacagagtgcgacttcccaagagcctttttcgatccctgccaggcaacaggtctgtggtccgcttggccgtcaccattctggacattggtccagggactctcttcaagggcccccggctcggcctgggagatggcagcggcgtgttgaacaatcgcctggtgggtttgagtgtgggacaaatgcatgtcaccaagctggctgagcctctggagatcgtcttctctcaccagcgaccgccccctaacatgaccctcacctgtgtattctgggatgtgactaaagggaccgtgtgctcctgagacccaccttggaccagtccacggtgcatatcctcacacgcatctcccaggcgggctgtggggtctccatgatcttcctggccttcaccattattctttatgcctttctgaggcctgcccgccctgatggtcatcggcactgggagtgccaacagctacggcctctacaccatccgtgatagggagaaccgcacctctctggagctatgctggttccgtgaagggacaaccatgtacgccctctatatcaccgtccacggctacttcctcatcaccttcctctttggcatggtggtcctggccctggtggtctggaagatcttcaccctgtcccgtgctacagcggtcaaggagcgggggaagaaccggaagaaggtgctcaccctgctgggcctctcgagcctggtgggtgtgacatgggggttggccatcttcaccccgttgggcctctccaccgtctacatctttgcacttttcaactccttgcaagcccagagaggcatcacagtctgactgtgagagaaacagccaagacaggagtgacgagactcaacctgttcagggaagtcactagaaacccaggcgtcctagatgcagcgggtataagcccccaagaccaggactggctcccagcgccccatgagagatgtgtggcttagtggctagggccaggcagccctgggtccaaatcctagccccatccctgacccagcaagtcactcagctccttccgtcctcattcatcgcgaaattgggataatcccgtacttatctcaccagctttttttttttttttaattgagatggagtcttgctctgtcacccaggctggagtgcagtggcacgatctcagctcactgcgacctccacctcctgggttcaagtaattcttctggtttcagcctcctgagtagctggaactacaggcacatgccaccatgcccagctaatttttgaatttttagtagaaatggggtttcaccatactggtcaggctggtctcaaactcctgacctcagatgatctacctgcctcagcctccgaaagtgctgggattacaggcgtgagccactgtgcctggcctgccagatttcacaatgaacaatgacaatgcatatgtgggaactactaggtcttcaatatgtgggaactatattaataatcatagaaattatgactgtaaggccatctgaggctgtctccaggtggagaatcatgagtccatgcctggagaatcccaggggttgatggttggggagaaatgaactttgaaactatagctgacatcgttattctttcagaggttaccttaatatgtaagcctgcacacttcactctactaagtttccactgggtctgagttattctgtatttctctcttcctctccaatacaacagagcccttggtatacttgaattgcccattgaactcttctcaatatttgtcttgcatatagaggtttagttacagatttccttgaaacatagagtttttctaagtcatgttctgtacttactataatttctttcaccccacactttcccttttcctcttgctggagtgcctcccataataatcctttatagagggagtgatggttgttttgtatgtctgaaaattcctctattttgctctttcttttctgtaataggcataggtagatattttatttgaaggtctctgtttttcatttccaagatttcgatttggttcttttttatttcatttttgaaatggttgtgaaatggttgcatttttgcctttcccagcagttcttgagtggttacggtgggtctcctccctctcagcagccaccagcccaggctgccccactctctgcccacccctttccaggctcaccgaggcctctccttcctaacaggtg

SEQ ID NO: 2405 - DNA, 3712 bp, Homo sapiens
aataacgccatgagcggactgaacgcggcccaggcggcgttaaatacggcaagtaataatatctccagctataacgttgccggatatacccgccaaaccactattatggcgcaggccaatagcacgttgggcgctggcggctgggttggcaatggtgtctacgtttctggtgtgcagcgtgagtatgatgcgtttattaccaaccagttacgtgcggcgcagacgcaaagtagcggtctgactgcccgctatgagcagatgtcgaaaatcgacaatatgctctccaccagtacctcttcgctggcaacacagatgcaggatttcttcaccagcctgcaaacgctggtgagtaacgcggaagacccggcagcgcgccaggcgctgattgggaaatcagaaggattggtgaatcagtttaaaaccaccgatcaatatctgcgcgaccaggacaaacaggtcaatatcgcgataggtgccagcgttgatcagatcaacaactacgctaaacaaattgccagcctgaacgatcaaatctcgcgcctgacaggcgtgggggcaggggcgtcacctaacaatctgctggatcaacgcgatcaacttggtgagcgaattaaaccagattgttggtgtagaagtcagcgttcaggatggcggcacttataacatcacgatggccaatggttactcactggttcagggaagtacggcgcggcaactggcggcagttccttccagcgctgacccttctcgtacgactgtcgcttatgttgatgggacggcaggcaatattgagatcccggagaaattactgaataccgggtcgctgggcggcattctgacattccgttctcaggatctggaccagacgcgtaatacgcttggacaactggcgctggcatttgccgaggctttcaacacccaacacaaagccggatttgatgctaacggcgatgccggtgaagatttctttgctatcggtaagcccgcggttctgcaaaacacgaaaaacaaaggtgacgttgcgatcggtgccacggtaactgatgcctccgcggtactggcgacagattacaaaatctcgttcgataataatcagtggcaggtcacccgccttgccagcaataccacttttacggtgacgccggatgccaacggtaaagtggcatttgatggtctggagttgacgtttacaggaacgcctgccgttaacgacagcttcacgctgaaaccagtaagtgacgccatcgtcaacatggatgtattaatcaccgacgaagcgaaaatagcgatggcgagcgaagaagatgcgggtgatagcgataaccgcaacggtcaggccctgctggatctgcaaagcaacagtaaaacggtgggcggcaccatgacccgctcctggccgccgggaaataccctggtcgcgcggctgatgaactgctgcggcggctatctgaaccattacggcgactactcctccgcgcaaattgcggaaggtttgaactatacctacggcggctgggcagatggcaacagcccgtcggatatcgaaaacagtaagctggtagtgctgtttggtaataaccctggcgaaacgcgaatgagtggcggtggggtgacttactatcttgaacaggcacgccagaaatctaatgcccgcatgatcatcatcgatccgcgctataccgacaccggtgccgggcgcgaagatgagtggatccctattcgtccgggaacagatgccgcactggttaacggtctggcgtacgtcatgatcactgaaaacctggtggatcaggcattcctcgataaatattgcgttggctacgatgagaaaaccctgccagccagtgcgcccgaaaaatggcccctataaagcttatattctgggtgaagggccagatggcgtggctaaaacgccggaatgggcctcgcaaatcactggtgttccggcagacaaaatcatcaaattggctcgtgaaatcggtagtaccaaaccggcgtttatcagccagggatggggcccgcagcgtcacgctaacggtgaaatcgcaacccgtgctatctcgatgctggcgattctgaccggtaacgttggtattaacggaggcaacagcggcgcgcgtgaaggttcatacagcttaccgtttgtccgtatgccgaccttggaaaacccgatccagaccagcatttcgatgtttatgtggaccgatgccattgaacgtggcccggaaatgacggcgctgcgtgatggtgtacgcgggaaagataagctggatgtgccgatcaaaatgatctggaactatgccggtaactgcctgattaaccagcattctgaaatcaaccgtacccatgaaatccttcaggatgataagaagtgcgagctgattgtggttatcgactgccacatgacctcatcggcgaaatatgctgacatcctgctgcctgactgcaccgcttccgaacagatggactttgcgctggatgcatcctgcgggaatatgtcttacgtgattttcaacgatcaggtgattaaaccgcgctttgaatgtaagaccatctatgaaatgaccagcgaactggcaaaacgtcttggcgttgagcaacagtttactgaaggccgtacccaggaagagtggatgcggcatctgtatgcccagtcgcgggaagcgattcctgaactgccaacgtttgaagagttccgcaagcaggggatctttaaaaagcgcgacccacaagggcatcacgttgcttataaagccttccgtgaagatccgcaggcaaacccactgactacgccatcgggcaaaattgagatttattcgcaggcgctggctgacattgccgctacctgggaattgcctgaaggcgatgtgatcgatccactgccgatctacacgccgggctttgaaagttatcaggatccgctgaacaaacagtatccgctgcagcttacaggtttccactataaatctcgcgttcactcaacttacggcaacgttgatgtgctgaaagcggcttgccgtcaggaaatgtggatcaacccgcttgatgcccaaaaacgcggtatccacaacggcgataaagtcaggatctttaacgatcgtggtgaggttcatattgaggcgaaagtgacgccacgaatgatgccgggtgtggtcgcactgggtgaaggtgcctggtatgacccggatgcaaaacgtgtcgataagggtggttgtattaacgtactgaccactcaacgtccgtctcctctcgctaaggggaatccgtcacatacaaaccttgttcaggttgaaaaggtgtaaggagtaaccgatgacaacccagtatggattttttattgattccagccgttgcaccggttgcaaaacctgcgagctggcctgtaaagactacaaagatttgacgccagaagtcagcttccgccgcatttatgaatatgctggcggcgactggcaggaagataacggtgtctggcaccagaacgtgtttgcctactatctgtcgatttcatgtaaccactgcgaagatccggcttgtactaaagtctgcccgagcggtgcgatgcataaacgtgaagatggttttgttgtggtcgatgaagatgtgtgcattggctgccgctactgccatatggcttgcccgtatggcgcaccgcaatataacgaaacgaaaggccatatgaccaaatgcccgtacccaatcgccctatagt

SEQ ID NO: 2406 - DNA, 1329 bp, Homo sapiens
  misc_feature (520)..(520): n equals a,t,g, or c
  misc_feature (1140)..(1140): n equals a,t,g, or c
tctgttcctctctcctggaagcttgcagacctcccttcagaaccaatcccaagaagccacctatccggaacaacacaaggatgctgccggactggaagagstccttgatcctcatggcttacatcatcatcttcctcactggcctccctgccaacctcctggccctgcgggcctttgtggggcggatccgccagccccagcctgcacctgtgcacatcctcctgctgagcctgacgctggccgacctcctcctgctgctgctgctgcccttcaagatcatcgaggctgcgtcgaacttccgctggtacctgcccaaggtcgtctgcgccctcacgagttttggsttctacagcagcatctactgcagcacgtggctcctggcgggcatcagcatcgagcgctacctgggagtggctttccccgtgcagtacaagctctcccgccggcctctgtatggagtgattgcagctctggtggcctgggttatgtcctttggtcactgcaccatcgtgatcatcgntcaatacttgaacacgactgagcaggtcagaagtggcaatgaaattacctgctacgagaacttcaccgataaccagttggacgtggtgctgcccgtgmggstggagctgtgcctggtgctcttcttcatscccatggcagtcaccatcttctgctactggcgttttgtgtggatcatgctctcccagccccttgtgggggcccagaggcggcgccgagccgtggggctggctgtggtgacgctgctcaatttcctggtgtgcttcggaccttacaacgtgtcccacctggtggggtatcaccagagaaaaagcccctggtggcggtcaatagccgtgktgttcagttcactcaacgccagtctggaccccctgctcttctatttctcttcttcagtggtgcgcagggcatttgggagagggctgcaggtgctgcggaatcagggctcctccctgttgggacgcagaggcaaagacacagcagaggggacaaatgaggacaggggtgtgggtcaaggagaagggatgccaagttcggacttcactacagagtagcagtttccctggaccttcagaggtcgcctgggttacacaggagctgggaagcctgggagaggcggancaggaaggctcccatccagattcagaaatccttagacccagcccaggactgcgactttgaaaaaaatgcctttcaccagcttggtatcccttcctgactgaattgtcctactcaaaggagcataagtcagagatgcacgaagaagtagttaggtatagaagcacctgccgggtgtggtggctcatgcct

SEQ ID NO: 2407 - DNA, 1640 bp, Homo sapiens
  misc_feature (687)..(687): n equals a,t,g, or c
  misc_feature (764)..(764): n equals a,t,g, or c
gtgagcactggtttaagcacctcatagactggcatttctgcctcccacaagataactggacctggcttaggaatctgaatagcagcatgcatggagtgcttctatgtgtcaagcactgttttaagcacgtttgaaataactcacttcatttgaaataactgagtctacatgatgactgtaaaaggttggttctgttgttacctgcattttaccgatgaggaaactgaagccttcagaagtgcagtcacttgtccagggccacatagcaggctgagatttgaaccgccaggccttttgactccagagcttacactcttaactccattcatctgctaagtccttccctgtcctcttgcaagatgccttaatccagggattatcaaactttttcttaaaatcaggagaactcattgcaaaccaattcatacctagattccacagaatcaaagatgcagccgagttacccattgagctggagtgggggcgtaraattgccctgtttggcctccttsctgacattgctgttcctactgcagcctctgatgcttccccttggaggctcccagacccagttgggcaaccacagtgttgtccgtctgcttctcccagttcagaggctcggctttgccgaagtccctccactcgaagtggcacagagttgaggtctcttccaggcacactggcgtnccctcactgggctcctgtccctgccttggtcaacatcctggtgcgcactgggtgggtgactaacaacatttttgganttgtggctggagcccaggtgactactccaaatcacggttttccattctgtgtgagatggcctcatgcctttctatgcctctgacaggcagttctctgaatttcgaaggctcttgtcttaagagactgtcagaagtccctttggcaagggactgtgggcaaaccgcccagcggctgtggtcaattcctctctctgatggcagtagtgctacctagggggccgcctgggtgaaacgggcttttttgcatacttccaaactggttccctgtagctaggggaccaaacaattattgtctgaaccaagatgctcctgagagtgaagagaatgtaaagtgctcagtcctggacagatggtatatatgatcgccgtaaatacagccagcccttgccagaagtgggtctggagaaatggtgcgggggggcgtgaaaagggcttacaacccgcagtcctgtgtctctgctaggtgaattggtagcatcagtcctcactctgcttattcagaccaaaaaattgttaagttcttcccaccaccacggagcacagacttgattaagatccagaaaggtcagccgggtgcagtgacttgcgcctgtaatcccagcactttgggaggccgaggcgggtggctcacttgaggtcaggagtttgagaccagcctggccaacctggtaaaaccctgtctctactaaaaatacaaaaattakccasgcatggtggcccatgccataatcccagctactggcggggctgaggcaggagaattgcttgaacccgggaggcgaaggttgcagtgagctgagatcgtgccatgcactccagcctgggggacagagtgagactctgtctcaaaaaaaaaaaaaaaaaaaaaaaactcga

SEQ ID NO: 2408 - DNA, 608 bp, Homo sapiens
ggtgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtgaccaaatgacgagccctcgcctctttcttctgaagagtactctataaaatctagtggaaacatttctggcacaaamtagattctggacaccagtgtgcggaaatgcttctgctacatttttagggtttgtctacattttttgggctctggataaggaattaaaggagtgcagcaataactgcactgttctaaaagtttgtggcttattttcttgtaaatttgaatattgcatattgaaatttttgtttatgatctatgaatgtttttcttaaaatttacaaagctttgtaaattagattttctttaataaaatgccatttgtgcaagatttctcaaaaaaaaaaaaaaaaaaa

SEQ ID NO: 2409 - DNA, 1450 bp, Homo sapiens
ggcacgagcggaagtgcaactcgaacttggtcggggcgcggatcccgagagggaaagtcataacaaccgcacgagggagttcgactggcgaactggaaggccacgcctcctcccgcctgccccctcagccctgtggctgggggcagagctcagactgtcttctgaagattgatgtctatttccttgagctctttaattttgttgccaatttggataaacatggcacaaatccagcagggaggtccagatgaaaaagaaaagactaccgcactgaaagatttattatctaggatagatttggatgaactaatgaaaaaagatgaaccgcctcttgattttcctgataccctggaaggatttgaatatgcttttaatgaaaagggacagttaagacacataaaaactggggaaccatttgtttttaactaccgggaagatttacacagatggaaccagaaaagatacgaggctctaggagagatcatcacgaagtatgtatatgagctcctggaaaaggattgtaatttgaaaaaagtatctattccagtagatgccactgagagtgaaccaaagagttttatctttatgagtgaggatgctttgacaaatccacagaaactgatggttttaattcatggtagtggtgttgtcagggcagggcagtgggctagaagacttattataaatgaagatctggacagtggcacacagataccgtttattaaaagagctgtggctgaaggatatggagtaatagtactaaatcccaatgaaaactatattgaagtagaaaagccgaagatacacgtacagtcatcatctgatagttcagatgaaccagcagaaaaacgggaaagaaaagataaagtttctaaagaaacaaagaagcgacgtgatttctatgagaagtatcgtaacccccaaagagaaaaagaaatgatgcaattgtatatcagagaaaatggttctcctgaagaacatgcaatctatgtttgggatcatttcatagctcaggctgctgctgagaatgtgtttttcgttgctcacagctatggaggacttgcttttgttgaactgcaactcatgatcaaacaagctaattcagatgctgggaagtgctttcgcttagctatgtggaagaaccattgactgtatacaaccaacaagtgtatggtgcaacaggagatccattgaaaaccgtttataggactgaacgacaaccccaaatgcaagtgaccatgagcaactacaaataggtatacatatgcatttgagctgaacagactttctgacatataatttagtcaaaattgctgtatttcttccccttaaatttatacataatcagcttcttgtatggacccaaattggagaaatgtaattcagtagttggtgagaaataaaggattgtgacctctgtgtaattatcaggaaaaaaaaaaaaaaaaaa

SEQ ID NO: 2410 - DNA, 1974 bp, Homo sapiens
  misc_feature (654)..(654): n equals a,t,g, or c
aaaattgctaattaatattagtatttggttgctttatcttaaaacaatacctacctctgttaataggaaaattagaaattatatctattgttcctaaagatacaatttgtttctctaactccaagggaagtgaatgaatatgtttcagactatacttgtctgtgtattatttgtttttgtaaggtggttttttcttttgcttcaaattgagagcatacaaacaaaattccactgtataagcagtcaattttggtaataataacacatgcctagagcactcagattaaattattacacatactaataaaattattcacagtagtactccttggtaatgttggtattagggaacagggatagaacccatcttcaaagtcaaccctattacttcaagcctttgcaggtcctgctgtttccaaggatacaatccaatgcttaatttacaggaatccgaaatcatttgctgtgttaaaaacttgagattagcccttgctgcccccttccaggttggcctttggaagcgaaaggtctttaagcttaagtaaactggagaatatttctgagtaagcaggctccaggtggagggtacactccaagataccttcacttgccaaaacaacactccctgcaaggttatcagcgaaaaggcagtanaaagagccctcctgctgccagaaggtcttgttttgcaaggcttctcagcctgcctgcagccattgggtgaggagaggaaaggacacctcacctggcagagcagcacaaaggtcaggcatgtttccctcctgacctggaagctgggtcctgctccttcacatgaactgtccagggcttggtcatatacccaggtcccctcagtcctgcccagartgactccactggtctccccagaaaacaccaacagcagararaaatgaartgtgtctgttttctggtttcatattgcarctcctcttgctcttcytaggacagaaataacatctgcmatgccararamctgtgaagtaataaacaacctttcccccagctcttgacaagcattaccttgcttkgaggtgcaatcagttytgacaagtttatggytttgtgtcyttcaacccaatggacattaccytctgggggagtttaatgacccytytcagcttcacactcacttgaaggaaagagctagaagtcagtaatgatgtgttatgacttgcatggcttcaggtagttcagaacctgcaacctgtagttcagattacaggagaagaactcagacgataaattggcttccaaagaaggccaaatagaaaaaaaaaaggttcttcagaccaatagctgagtgacctgaaatttaaatgcaaaaaatgcattaaaacccacaaaaccacttcctttaaaattcttgataccaaacatgttacagcattaagtgaaccttaatctaagcaaaattcagagaagagcattcacacctttgatagaagagccagccagccagggtgctggggctcagctcttgagaaaaatgttgatgtaaaagccttggtggcctggttcagcccctgagcctccctggtaagcacatggcaggctcagaacatccataactgaatgctctgagccctgtaaaaatgcagttacaatgggaaatcaactcttaagtatgctatgggatgctgtgataaaatttgagtttctctaccttctgtttgcactttggttcatttagaaaagagtccataattgtgtgcttcaagagtgcaattccatggctgtaacagaatagagtcctctttcttctggcctttgcctctttggggatattccaactctgtggaaggtgatcatttgcgattatgatcagttatttatatttgactgtaaatgaaaacttcagagtcagtttcaaaaaacaagagatggacataaggacatgtgcttatgagtaggggacaaataactagagacaaaaaaaaaaaaaaaaaactcgta

SEQ ID NO: 2411 - DNA, 5092 bp, Homo sapiens
gatattttagataccagtcctttataagatgtgtttgacaaatattttctcctagtctgtggcttgtcttttcattttttttaaacagtgttttacagagaagaaaaattttcaattttaatgaagtctaccttatcaattttttctttatgggtcatgattttcgtgctgtgtttacaaatatattgccaaacaagattttcttcctcattatctacaagttttacagttttgaattgtatgtataggtctgtgatactttctgagttaacttttgtgaaagataaaaggtcagtgttggatagattatttttccttttgcatgtggttgtccagcaccatgaagactcttccttctccactgaattgtctttgtacttttgccaaagatcagatttacctcttaaatctttgtcaaacctgtccacttctcaccatctccattttcaatctcttcaagccaccatcctctcttgcctaattattgcagtagtccttactggtcttgccttatctgttgatccctgttttattcacagaatatgatttgtgattttaaaggcataaataaaatgccttttctgtttaatatctaattgctttcctttatacaaacaacaaaatccaaattctttatcatggcctgtgagaccctaaatgatcaggccctaccttttcttccaactttaccctcattcttcctctccagccacctttggctcatttagtctctgaatgtgttactgtctactaccttaggggattcctaatgactggaatgccccttttaagtctcagcttaaatgtttcctcttcagggatgccttttctagtcattatatctaaacatttagttctcttccttgacttttactctctaacattacatcaattctttactactattttgcccaatttaaaagcatatattgttggtctatttattgtctgacttcctgagaccagggatcacgtctgtcttgtttgctattgttttttttagcagctgctacacagtaggcgccaaacaaatattttaaggaagaagacataggcagcctttgagatgcccaaatttagtgaggaagatccatatgtatgtaggtaaattatagtgccattttagtgctgttagaaagttgtagttttggaaaacaagtaatgaaaggttaagaaagaaaaatctttcggattcttcctcaagtgtgtgaactttatagctgtcaatttatgaagtcttattgcctaggtttcttttttttttttttccattctttgtcacttttattcagtaggttttttttcccttattttcagtgccagacatggcgaggagtgattacagccaactgttattaaaacatttgttcacaacatataccccctttataccactgaccccaaactgactcattttatgtgctttcattctttctttttttaatataccactatcaagaccgggtggagggggcaagggtaagagagatgaaggggaggagtccaggaggccagaagaggggaatgctacaagccacagtaagaatgagctgtatttaatttaaaaaaaagggggaaggggtgtaccccacaaatgatacagtaatgaggatacacaattaaatcccatagcatgactgaaagctttcactgtgtttgacatcatcacaatggaattgcctaggtttcttagctaaaagtaagtttgtatcttttattatttgatagtggggggttagcgtcctagaagtcccagacttaggttctcaattgtcttaagaaaccatccatctgtattgacaatatgggtgctctaggggcagtcttaagcccaataagaggtcttttagcgcactgagcttttgctctctagggtcagtgtttggatttgaatatccagcactgccactcaccttgggcaagtcatttaaactgcatgtctcagtttcctcatctgcaaagggactaataaacacacctacctcctgggatggttttgaggaatacattggctaatatatgtaaagcatttactatgtgccagaccctgcaataaatgtgaaagtagtctctgttactacataaagggcttctcatttagccaaaattttattacattctagtacacttacgttgagtaatatgcagctttttcagtggatacttcatttcaaccttacagagaaattagaaaccatcagatgggatatccttcattctgataccaaacataaatctgacatgttcaacaccccttccttcagcttcacctatgctctatatcttatcacctctgctatctgagatcttaagatttttaaaaaattacttctttctcatatttaactttttcctttcaactagatccttctcttatgcatagaagcatgttaaagtttgtctaaaactttcattgatttatatctagctacttccccatgcttcctctgcatacccaaacttaaaaactctgtaatctctccattcctcccctactcagcccacttgaatcttgcttccacctctgataacctcactgaaataatactattgaggttattagtagatcaagtggacagctttgtatctagtcatatgtgtaccctcagcagcatttgaaacagtagactacattctctcttcacactttgggtgctattaatctttagtcctctgatttcctgtctttctggccagtttttagtctgattcgcagactcattctcactctacctggactttatatatgggagtttcttaggcagggtccttggttatcatgtgtcaattctctgggcatttctaccaataccacagattgaataccttcacacagatgactcgtgtttataacactgatcaacttcatagatctacctatttgacttctctttttgggtgtcccaggagcacttcaaacatgctttatgaatttatgatcttcgccttcaaatctggttttcttttgggagatctcatcttagtgactgtcacccacatgtgttcagttatgtatgctggaaacctgggtgtcgtatttcagtatatctgtagtccttacaccataatccatcatctagtcctgctggtttttttacgggctggggggctgaaatatctcagccatatatcctgttgtcattaccttgtctcaatccatgatttcctaacttggatgcaagagttctaattggtctccttgtatataaccttatgctaatgaaattcattctccagaatttggctggagtgatgttattcctttaattaaaacattatattggcttccaattaattttgggattcatgggtagggtagagacaaaaattcttgctataatttttgaaaacctgagagtcgccatttacctttccagtcttacctttgaccactttttggctgtctcttttgcccatttacttacttcagggacgtctcttgtgatgttcttgaataggtgagatcattctgtttgctgtcattgtgccatgtatactccattttgtatactcctggttttacatttttgcgtgccatttctccctgtagctaaaatcctgtgagagaccaggatcttgtttacttttgcttaccatttgccattgcttattagcacagctaattggcttatacccttcatacattgaattttaagatgtcagccttatttttcatttactatgaaaaaaagggaaggaaagtaatcagtgaaagaagaaacctaacatgatagatgtaaaacatactgctttgaatcaatgaaagataagatcacaatgatattgttgaaatcattttctgtaaaagctgaactaacttaaactataacatcctctcccagccccttgcttttctataatggtaaaataaatgctattgaagaaaaaaaatttagaccggttctagattctaacaccttaagaaaataattggcactaaatccactgtttcaggcctttcaaaactgaaaaattacattgtgtttctaacattgaaaataaagtttcaagatagttttaattaatttggatataagtatagaaggtttgaccactttcagaactctcaggtgattttgacttgtgatcatctctgggaagggatatttagtgatagcctgaattttaaaaacctcaacttgaacactgggagttgatgggagaccatctgattaagggatggactaagtaagtgtaccagtgtcagtttgcctattaaatacaatcaaagcgcaatgtctttccttttaagataaaaaaccagtaatttggataatattttaattcagcaccaagtagattgtttctcacacctgtgttggaagttactggtttagagtatggtttaaaatttttttctctcataggcctttaaaattaaaataatttgcatgttaattaaattccagccttaatagggttttccatcaccttaattcccacatttgtttttcatttccaacatctttgaacttttattgaataaaataattgtacaatcttagataaatattaaaccaaaatttgatgaaagtaatactgcattcatgatactttgctagctagatactataattagaactgaatgaaataaacaacctgtttttaatttttcccttttttgagggatgacacagtttgcctaattagaaataccttttgtgactgtcgtttgtttacctctattttgcagcagcatagcacttctgagatgtttaacttcttttttcatcaaaattattttgaacatgctgacatatctttgagatttaattcctagtcatttaaagaaaataaggggctaggggtggtggctcacttctgtaatcccaacacttggaggccaacgctggaggatcacttgagtccaggagtttgagaccagcctggacaacatagagacctgtctctacaaaaaaaaaaaaagttagctgggcgtggtggtgcacgtctatagccccagctactctggaggctaaggtgagaggattgcttgagcctgggaggtccgtgtctgcagtgagctgtgatcctgccaatgcactcagcctcggctcagtgagaccttgttaaaaaaaaaaaaaaaaaaaaa

SEQ ID NO: 2412 - DNA, 1560 bp, Homo sapiens
  misc_feature (461)..(461): n equals a,t,g, or c
  misc_feature (497)..(497): n equals a,t,g, or c
  misc_feature (499)..(499): n equals a,t,g, or c
  misc_feature (595)..(595): n equals a,t,g, or c
  misc_feature (621)..(622): n equals a,t,g, or c
ggctttttctgacattggtgaaccccctagactacaattaatccctttgctacagacacctgtagcccttgctgcctcctttttgttaagaggtcttataattttatgtttgatgtccatcttccccacttgattgaaatgcactatttatggaggagctatgtctgtattgtttgttgctgtatccctattgtctagcatagtgcctgacatacagtacaggctcaagacatatttgcacattgatttatggaaaactgatactcaggttctgaagaataaataaatgcacctgaactgtcaaagtgctaaaagcaggcaatccagaaatgtctggaggtaggaatcacagctgcaagaggcacttcctggttaacctcgccctccgacctctagttggagccacccctttggatcctacttcagcctttctggagtcagtggctcacaggtttcctganacaaagagaagaggcttgagactattattacatatnantcttctttagaagcaaagttggttcgtggattgaattttcaaccttacagtaccaattataaatcctgaggcattctatcagttaagacaacttanaatatttgatcccattcagaactttnncatttgttttaaagcaggaaaagtaaargmagtcaatgtwmtaacycttcttctttaaaatgtggatcatagtcctcttggggatgtttgttcatttaatattaacattttttaagcttgscatgtwtcgtgggtgtatctgtttggtttcctttggtaactgcattttgccatgacccttgataccagctctactgctacagccctaggctaggccaccgtcatctgtggcctggaccctttcagtcctaactggttgccgtgtctcctttcttaggccccccaacagttcatcttccatatccacacacagtagcccttaatgatgtttttaaaggaatgagctatattaggatgatttctttgcccaaaaactccttcaatggttttccacttactccagagacccaaaaatctaaggcattttccctatgggccctggatggccccacattccccctgacccccgtctccagtgctgtcccctcctgcttgctgtgcttccagcccacactggcttccttccttaccctcagggttccaccaatctggatcttgtctcataaactttgttcctctgacttcttctttttgaatgttcttttcccagaccttcacatggctctttgctctccccttctgagtctgaacacaaaggtcactgacttaaagaggctttttcccaccatccagttgaaatcagcaccctctctgtaactgtgtaccacattgtcttattctttctcataggtctgaaattgtcgtattcatttttaatgtattttttgcctttttgtccctgctaacatataagctttttgaggtcagagactttcttttcactgtagtattcccagttcctaaaacagggccctacacatattggatgtttaataaacatttattgactaatacaaatgaaaaaaaaaaaaaaaaaa

SEQ ID NO: 2413 - DNA, 1092 bp, Homo sapiens
ggcacgtgttgtggagtctcctaagtgcttgctggacacaatttcttgtctatttttgctgccttatgattctccaaaggacatttcccccacgggctctgaggacatctccgtggctttccaaccccatgggggttaaagggaaaaaaaaaaaaggaacgtttatggaaatgatgctagggttgttctctcctctttgccttgtcactggaattgctgaaggcagggctgaagatgcttctctacatgacatctgcaccacccaacacacacttaccttcacaccttcataccctgttggagggtcctgatgactacagggcagtaaattcagccccacaggagggccacagcagcccccagcctctagcctcctaccctccttcttaggcaaccttgacaggaaattttccctctgccttctccttgatcccaacggtagctgcataatagctgagctcacataatccctgtcgccagtgctagagtgcccttagatggaggtagcccaggtttgacttcctgaatccccagcagcaggccttttctttctagagctctttgcaggaagagaaagctttggaccagctcatgctgggtgtaatcctttgtggaagcctccctgtttcccttctctgatctgccccggagattcctgtgtgtcccagtctctagggagggaggcttagctggagaggttcaagggcaggagaaagcaggagaatgcagaggccgcggggagaggacagaaagtatatcatttataactaacctttagcctttagccactcaaaaatatttcctaatagcctaagggttcttggcaggtctttccccacatcagcaagaaatcttgggagttgggaagagtcagaccttgttccctgaacaagctttctgctttggccaagagttgttaggagattaatgcctgtccctgaaaggcacaggttggagtgtttacttcttcctctcctttcctctctccccccttagagatcgtgacccttcctgcttgcctccctggtgggctctttcaggctggacacagggtttaaaaaaaaaaaaaaaaaaaaaaaaaaaaaaactcga

SEQ ID NO: 2414 - DNA, 1423 bp, Homo sapiens
ggcacgagatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttgtcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaaatgctctgaaattgtatttttcctgtggaaagcataactttcatctgcttgttcgtgctcaaaaaagatcatgaatgaatgattgcatgattttatgccattgtgcttatactaaaggatatgtagcccatctcttgagctgktaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtc

SEQ ID NO: 2415 - DNA, 1266 bp, Homo sapiens
cccatgtcggccctgaggcgctcgggctacggccccagtgacggtccgtcctacggccgctactacgggcctgggggtggagatgtgccggtacacccacctccacccttatatcctcttcgccctgaacctccccagcctcccatttcctggcgggtgcgcgggggcggcccggcggagaccacctggctgggagaaggcggaggaggcgatggctactatccctcgggaggcgcctggccagagcctggtcgagccggaggaagccaccagagtttgaattcttatacaaatggagcgtatggtccaacataccccccaggccctggggcaaatactgccttcatactcaggggcttawtatgcacctggttatactcagaccagttactycacagaattccaagtacttaccgttcatctggcaacagcccaactccagtctctcgttggatctatccccagcaggactgtcagactgaagcamcccctcttaggggcaaggttccaggatatccgccttcamagaamcctggaatgamcctgccccattatccttatggagatggtaatcgtagtgttccacaatcaggaccgactgtacgaccacaagaagatgcgtgggcttctcctggtgcttatggaatgggtggccgttatccctggccttcatcagcgccctcagcaccacccggcaatctctacatgactgaagtacttcaccatggcctagcagtggctctccccagtcacccccttcacccccagtccagcagcccaaggattcttcatacccctatagccaatcagatcaaagcatgaaccggcacaactttccttgcagtgtccatcagtacgaatcctcggggacagtgaacaatgatgattcagatcttttggattcccaagtccagtatagtgctgagcctcagctgtatggtaatgccaccagtgaccatcccaacaatcaagatcaaagtagcagtcttcctgaagaatgtgtaccttcagatgaaagtactcctccgagtattaaaaaaatcatacatgtgctggagaaggtccagtatcttgaacaagaagtagaagaatttgtaggaaaaaagacagacaaagcatactggcttctggaagaaatgctaaccaaggaacttttggaactggattcagttgaaactgggggccaggactctgtacggcaggccagaaaagaggctgtttgtaagattcaggccatactggaaaaaaaaaaaaaaaaaaactcga

SEQ ID NO: 2416 - DNA, 456 bp, Homo sapiens
  misc_feature (456)..(456): n equals a,t,g, or c
gaattcggcatgagctttctttctcctgcaggcattggaaatacagtcccagctggcaacaccagccagcagcacagcccggaatcctgctcctgacctgcaccatccccaccagcccacgatagaacgtttttgtaggcattcctcctcatgggagaggatagagtacatgcgagtttttgctctcctcccaccctttcacaagagcactgtgctttcttttcttctctttttcctttctttttttttttttaggcagggtcttgctgtgtcasccaggctggaatgcagtggtgcaatcatagctcactgcagccttgacctcctggactcaagcaatcctcctgccttaacctcccagctactcaggagaccgagacaggaggaccacttgagcccaggaggttgaggctgcagtgagccgagattgcaccactgsamtccagcctggggaan

SEQ ID NO: 2417 - DNA, 2707 bp, Homo sapiens
ggcttctctggactgcgtttggatgatttctttgaacggtttttattctggaaagttctgctcgagcatctggtatctccctggtgtttgggatgtctccttctcattcccccgtgtcttgctttaagctgcgtgtcctcgtgtttccgctgcccctgttcttgggcactgcgttgtgttctgtctgggatccccgtgcaaggcccctgggtctggtggctgctgcccggcctctgggaccgtctacctgtcccagcccccgtttccccgcttcttcagctggcaccttgaaactccgtgccaggtgagcaggcctgtggctgcaggttcccggaatctgtcgtgggttctgggttgtcccttccagtgcaggcggtggtcaacgcgccaccatgggggtccaggcagcaggatggtcatgtgatgggggccactctgggcttttcattctcctttcatctgtggcctcggaggctccccatgttttctgaggtgcacagaacatggaggggtgctcatctcatgtcagatattggaaggatgtcgtgcaggaaggttcgagggtctcggggtggtcctgagaagccgatgtgataggtgcggcagcttcctcttcccctgagcgggggcttccagagcctccctcccactggtgcccatggggtttgagcctgatagctccgcaggattcagctgctgtgagtcacagccaggatggagaggtctaaggcaggcctgatgccgggcagggcgacatttctagaaaaggtttcatctggtgatctgctaaatggcatgaaaatcacaaaattggcactcagtgaccatcaggctggctgtgtgtggctgctctcctcaacaagcaaatggctgcccccatccagagccccgactcccgctggcctcccccgtgcggggatgtggggaccagggcaggccccagagaccacctgacctctctggcaggaagaagaccacgtcgtgccgtttcctcctcccttgagcccgttagctgtctcggggaaccggtaagcccagggccaccttgtcacgtcctccactgaacgtgggtccacgtagatgccagccccttggtcttgcccagaagttgtgggaggtgctggttgccagggatggctatgcatgtttgtccccatggcagggaggcctctgggggcctggccctccccccgctagctgcttctcacatttttgtctccccgagagccacctgctctcccagggccctcaggcccccgtctgccagtctcctggcacctgggctggggtctgcgccaggcaactcccacagcagggcaggatccaccctccacgttatcattactgccatcccctgtgcctgggttggaggccacgcccacccagtggggcccctctggaaaggagacttgacctcagggtggtggcagggctctgtgggatgcccctggtgacagggaccagaatgttccctaaagtggatgtcaggcccctggctcagatggagctttctgttcttgatgggctttagaaggtgaaaaactaggcttccagaggtgaagttgcactgtgggctttgtggcaggtgagcgctgcctgaccctgaacagctgctaaagactcagacctggagccttcctggtgtcctgtgtgtccacgcaggtgtgccagtgtggcagccctgcgccaggagctgcccctgcatgtcatggcagcatccatgccagccgagcgcccctctggctcccaggcatctcatcctgtctggctctgagggccgtgctgcagtgaaaaccattcaccttgacagtttggctttcgaccaagaattcactgtcatatttttgatttttaaaattaagactgtattcagatataatttgcgtaccataaaattcttccttccacagaatatggtttaatggtttttcagtatatgcagccatcatcatctaagttgagaacatttttgtcacccccaacaagaagccccatgcacatggtccgtcactccccaggccccaaatcccagccagcactgatcttggccattggcctgtcctggtcattccatagaagtagagccacgtgactgtgtgtgtgtctgggccacgcgtggctgtgtgtatgagagccatgcgtgactgtgtccgggtcacacgtgactgtgtgtccgggccacgtgtggctatgtgtccaggccacgtgtgactgtgtgtgtccggcctcagcacagtattttcaaggctccttccttccttttcatgactgaatcatactccattgtctgcacagaccacaatctatcccgtcatttgtctctggatgcttgggtggctgcactttgctgctgtgagcacttgtgcacaagctgtcgtgtggatgtgtgttttcagtaacctgcgtgtacgccgaggactggaattgctgggcgatgtaactgtgttaagcttccgaggacctgccagactgttttccacagcagctaaataattgtacgttcctcttagcaatgcataggggttcctgtgtctccatgtcatcaccaacacttgtccaaactaaaaaattctaggccaggcgctcatgcctgtagtcccagcaatttgggaggccaaggtgggcagattgcatgagttcaggagttcaggaccagccagggcaacaaagtgaaaccttgtctctaggaaaaaaaaaaaaaaaaaaa

SEQ ID NO: 2418 - DNA, 2558 bp, Homo sapiens
ggcacgagctgggattacaggcgtgagccaccgcgcccagcctaaagtgttgatttttatggcaaatggtcccttcctcttaatggcccggggggagatctgtgtgatagctggtgttaggaaaggtctgagatggagacattcagtgacgtcagcttcctgaatgcccaccctcctgtgctgtttcttgctggcactgggatgaggacatggctctggtgtggctgtgttttctcaattctgttgagggatttggggtgagtcgtgctccccctctgtctcctcctttggaagagaatgcccaggacagtggtgccagtttcaggtacagaaaaacaaaaatagcgctcttttggactcagttctctgtcacttccagtttgtgaggggacaggtatttgactcagcttggcaaagccaggaatggagtgttgtagtaagagcttagcagcgtgctttgggctttgagctctgaacttaagaggagacctcagttcagtctacacaggcttcttacctcaggtgagtcactttgctggggtctctgggccagaggtcaaggctgcccctatgagggctttggactctgagggtgtggcgttatgtgtgtattagcaaaatgctggtgtgcctgggagctttggggcaatgctcaccagctcctgagttctcgggagtgaagtttgggactggatgcctcttgcattctgagcctctcactcctgtgtctttcctcttgcccttcagatgtttgctgacagccatttctctcccgaactgtctgccagcccagactgacctgtctgcttctcctgctcagcgcccagagcaccctgtctgtttatgcctggggccggttttaactggtcccccagtcccatgtcacacacacctgttccctttggcttagctgcagtgtcacctctcgtccctgtttccttcctctctatgaggctgaaagtcaatgttacttggagatacagcactccacagcctacagtcattgctcatttaatctttgcagggagtgcgtgaggtcagtaggtaggcattatcgtgctcattttacaaatggaggacctgcagcccagagaggtgtgatttgcccaaagacacacagctgctctgctattgagcacagccagtcctggaatcaaggtcctccagcattggtccatcattccctgtgaaatgttagtgcaggctgggcttggtggctcaggcccgtaattccagcactttcgggggctgagacgggaggattggggtcaggagttcaagaccagcctgggcagcatagcaagatcctagctttacaaaaacaaacaataacaacaaacaaaatggtaattcataggcatgagttaaccacatatggggtggggatgccctagcctcacaatggccctatgagggctttggactctgaaagcgaagtcaggtgcggtgttgtgtgtacctgtggtcccagctgctcaggatgctgaggctgaggcaggaggccaagactgcagtgagccatgatcctagcactgcactccagcctgggctggagtaagaccttgtctcaaggaggggtggggcttgaaagcgggccctgggccccacctcctcacatccccagtccctgatagcaccatcatgtgggcgatgcctgtgtaaccccaagctgtatcataaagctggacaacaaagacagctccctggggtccactgtaatggaccaaggtctgtgcgtccttcctttccacatccccctaaagttgacaacagtagtacatggcacgatggatgttgtcttggcagggagcttataactcagcttaggccagatccaggagggcaggtcagtccttgaggatgggcagcagggaccgaggagggcccttggcgtcccccaaccttcgtttttctcaccccggggataaggctcagaggcggtgccagggaaaggcccactttgggcctactcacagcagcgatattgccactttccagaggtggtgaactgattccctagcaaccaggggccctgcctgagtaggtcacagcatgtcatcggctcctcaggaaagaggaagactgctcagctggagctcgggaccatgaaggcaggtgtgtgctgggctctcaggcactgtcctccccagcccacctcccagggctgaaccttagtgacagggaaaagcagggtgcaggacagcgatgcttcccaaagccacctgcagggttggtgctggaagttaccagatggcaccaggctggccgtgggctcacaatgacctctcttcctagctggaacttccagggtccctgttggaaaggaagtgtccagaggacacagcagctgagcaaggggcccacctctggttccctccatcttttactctgcatttctataccttcactctggagggctgggtgggaggacatggcttccttttagtcttctggtagaagcatggatgcaaacaccttccttgagtttccatgagcatagctgccacaggctgacctttccaaaagacattactaaatataaaaaaaaaaaaaaaaaa

SEQ ID NO: 2419 - DNA, 1114 bp, Homo sapiens
  misc_feature (1073)..(1073): n equals a,t,g, or c
  misc_feature (1102)..(1102): n equals a,t,g, or c
  misc_feature (1105)..(1105): n equals a,t,g, or c
ttattaaatgaatatagcatttcttagcaacttcttttgatttgtgagtatatattttcttggcctcaaaattaaagtaaaaagtatcctcttactcagwggaggacaggggcaagagcctgggmccttatttgctaattaaaatgcacacacacacacacacacacagaaattttgagagccattttaatataattgcctccctagaaacataccttttagggaatttttatcactaaaccacatgttatttaaatacgtacatgtttaacataaatacatacataaaattcacatgcatacttaacacttatgttaaatatattcaatgtatatacatatgtacacaatatatgcatatatacatgtgggtatgtggtatgtgtgcatgtgtgtgtatggccagctacataatttgtgggactaagggcaaaatgaaactgtacggccctcgttcaaaaattaggtgtggggtgcttctaagcacagtcttgtgcaactgcacaggttgcatgtccatgaagccatcctgtgtgtgtgcacatatgtgtatgaatatgtattttatataatacatatatatgcatgtatgtatctgagaagaaatgtttaaaaggctacatacaagcttttccaggtctctactatctgktaactaactagagacataactcacaatatgcagtccccactgagtgttcaccataatttgagattcttggcatgktaacttttcattatggaatattgaataatttcaatattattcatacatttcttgatgttcaaacatacacaaaaatagaataatgaaactctacccatcacccagctgcaacaaatatcaatactttaccgktcttaawacatctaaccccttactttttgtttgtttcttttggtgaagtatttaattgtaattttttttttaagagacaggatctcactckgtcacccaggccagagtacagtggtacgatcacttgagcctaggaggtcaaggccgcagtgagccgtgatcgtgttactgcattccagcctgggtgacagagtgagatcatatctaaataagnataataatcaaaaagagcaacagagcatnccngttagaagg

SEQ ID NO: 2420 - DNA, 554 bp, Homo sapiens
gaattcggcacgagcctccacctcccaggttcaagagattctcctgcctcagcctcctgagtagctgggattacaggcgtgcaccaccacacgttgctattttttgtactttaagtagagacggagttttgccacattggccaggctggtctcaaactcctgacctcaagtgatccacccaccttggcctcccaaggtgctgggattacaggcatgagccactgtgcctggctccatttacaactatttctatcattataatgcaggggctctcaaacctgagcatgcctcagaatcccccagagggctgtgcgcacagactgctggacctttccccagcttctgattccgtccctccagagtggggctcgaagattgcctttgaggtgargctgcgggtcgggggcacgtctgagaactgctgcagaggtgartgctgtggctctgtctgcattccccctggaagactgargcaccaggtgtgctggtgctaacagaccacaagtccctcctggacactgcccttctctgaagggagctgcctcctcactcga

SEQ ID NO: 2421 - DNA, 1303 bp, Homo sapiens
  misc_feature (1170)..(1170): n equals a,t,g, or c
  misc_feature (1199)..(1199): n equals a,t,g, or c
  misc_feature (1214)..(1214): n equals a,t,g, or c
  misc_feature (1231)..(1231): n equals a,t,g, or c
  misc_feature (1243)..(1243): n equals a,t,g, or c
  misc_feature (1247)..(1247): n equals a,t,g, or c
  misc_feature (1265)..(1265): n equals a,t,g, or c
  misc_feature (1276)..(1276): n equals a,t,g, or c
  misc_feature (1283)..(1283): n equals a,t,g, or c
ggcacgagatgtaatagtgctttctgggaatgtyctcyccgtatttgatagtggtccctgaaatactacttggtatttgtaaacaaatgtctgtggtttgccttccaaggactttaatgtaggcttatctggctgaagaattttgtgagaaatgctcacgttagtgtcttttgtctttctcttgctcttgttagagtctatgatttagaggatgtatgcttggctgtggaatatctcggagctgaagagaagaagccaggtcttagcattctttctatataaatgttttcataccttaccccattttcaatatggtacatccttcttcaaccatacatgttttctctcagttttaggaattgtgttttctccaaaagaaaaacttccagtcttctctctcagtggtgaaggagcaatcaccaagtgtccacaactggaaagaggattgataatctaactacttcttacacagatgtagatttactcttcctgtatttatcttaccttcaccttcacttgcaaaggtgactgatgattcctacttctgtgcctttgggggattttgtaatgtggatttgtttgtttcttggatttcactgcatgtaaattaagattcagcattataattatgttaatctgttacctgttcctattcgtctactcactttctgctttcaacattttcttgcccttttcccctgtggtttttgcttctctctttctctctctttctctctctctctctctctctctctctctctctctgagtattgttgttgtattttgggggtttttgtgtgtgtgcccctgtatttgtctccttttgtcttgccattgtggtggattcaagttgtgtcaatttaagccaaactggaactacatttaccagaattcctttccttgcatagctctggtcagcatatcccacaacagacattttacatgagatgcggcaggtgcaagagcatagcacagacattgattccatgtgtgtaaggtcaatgaagggcaggatgtgctactgtagattacacacatcattgctcatctactgatacatgttactagtgtgtggcagccagatgggctcatctactgatacatgttactagtgcgttactccagatgggctacttttccttcagcttccctcatttttagcctaatttntagccaggtggattttcagtttcctatgngcaccccatcactgnagttgctgttttggagntggtaaacgacnaagngttcctttgatttgctgntggcttacagngccattnaaaaaaaaaaaaaaaaaaaa

SEQ ID NO: 2422 - DNA, 918 bp, Homo sapiens
ctgcaggaatcggcagrgcagttttcatcatctatgatcttaagtttcctcatgctctttctcattgttaagacaataccacttattttagcttattgttacaatagtatttcatttttttctaacaacttggtattagtcaagatgggatataataacaaatgactcttgaaatcttcatgggtgccatgggaagtttcaagaacacaacttgaaagtgaattgcatgactttgttctgtgtttcattgaccactactcattcagtgagcctgaaagtaactgtgtatatcactgttagtatactatgcatgccagatacccaagactcaaacttttcctttcctttagataccacctacttagtcatcaattttggttcaacctactccactaaatagctttgacttccattcacttaccactttagattagtgctatagactcctattttacctccttcatatcaatccccttaaaactcccaatagcttccattgtttcaaccaaaagctcaaattcctttaatataaagtgttatatgaactggcaccctatatactctatatcctaatctctcatctttcatttatttctttaactcctgactcatgtaacaaaaatgtatttatctcagcacgtatgtactcccttgttatgctctcccaaatgtccctgtatttttcattgaatagcaattgccacattttattttatatgcttgtgttaccatttatatatatatttactacagactctgcttttagaaggcatacactggccaggcgcagtggctcacacctgtaatcccagcactttgggaggctgaggctggcggatcatgaggtcaggagatcgagaccatcctggctaacacggtgtaactccatctctactaaaaataaaaaaaaaactcgag

SEQ ID NO: 2423 - DNA, 597 bp, Homo sapiens
  misc_feature (12)..(12): n equals a,t,g, or c
cttgccatatancaagctgaattacctcataaggaacaaagtggagytcacgcgktgcgccgtctagactatgatccccggctgcagaattcggcacgagcagtccagaaactgcgtgccctgccctttgcttgggcccctctaccagtatgtccagcatgtgcccgggggccctcagctcccctggggcccagcccacccaagacacagctcttggtcgtgaacatgaagatgagccaaactctagtggctcttcctgaaagaaatgagaatgcccagccacacccatgcacgctttgttcttttttatttaatactgaggaaccggagtggaggggtcctgccgggctgcagtgaccctgagggaagtcaggagagccctgggctgcagaagagtccccccacaggctccgaagcaagcttgtcctggtgcattcagactgctcacagcaggctttgggccctcactctccagatcccagagagccctccagggctcccagctctcgggccagtgcccamgtcctcgaaggggggccggtaaccaattcgccctatagtgagtcgtattacaattcactggccgtcgttttacaa

SEQ ID NO: 2424 - DNA, 979 bp, Homo sapiens
ggcacgagtacaaagccaaaatgtgatggaacatcccatgatgcagacaattcattttactccagctgtactccactttcttttcctgtggtcttccacgtggagtgtctctatctgagtcccctgtccagccctttttaagggtatcctgttgagcaggatttgaaatgtttcacattttgcttaatcctccacctccaccctgatgtcctgcagtaaatattcacgcacatttcagcttgacacactctaggcaagcagctcaccccagtgtgggcaacagttctttttttgcttcactagctaaccagctggatgactcatctctgcctttagattttccaggtggatgttggacatggcacattctgctcaccaaactcctgcgtaagcatagcaagacccagagtttccttgacaccctctctcacatgcacaaggggagaggcagctcctctctgctcctttctgagaggcatgaatcggtgaaaacaacagcatagcccatcccagcaatgtcctcacaaaattccaactgcccattctttacggtgagttttctaaacaggtttcctccatgacaattttctctacttgctgtcttaataggagatttttgtttccccccacctgtatttttaatggacacatatacctttctgataaaaatatgtaaaatattctgttcgtttttaaaatgtcatattcaagtctgtggccatcttttgttcttaatattcacgtctataaaatgggctagaaaacagcatcattgctcaaggtgtaaagctattggtttatctagctgaaaaggtgtgcaaggactattgaaaaaagaaatgttcattcagaaacatgggctcttttattttgtacatatcttacagcataggattttttcccctggtgtatatgccaaagatcagcctcagctgaaaaaaaaaaacacatatgcccctaacttactgcttgcttccaa

SEQ ID NO: 2425 - DNA, 313 bp, Homo sapiens
  misc_feature (1)..(1): n equals a,t,g, or c
  misc_feature (247)..(247): n equals a,t,g, or c
  misc_feature (256)..(256): n equals a,t,g, or c
  misc_feature (274)..(274): n equals a,t,g, or c
  misc_feature (287)..(287): n equals a,t,g, or c
  misc_feature (295)..(295): n equals a,t,g, or c
ngtttttgtacccacagattagcattttcttgatgtttgaaaaaagtttaagctatgtcctaatttaaaaatgagcacaaactacttaacagatgtctgttccctcttctcttacttaaattatctttattttcaccatcacctcccagtgccggaacacctggagctctgtgttttgtggttgggtcctgggttgccaagttcctatttggtcagtgccctgggcctgtggggcggttctgcaggnaagtgggcnggctgcttgcacgagggnatacgttgcagcntccagtgngaaccattttgttgaaga

SEQ ID NO: 2426 - DNA, 622 bp, Homo sapiens
aggcgatctcggctcactgcaacctctgtctcctgggtttargsgrttctyytkyctcagcctcccaagtaggtgggactacaggtgtgtgccaccacgccctgctaattctttttgtatttttagtagagacggggattcaccatattggtcagtctggtctcaaactcctgacctctggtgatccacctacctcagcctcccaaagtgctgggattacaggcatgagccacagtgccctgccagttttgtttattttgttactgctttttcctctccctctggaaccactarattgtgagtcatgcacarcgtgtgtgtctctctcatgcccgctatatagtcacagcagctgttctttgattcatttgttcattcaacatatatactttgagaggctggcacaatgccaggcactaagtttgatagtggagacacacaaattaaaaagagattcatatcctgacctcaagttgatgacaatttagaagggctatgcgtaggaaaacagaaaactataagcaatagactcagtgtcacggtccagatatatccaagacacttggagcacagagggagtcctgctccaagggagtcttatgtcttttattagccatagata

SEQ ID NO: 2427 - DNA, 949 bp, Homo sapiens
  misc_feature (55)..(55): n equals a,t,g, or c
  misc_feature (508)..(508): n equals a,t,g, or c
catgataaccccaactcgaataaccttcactaaagggacaaaagctggagctccnccgcggtgccgccgctctagaattagtggatcccccgggctgcaggaattcgscacgaggttgtgtgtgtgtgttgcttgggtgtttgtctcctttgtaatggtcgtgggtgacaagtgtgtcagagtacttgtccctcctatatgtgtatctatgcgcacgtatctttctttgtgtgtctgctgctgtatttgtgtctcttcttagcgagtggctgcaggtatgtgtgccctcggggtgtttcttctggtgccatggtatgagtactatctggttctcttgttttttccttgtgtagctttcagtgtggtttctggattttttctttgcaacgatagtaagcgtactctgcattcctgtgctttgtgtttgtgtgcaggtatatgctttccctatatgtttcttttctgacttgatttgtgactagctgtgtgtgtacacggctgtgtgcanccatttgctgaaatgcagttgtgtgtgtgtgtgtgtgtgagagagagagagagaggagagagagagagaaggagactatggcttttctgtttgkmcaaarrtcatgtsagcctatgagtgcctctctctgtgactggagctgtatgtggttacatgtggtcacaagtgcacattcaagttcacatacacagagatatcattttagggcttgaacctggaagtttgcctccagggtcatctgaacctggattcaggttcagatccagggccatctgaacctggatcgtgtgtgtgggaaagacccaggacccacacacaatgtcakcagctgtgtgtaattgtgtgctctgtgtgtggctgtgaatctgtgtgtgtgatttgcctgttgattgtctttggcatggctgtgggtccacgggcggtgaggttcaggagtctcga

SEQ ID NO: 2428 - DNA, 3224 bp, Homo sapiens
  misc_feature (3176)..(3176): n equals a,t,g, or c
  misc_feature (3184)..(3184): n equals a,t,g, or c
  misc_feature (3196)..(3196): n equals a,t,g, or c
  misc_feature (3202)..(3202): n equals a,t,g, or c
  misc_feature (3211)..(3211): n equals a,t,g, or c
attgtaagggaacaaaagctggagctccaccgcggtggcggccgctctagaactagtggatcccccgggctgcaggaattcggcacgaggattctcctgcctcagcctccggagttgctgggattacaggtgcacgctgccatgcctggttaattttttttatctttaatagagacggggtttcaccatgttggccaggctggtcttgaactcctgacctcatgatccacccacctcggcttcccaaagtgctgcaattacaggcatgagccactgcgcctggccacctttgctgatttttataaccagggttcagtgggcaacagcaaccaagtgtcagtttacagccaaatcagggattggactgactcaaggctgcagttcagtatttgtaaaactaggtctatttctgatttgtccctatgattgggaatagctcttgatttggcaagtgaaagcctaggtgttttctagattacctcctgctcagcatggtgagattgtggaagctctgcttaagccagcttcttatcaaatgctttctgcttggtttagcagcctgactacgtgctacttatgcatagataaatgttttgagaagaaaaatatctcctattattatactcacttctttgtgctgccttctctcttaatccctctctcctttggtaaccctaagctccaattatgcccaaacctctgcttagccaccactttctgcttggcattttaatgtctcatcctaaactgattataagccagcaaattccttgagaaggaaaggagcatagaatgtcaggctaggctcacctcagtgagtttccttttctctcagacaccttacttggcccctcaagtcctggcttccattggtaacactctaatgctttcaaccattcttaaaattaagcttttctgttgtttgtttgttagtaggaggtttggtctgttgtaaattagtctgatgcaactgacacagctgaaagtaaagtcagttgtttctcttaaaaaatccacataatggccaggcgcggtggctcacgcctgtaatcccagcactttgggaggccgaggcaggtggatcacaaggtcaggagatcaagaccatcctggctaacatggtgaaaccctgtctctactaaaaacacaaaaaattagctgggcgtggtggccggtgcctgtagtcccagcgactcgggaggctgaagcaggagaatggcgtgaacccaggaggcggagcttgcagtgagccaagatcgcgccactgcactccagcctgggtgacagggcgagactctatctcaaaaaaaaaaaaaraaaaaaaaaaaaaaaatcggcagaggctctaacacagttcacaaagacagccctttgcaggaactctagaagacctgatatgctccccacaaagttcagtcatttaatgagacatgttgacatcacttgttcatgtgtttggcatggctctgagtgcaggtacacaaagggttgttaagatgtctttgtcctcaaaacactcatcatctacagtgagagagactgacaagtagagagctgatggcactgagtgtgacaagtgctatgaaagaattaaaaggatgtcccaggaggttagtagaggcacacctaatctattcttgatgtgggggtaggtgaagccaaagtgggcttcccagaggaagggacacttcagctgagcccaaagggctattagtgttttcccagatgaaaagatgaaaggtatcaggcagaggaaatagcatatgcaaagagagaaagagagagcatggattgtctaaaaaacagcaaatacttctgtttgataaatgtgcaaattaccacagagagtgacaggggccagatcatgaagggtttcttgtatcacaagttaaggggatctccaagccatgcccggtagctttaaccatctatttgaaatgatacatttaccaagggcaatggtgctcagaacctcattgtttggttccttctggaaacactggttatctcacatgatgaactctaattgtcaggctcgtgccgctcgtgccgaattcggcacgagtccaggaagcagagcttacagttagctgagattgcgtccctgccctccagcatgggcaacagagcaagactcactcacaaaaaaaaaaaaaaaaaaaagtaaaytgtataaacactcaaagtcagagcttatcagataggataaataagtgagacacaaatgtwtgctatytacaagaagtgcatgttaaatataaagacacaaatatgttaatattaaaaaagtactctgttggcagggtgtagtgaatggaaaggctgaaatataagagctaatatggcagttaaaggaaatggcaatgacggtaaaactaaaaaggttgatggaaagagtaactgaggttgaaagactggcaggggcaagattatgtatccatgtagaagagtttgcaatttctcctttgaacatttggaagggacttaaacagtgagaagttatggacagatttgcatttacactctagaaagagcattggctcaagtgtgacaaatggaatggagtgaattgaggggaagtcaaggagagcaggtgagacactatttcagtagacaaggtgagaggcggtgtgttggaagactagcagtcatggtgttgcaggaaagtkkgtccactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggccgaaaaacccgtctatcagggcgatggcccactacgtgaaccatcaccctaatcaaagttttttggggtcgaggtgcccgtaaagcactaaatcggnaaccctanagggagcccccnatttanagcttgacngggaaagcccggc

SEQ ID NO: 2429 - DNA, 722 bp, Homo sapiens
  misc_feature (2)..(2): n equals a,t,g, or c
gnaattcggcacgagaaaaatttacgggtaacactgaggggtggggtggaaagttttgatcataaagtggtcaccaacaagggcacttctgaggtgctaatgatgttctgttttctgatctgggtcgtggtgacattcacatattcattaaattgtacatttgttttacataagtttattatatttcctaattttaaaaaagttaaaaggaggaggaaaaagttggttatgaaagtgtaaccattcttccaaaatatcaattaaaacacatctgaattaagaggtaaaatatatcaaagattgacagaaaacaaaagctctgaaatgatatttccagcctaagaacagtcgttgcttttgttggtttaggaagttttgttctcctgaactaatgttcaaaatgaaaaaaagtcacctgggccaggagcagaggcccacacctgtaatcccagcactttgggaggccgargtgggtggatcacaaggtcaggagatcgagaccatcctggttaacgtggtgaaaccccatctctacaaaaatacaaaaaattagctgggcttagcggtgggcatctgtagccccagctactcgggagattgaggcaggagaatggcatgaacctgggaggtagagcttgcagtgagccgagattgcgccactgtaccagcctaggtgacagagcgagactccgtctcaaaaaaaaaaaaaaaaaaaaactcga

SEQ ID NO: 2430 - DNA, 485 bp, Homo sapiens
gaattcggcacgagtaccctgttctaatacagttcagtgtgtcttatagaaaatcatttatcttttgcctccctgaaatgattttaactttttgtgtttttctccttttctcatttcataatgcaattaaatctaccccttttctcaaattttaaaaacacatgaataaaatatcttttacttaaggtcaaacacaaatggagtggcgtaggctggtcatggtggctgacacctataatcccaacactgtgggaggccgaggcaggtggatcacttgagctcacaagtttcagagccgcgtgagcaacatggcaaaaccccgtctctacaaaagaataaaaaacttagccaggcatggtagctactcagggaggatggcttgagcctgggaggcagtggttgcaatgagccaagatcgcaccactgcactccagcctgggstataaagccagaacttgtctcaaaaaaaaaaaaaaaaaactcga

SEQ ID NO: 2431 - DNA, 1026 bp, Homo sapiens
ggcacgagcctctgtcaccaaacagtatgaagtatctaaacaatgttttaaaacaaattatttgtagccttcactgttggctgtctccatggcaggtgagctgcgaccttttgtcagcagcctagctgagatggctgctgatgcctgcaggtataagtgactgtcaattttccttactcatttatcttgctgtctcatgtttaaactagaagaagttgttcatctcaagtgtcctcaatgtcaatctatcatgtttgcctaattttgctcttgtacatcacatctcacagtcaccagaacatgagtagctgtctccaggtgcctctgtctctgttatcttgcccactgaagggagagcacttaagccaatttgcaggagaccacagtttgccagaggtcagagacagaaatcaccactgcattttgtttaaagaatcacatcagaaaagaaaataaaggacagggagggaaaagaagggaaacctaataaacacgccggtcctaaagtttgattccaagatttatgacagaatcaggcaaaactaaattaaaataatatctgtgaaaactggacaacctgaacataagttgatttttccagagaccaaagaacaaatcattgcacaaacacataccttttcaaactgaaaatgattccagagttaacttcatggacctaaatatgaatattaacatctcacaaatactatttgtaattttatccttgagcagtatagtggagaggtgacttctaagcaaattattagtaggaagtaaggttaagtgggcatattccatttttacatcctttcttctccatttatttacttcctatatgtttaggggcttccaccacccttatcctctgaaataacactagagcttttgccatttcctccacccaaagcttctcagatgttggaccagcaaggcgatcaagtttgttgtttgtttgtttatttgtttgtttgtttgtttgagactgggtctcactgtcacccaggttggagtcagagtggctgcgta

SEQ ID NO: 2432 - DNA, 639 bp, Homo sapiens
gaattcggcacgagtattaagtcaaattgctgtattctacgtgttagagtgagttcaaaagatccattgtattactgaataggcaaaagttttaatttcagaggatgaaactgatatattactgccaccttgtggatattctgttattacaggctattataaaargcaatgcgggtatgtaatctgttctaacaagaagcatttcctttttttgtcgtttttattattgttattattacattttaagttctgagatacatgtacagaacgtggaggtttgttacataggtatacacatgccatggtggtttactgcacccatcaacccatcatctacattaggtatttctcctaatgctatccctcccccagcctcccaccccttgacaggccccggtatgtgatgttcccctccctgtgtccatgtgttctcattgttcaactcaaaagaaaaacagaagcattttctgctttcccaatttcttaaatacaatgcaactttatgtttaatttaactaacttaattttttgagacaaggtctagctctgttgcccaggctggagtggcgtggcgtgaatatggttcagtgaaacctccacctccctggctcaagtgatcctccttcctcagcctctcga

SEQ ID NO: 2433 - DNA, 1551 bp, Homo sapiens
  misc_feature (420)..(420): n equals a,t,g, or c
  misc_feature (1017)..(1017): n equals a,t,g, or c
  misc_feature (1408)..(1408): n equals a,t,g, or c
  misc_feature (1423)..(1423): n equals a,t,g, or c
aggctggactaagcatagagaaccaggagagaaagaaagatttaagagactgagtaatattttttgacagatcatttaagaaactgagtaattttttttttctccaaaagggcatgggttttttttttgttttgttttttctctatttggcactttctagggattggtctataaattttttgaaagatcataggataaatttctttgtagcaacttcctattttagtgtttatgttaggggarccccargtgtccctgctgatacgccattagggccacttctcagcctctggctacatcataatgcttttttttctatcttgccaaagtttccmgaaaattkakgttttctaattttaaaaaaattggttgtggagatgggatgggacctctttataagccctgaaaataagtgatttnttttaagtgctattctgctataaacctgattctcacttttttctgtagacaacagttttttataatatatctattttgtgtggacattatttccttttaaccaatactgaaattccatagtgtawactttctccacattttctttgattaatacttycttaaaatagacacttggattggcaccagctgtcaccaataaagctgccctgaacattgtcaatcaatcctgttaaccaatttgagaatttttctggaatgcttagttagggatgaaattgctgggttataggtatgagtatgcttgatatacttttctccagaatgtctacacctgtgtgtacaccacatctccagagataggggaatcttatgtccctgctaactgctctcgttatttaattttctgacatttgccgccgccgccgccccctgcccccaacacacacatggtataaagtggtagtttcttgttttaaattgaacttttgaatgatttgaatttgggcatttctttgtatcctgagttattttggtttcccgttatgtgaatatccttttcctatgctttaactacttttctaatttgtcccttttttnggttatcaaattccaggccattgtctattccatcgtcacttttgggtattggaaacatctttccattctgtagcctgtctgttgaacataaatcttgatttttatgtaatcagatttttctccttacggttatgttcttggaattttatttaagaaatctttttctatcctgagaccacaaaaatgtccccaccattttcttctgtttcatagttttgccttgtatgtttaatcctttaaggcatgtgtagttcattttatatggtgtgaaatagttcttattcatttattcaacacatattggtggagtgcctgctgatggtagtactcttcagagtactttgtatatatttgtgaacacatattcttgccctggaagcttatgttgtcnttcaaggtagatccntactcggtttccacctgttttcttcagccctcaggatgaattccacaattttacacatagcaccagttaaggaataggctttattggagaaaaggaaggcttattagaccagcatcagcaaaaaaaaa

SEQ ID NO: 2434 - DNA, 809 bp, Homo sapiens
  misc_feature (564)..(564): n equals a,t,g, or c
cattaattggctctatgaacaggagaaaaatgcccacatttcctaaatcccagaatgtgctgccgttcttatctatgctactatcagcaactttatggtctcagtcacctctctgtgacacattaatcaaagacaaagcaaaaagccagtcagacaagagaaccagggatgaaaaattgggtaaaattgaattttaaaaaatatgagtctaattctgtggctgtacccataagacgcaaaatggaatgatcagacactgatcctctcgatgtgattgttgtgatcagtcaaatccaacatagtcctttggaatgtgaccatgaccagctwgcaacacctggttcagtcaggtacaaaagaagtcytcttcmaaggtttggcttgtttcagcgtccttgtttttgtccctacttgaaggccaaactaacttccttatcctttgtgcctccctgtttcagtttcagaaacacctttcctgcccatcctwatctacacggcccatatctgctacacactctgtaaattacccttcctgtcataacggtcttcccaacaaaactgccntatctgccagtgtaaccacattcctgcaccattcaagttaaccaatcaggttcagcttagattttgtggtccaactccagccagtggaggtaagacacagtagcagggacaagccgcattagggataaaaaccccttccctccttcattcagtgtgctcttatggtgaccaaacttgtgagcagcacccttttgcagaaataacttttgccttgctgagaaatcctttgtttaagtgctcatttt

SEQ ID NO: 2435 - DNA, 532 bp, Homo sapiens
atggctgctttcaacccgaacgcgtccatccttcaagatcaagacccattccatagttcaacaagtagttggtgatgatagagtgccctgactgggccagaacagcctctttagccaaacagcgcaggaaagtctttaaacagatgctcagctcctttcttcattttcactttaattccatgatgcctctgtgtccctctgacgacatctctcctggggtctgggactctgctggtcttccatgcctactgagaaggcttcctggccatcatcaggcaggaaaacctcaaagccctccgtcctcaacgtgggatccctgggccagcagcatcagcctcaccaggaaacctgttcttctgctcattcttgggccccaccccaggcctattcaaagaaagactccaggggcagcgcttggcagcctgtgtttccaccagatctgtgtgaaaactcaaatgaaccagcccaggtgatgtgacgcaggaagtgcaaggctgagagccagtgtctaaggcaacctcgtgccgaattc

SEQ ID NO: 2436 - DNA, 2290 bp, Homo sapiens
  misc_feature (146)..(146): n equals a,t,g, or c
  misc_feature (525)..(525): n equals a,t,g, or c
  misc_feature (2196)..(2196): n equals a,t,g, or c
  misc_feature (2254)..(2254): n equals a,t,g, or c
  misc_feature (2256)..(2256): n equals a,t,g, or c
  misc_feature (2274)..(2274): n equals a,t,g, or c
ggaggaatgggaagcccgctaagagaacagaagtcaaaaacagttgggttctagatgggaggaggtgtgcgtgcacatgtatgtttgtgtttcaggtcttggaatctcagcaggtcagtcacattgcagtgtgtcgcttcacctgnctccctcttttaaagattttccttccctctttccaactccctgggtcctggatcctccaacagtgtcagggttagatgccttttatgggccacttgcattagtgtcctgatagaggcttaatcactgctcagaaactgccttctgcccactggaaagggaggcaggggaaatacatgattctaattaatggtccaggcagagaggacactcagaatttcaggactgaagagtatacatgtgtgtgatggtaaatgggcaaaaatcatcccttggcttctcatgcataatgcatgggcacacagactcaaaccctctctcacacacatacacatatacattgttattccacacacaaggcataatcccagtgtccagtgncacatgcatacacgcacacattcccttcctaggccactgtattgctttcctagggcatcttcttataagacaccagtcgtataagggagcccaccccactcatctgagcttatcaaccaattacattaggaaagactgtatttcctagtaaggtcacattcagtagtactgagggttgggacttcaacacagctttttgggggatcataattcaacccatgacagccactgagattattatatctccagagaataaatgtgtggagttaaaaggaagatacatgtggtacaaggggtggtaaggcaagggtaaaaggggagggaggggattgaactagacacacacagacacatgagcaggactttggggagtgtgttttatatctgtcagatgcctagaacagcacctgaaatatgggactcaatcattttagtccccttctttctataagtgtgtgtgtgyggatatgtgtgctagatgttcttgctgtgttaggaggtgataaacatttgtccatgttatataggtggaaagggtcagactactaaattgtgaagacatcatctgtctgcatttattgagaatgtgaatatgaaacaagctgcaagtattctataaatgttcactgttattagatattgtatgtctttgtgtccttttattcatgaattcttgcacattatgaagaaagagtccatgtggtcagtgtcttacccggtgtagggtaaatgcacctgatagcaataacttaagcacacctttataatgaccctatatggcagatgctcctgaatgtgtgtttcgagctagaaaatccgggagtggccaatcggagattcgtttcttatctataatagacatctgagcccctggcccatcccatgaaacccaggctgtagagaggattgaggccttaagttttgggttaaatgacagttgccaggtgtcgctcattagggaaaggggttaagtgaaaatgctgtataaactgcatgatgtttgcaggcagttgtggttttcctgcccagcctgccaccaccgggccatgcggatatgttgtccagcccaacaccacaggaccatttctgtatgtaagacaattctatccagcccgccacctctggactccctcccctgtatgtaagccctcaataaaaccccacgtctcttttgctggctctgggtctctttggcgtcttgaaccttatgccttccctattgaagttaataggggttcagcacaacactgggtcccaggcatgcagccttgtctttttatgtttgtcctcatgggcatcatgtgggccacagggatcttacccaaaatcatgcctagcaggaagagatgcctctctattgatattccagctgccccacaagcaggtatgtgcctactcattctctgacatgtgtcctaggtttcttgactgtaamattccgcttaataaataatgtattgagcacctgctatatccagagctctgctgggcactctggaagattagagtttgaagaacacacaatcgttgtcctccagaagttcatggtccagtagggagagaaggtcacaaacagccakaatctacaagatgagaggggctatwaaagagagctgagaagagtttcagagccactgagaagatactcattttagtcttggtaacgggaanctttctggagttggtggcatttaagatgaaccacaaatggagcaggaatttaatgaanangaaaggaccaggacgtcnaatagaggacacagca

SEQ ID NO: 2437 - DNA, 514 bp, Homo sapiens
  misc_feature (507)..(507): n equals a,t,g, or c
aggcagacgtagaactagtggatccccmgggctgcaggaattcggcacgagccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagtaaaaaaaaaaaaaaaaaacaaaanaaaaaaa

SEQ ID NO: 2438 - DNA, 523 bp, Homo sapiens
cacagcaaagcaagttctaagagccaagcttcagaccaatcccccaccgtgaagtcccccgtgcgagtgccccttgaaggaggttttctaacaggtgagtggtctgattctgtctctgtcctgtgggatggatgggctggcacttgatggctctccttccccctcacccyccacggagaaggctggaaggtgcatttctcagacttccttgcctgggaaatgggaagtgatgcagaggatcccaacgtctcctcggcaggcttggtggtggacgtgctgggccatgttccaggggccagctgctggctccgtgggtgctgagaggaagggggaaggctgtctattttttggccaggatgaatccagcagatgtggtaggtcctggccgcttgctgacccgtgggtctaccgggtgctccggagctaatggtccccagatgctccaccgtcctgatgtggcagaggcatggcattttggcgggccagtttggtggcatcctgggaaccgttttggaggctcgag

SEQ ID NO: 2439 - DNA, 995 bp, Homo sapiens
  misc_feature (801)..(801): n equals a,t,g, or c
  misc_feature (834)..(834): n equals a,t,g, or c
  misc_feature (992)..(992): n equals a,t,g, or c
attatgaattcggacgcagaggtgacagtgggagctggcctgggccaggacggcaggtggccctggagatgggaaagtgtctgtgtcgaggcgctgagctctctctctgtttctccttttttcctctactccttccccttcacacccccgtggctggaaggaacctcggcttccctgaaagcttgggggtcccacccttcttaccccacccgggaggaacgcccagggccccgggcttgtttctcctcttgttttccttttgggcagtttgatcactgatcgagtaaggaatgacctttagattgtgcgacttttgtttttgtttttttaaatttttttaaaccaagaatgatttctcctgcttccttctcctcaccatcttcccagacggagttcaaaggccacttctcaagcagcttttggcaccttcagcctcagagtggaatcttttaaagacaggacccctatgtccaggaaaggggaaaaggaactttgccaatgatagtgaccacagcaaaagcaaataataataatattaataataataaagagaaataaaataataaaataaaaaacaatagcacagcccttgttgaggtcagcagggaggaggggctgcccggagttgggtccttgcctggattttgacacagcaacttcctgtagtgagcactttgtatgaatcgtggacttcctgttctcaaggcgcaggtatttattctgtatctgtctagagcacacaccaaaatccaaccttctaataaacatgatggcgcagtcccactccctgcctcgcctgtncccctatcccccccaggcctgggatcttcaggngtcggtgtggggaggggcccctgccctccttgccttgattttgctcccctgggtccagctggttccaggcctgtgaatgtcagttcgtcgggcactgactccgtctgctcttgggccttggggtcatttgacaaatatttgcccaagggctcccaagncca

SEQ ID NO: 2440 - DNA, 644 bp, Homo sapiens
tcgagttttttttttttttttatttattattttactttaagttctgggatacatgtgctgaatgtgcaggtttgttacataggtatacatgtgccatggtggtttgctgcacctatcaacccgtcatctaggttttatgccccgcatgcattaggtatttgtcctaatgctctcccgcccctttcccactaacaccctcctgagtttatgaatccttgcagatatgttttatgtatatgatcatagtatgtatgtagacacacacacacacacacacgttccctctctctacacaaatggtaacatactaaagatactcttctgtaccttcacagtacaagtaccatattccccacttagcacttggcaaaggccaaagccagttaagggcagggtgagcacttggcctccaagctctatgtccagtgctcgctccccacagggcccctaactcacccacagaagcggactcagccccaggctacgtctaacaaccacacacaaaagcagcaagaaatggcccatgctgccttctgggcaggacattccatcctgcagaaggaacctttaggctcactccgccacctgggaagccaggctgccaggggatggggcaggcggttggactcactcgtgccgaattc

SEQ ID NO: 2441 - DNA, 517 bp, Homo sapiens
gcacgagtagaagcatgttcttcacttcaagacccaggaccccatggacatcctgcctacagatcgccccactagccctgcttcagtcactgggcatctggcagcactcgataggtgccatgtggtactgcctgctctgtgggtgcagctgccatgccaaggccgtcccctctgtcctctccaggctctcctgtaacctcccagctctgctctcccatgccctccctcaacccagcccttccgtgggggctcctcctggctctccccggcctgtccctccacaccccctttcagaccctcacagctgcctccccacaccagccttcaggggactctgcagcccacctctctgcccactccttcctcctagattctcactgaagcttcccccgctctccctagacccgcagctcatacccccggctacttattagaatgcctggcaagcttggataaaaccccatactcagccacacccaggcccattaaaccagacacctagagttggcctggaagc

SEQ ID NO: 2442 - DNA, 655 bp, Homo sapiens
ggcagagctggtctcgaactcctgacctcaggtgatctgcccaccttggcctcccaaagtgctgggattacaggcataagccattgcgctcggctgagattagcaataattaatgtgatatgaaaatattttctttttcttcatgacaaattcatggctaatactgccaggatttttttgttgttgcccatattcataatagaaggaaatgctaatatgaaaataaagatgtcactttttccccaatccatgcaatttccccctaaattgtatccatgacctacctgagggggatccatggactctcaggttaagacccctctactgaagggtagcagagtacagtttcaaaattactgattaagagcgtgggctcaccaggagttcaagcccagccggggcaacaggatgagacctcatctttacaaaaaatgaacaaaattaggcatggtggtgcttgtctgcagtcccagctacttgggagactgagttgagaggatcacttgaggctgagaggttgagggtgcagttgagctgagattgcaccactgcactccagcctgagtgacagagtgagatcctgactcaaaaaaaaaaaaaaaaaaaaagaaaaaaaaaaaaaaaaaaaagaaaaaaaaaaaaaaaaaaactcgta

SEQ ID NO: 2443 - DNA, 1102 bp, Homo sapiens
ggcacgagtttttatgctggttggtctcttgcagggaggtggtgctgtccagagagtatcagctgtggtagtatagagaggaacaggtggtggatggggccctagaactcccaggagtatatgccctttgtcttcagttaccagggtaggtagggaaggctgttgggtcagggcagggctaggcatgtctgagctcagactcttcttgggcaggtcttgctgtggctgctgtgggggatgggggtgaggttcccaggtcaatggtgttatgttcctaggaagtttatgtttttctctcctgtgtcatgcaggttgtcagggaagtgggggaaagccagcagtcacaggcctcacccagctcccacataatccaaagggctggtttcactcccaccatgccccccgaccccaatagcaccgagtctgttttaggcagtggacaagcagggctgagaacttgccccaggctacctgcctcccagctgtgaaagcaagtttggctttccttcttcccctgcctgtagagtctgcacactggattcaggccctcccccaagttctggccaggagacttctcgattagttcaaattgttgccaagttcagctggagatttccttctcctgtggcctttcccagtgcctctggccaccctaccgaaggacaatgtgaggccaggcagaaatagtttgctaggggacccagagagctcacagggcttttcctctacccctgtattttgaggggtaaaggaaaatctgctgtttcctctacccctgtattttgcttggttctctcaatttactcagctccaggtaagatcagcatcatctcccgtaatctagaccttcagtttccttagtggggtgtgtgttcaggagcagacgatctccctttcccacttccacggtttgggcactcacagtatttggatcatctcctgggtccagcaggagcaatctgcttccttcagaaggtctgtgggtcccccccggcttcctgatttattcctgccgtcattgaagacagaggcgacttcctccttggaaactttaggcgccactgctcagtccgaaaaagcccattccattttctactaattg

SEQ ID NO: 2444 - DNA, 1467 bp, Homo sapiens
gaattcggcacgagcagagcaagactccaactcaaaaaaaataaaaagaaagaaagaaacatccctggcaccctgctctccatcatgtctgtgtgtttaccgctgcacctccctttcctgatgctagcaaaggtagccaccagcttttgcagatggcagctcacactatttgtgtccactttttacaaagatgccctggttcatactgtcaatgacagaaatcaggaagcagaattggaagcactcaaaaagtcctgttgacagtgcacatcccctcatgccctggaatatcacacagagagctttgcagtgagctggaaagtcctccagactcaaggccgggcctgggsccacaacagactttgacagccctgcagtyccgggctcaccagggaarggagccaggagttcagcccccgcagcggcccctgctcacagcacaggcaaaagccacagccacacaggatggggcctccctacttcagcccaattgtgatttcctgccttgcaaatcatctctcttgaagctcttcagctcctcttcatttcttacaccagcaccagcagctggccttcttcttgagccaattcccagaaagcaatargctgagtgtcactttttcagggttgctgagagctgcccatggggggaggcgggacaatagcagcagcrgggttacccagcaamscaactccctcccaagcaccagccctgtggcaggtggacttcaaagttacctccctgaggaaagcacaaatcatgtgctggacctttgacatcctccccgagggtcacacactgacaattacactctgggtataggatccaccccgctgggactggctaggcaccctgcagaatcccaagagggccctgccgacagctaggacccgccaagcccattagacctcctagcaccttccactgtccctgtttcctttggtttttgttgtgttttttgttttgtagagataagtatcacttggtcgcccaggctggagtgcagtggtacaatcatggtacactgcaacctcaaactcctgggctcaagtgatcctccacctcggcctcccaaaatgctgagattacaggcaccatgcctgggtcatatttttttttttttgagatgatgtttcactctcgttgcccaggctggagtacaatggcgcgatctcggctcactgcaacctctgcctcccgggttcaagcgattcgcctgcctcagcctcccaagtagctgggattacaggcacccaccaccatgcctggttattttttgtatttttagtagagacatagtttcaccatgttggctgggctggtcttgaactcctgacctcaggtgatctacccaccctttagcccccaaagtgctgggattacaggtgtgagccactgtgcccagccaatttaaaaaaatttttttaagagatagggtctcactatgttgcccaggctggtctcga

SEQ ID NO: 2445 - DNA, 649 bp, Homo sapiens
  misc_feature (527)..(527): n equals a,t,g, or c
  misc_feature (647)..(648): n equals a,t,g, or c
gaattcggcacgagcactttaagcactattcattttccctaatttyttccactcaccgggaattattcattgttctccttcactcccttgctcagacatgtktcccatgtcaccccaggggaggctgtyatgtcacaagatgttgttactgatgatcttggaattwtttccctgcccccagcctgggactaatgtaattattatttcaatgtgctttttcttaagccatagcaatgcaatttatcttcaacattatcatttttaaacatctgttaattattaacaatttactgctyctycttgcacaaaatgctattccagtaacatttattaattaagttatgtwcacataccaaagattttacaggcttgtaaaatagcaggccattycaaggatttctctcttggtaragamatttgtwgggaaagagttatataatcactaaattacattcatatcaagaacacttttcctgagtgaaattagtctaggtttgcttaagtgtctcttttttatttaactaagnaaatatcatgccatatctgtcttatattgctattatctctcccttccgaggaccacatcttctgttacaagagggagactgtgcttcaagggagtagaagagatggtttcagtatatttnna

SEQ ID NO: 2446 - DNA, 692 bp, Homo sapiens
ggcacgagctaaaagagctagtttgagtaagctgtgtaagacagctgctgctaaatagaaccaaattcacctgcctatggccggccacccagtgttctttctgctcatccacctactgcccttagacttcagcatgggctggacccagaccccaggatctaacaactggcgacgaggatggaaggaggtgagtgggtcttcagcccctgagggctcccgggacggctacgtggccgcagcatgagctgtggtacccggtcgcagtggtgctgcttggatgagccccagtggaaacatgggaggcagtgtacagatcccctatgagtgtggagaaggcgctgaatcacctggaaatgcacagcattgaaaggaacatacctttgccagcagagtcagatgggcatttgcgactatgctgagggaaatgaatgcccaatccctgcaggatgcagcgcagggaggaggaacctccgttgcaggcttgcccggtagtccgtcagaaaatagagcatgaacagctgttgggccccaagaggaggcccagagaccccccatcgtggtggaacacatttcctatggtgcctgtgtccccgctgaattgagggagttaagcaactaatgtcgccagttgtgtacagacttagtgcaagtcattcgggagaaggacatttgcgcaacctagtcctactcga

SEQ ID NO: 2447 - DNA, 979 bp, Homo sapiens
  misc_feature (751)..(751): n equals a,t,g, or c
  misc_feature (858)..(858): n equals a,t,g, or c
  misc_feature (885)..(885): n equals a,t,g, or c
agtttctttgcctttccttgtaaattttagaataaccttgtctatatctacagatcttgctgggattttgataagaattgcattgatcctttataccaatttgaggaggatttatgtactttttgtcgagtcttttaatccatgaacatgttatatctgttatatttagcattttgattttttcctcagtgttgcatagttttcagtatacaaatcctgtaccctttttttttagatttacacctagtactttattttttgagcaattgtaaatggtattgtattttaaatttcattgcccatgtgttccattgctaatatactgaaataarattggcttttgtatgtttatcttgtatcccacaatcttgctgaactcmcttgttctaaractttttgtarattacggggaatttcyacataracagttatgtcatctgcaaatggggatagttttgttttttcctttacaaactgtatactttttttatctgtttcttgctttattgcgagaacttctagagctgtgttgagtaatagtggatatctttgccttgttcatgttcttatagggaaagcattcagtctttcaccatttagtataatgttagctgtagggactttttagatccctttaccagattgatgaaagttcctctctattcccatttttctgagaggctttttaaaaaaagaatgaatgggtgttcgattttgtcaaatgcatttctgtgtcagttgctatgaacangtgtttttcttatttagcctgttaatatggtagattacattgattggctttctgatcttgagtcagcattgcatccttggaataaactccacctgggtgtggagaanaaatcttttttttttttttttttttangagatggagtctcgctctgtcacccaggctggagtgcagtggtgtgattgtggctcacggcaagttcctcctcctgggttcccatcattctcaa

SEQ ID NO: 2448 - DNA, 1199 bp, Homo sapiens
  misc_feature (469)..(469): n equals a,t,g, or c
  misc_feature (582)..(582): n equals a,t,g, or c
  misc_feature (630)..(630): n equals a,t,g, or c
gaatggcacgagcaatggctctgttagtcctgactctgtattgcattctttttttaaaaatctacatgcctgtcccatctcactgtgagcaattcaaaggcaggaattaagtcttattaatttctctcttccgttgcccagcatagtgaccagaacagagctcaataaaatgtgttgaatagataaatgggctgttaagagaaaaactttagcagaattaaatttaaaggagtttaattgagcaatgaatgattcacggatcaggcagcccccagaattactgcarattcagagaggctccagggtacctcatggtcagaacaaaaaaagggaagtgacgtacagaaatcagaggtgaggtgcaraaacagctggattggttacagcttggcatttgtgttatttgaacacagtctgaacactcagcactgtatgaatggttgaagtgtggctgctgaaattggctganactcagctattgttacaggctgtaatcctaaattagggtttcaatcttgtctgcacactaaggtaggttgcagttcgtccacaaggacttaaatacagaagtatggagtcctnctcaggccatatttagtttgctttaacaaggcatagcagtgataagtnccagagagaggtggtcagcacgattcatcactgtcctcagacaagaagaggatgaggagggatgagccatttgtgcctattttgkacctttttggcaaagtcatgattacttagtcatgtwacatgtaacttagcatgacccatgggtacagaaactaggtttaatttttttatccaacagtgamgttttccatacttcactcaagtacttagtaattgctgtagctttgcttcattgcagcggcttcatagatcatggctgttgttcatcgcttgtggcgtgcctgggaaatcaatagctaaaaaygttttgtgaacccttagtagttgttacctgggtaggtttggaatgttccaggagaattaatgaacamtcaggtgatmgttttgtcattttacagggaataataagcaaatgcgtgtttggaagtgtgattctatcaaatctgtttataaataagtgcatatttgccatttaaagtaatttttttatctgtgacttgggcttcatgggattagctataatgacacgtctgggagtctcctcacaattagaatgaaatcctcga

SEQ ID NO: 2449 - DNA, 773 bp, Homo sapiens
gaattcggcacgaggaccaggcccctgcgatgctcccaaagcctcagctgtccgtcctcacactcactgtggcgctcagcytcatcccaggaacctgactgcctgtctccccaggcgaaggcttcatgagcaaagccactgcagcatcgcacggtgtatctctgagcacagctgacttgacagaaggactcaactgtccacattaccgargactgaggtatacggaatggtttctgttttgcttcttcaaggaggggaactgaaacccaactaaatccaaggtgcctcttccaacgcctgtaactaaacttcaagcatcacagccccaacacctgctgatggcaccattttaactgaggtccatcccgcaagcttcccgactgtccacactggctctctctactcctgtgcaccaaagaracaagccagaataaatggataaaagacagtgtatgcgcatgcctgtcccagctacccaggaggctgaggcatgagaaccgcttgaacccgggaggcagaggttgcagtgagccgagacggcgccactgcactccagcctgggagacagagcgagactctaaaaaataaataaataaattaaataaataaataaataaaattaaaaagatagtgtaggctacaaacctcaggaagaaaataccagcatgacttcagaatagtcagammtaatggtgtataaagttctcccggctcctctccacccacctccatcaatcccaccctatctctaacccccaagttctctgttcctc

SEQ ID NO: 2450 - DNA, 733 bp, Homo sapiens
gaattcggcacgagctggcttgcagcagaactggttttttggccctgagtcaatgttcatttccccacaccaccttaacagggtttcctggccaaagagcagggatggagatgatgatggtggtgatggggtgtgtgcaaggcccgggagagggttgtagtgggaagatggggaagaagccacgcccctggccactagtttcttattcgattactcatctgtagagaaatttgagacgcatcacctgacccatccgtcaattcgcatctggcatctaaaagcaccagagtcagtgctggggaaaacactatttaaaaaaattcccagtttaacctcattaagcctctgttttcccatttgtaaactacagacagactggagacttgtaagagataaatctaattctttcatagacattaatgatccttgaaaaaggatcatttgagggacatggagattggtttctactgtttctgttgttactaacactcctcctttcccaaggcctttagaaaggggtgagctctccatcacagaaagtattcagataggcttccaggaattttttgggaaaatgttcctgctttgagtaagacacaggactagatcagcgtttggcaaactatggctcgtgggctaaattccgcccctctcctgtgtttgaagataaagtggaacacagccacgtttactcgttgacagagtctacggttgctttggcacacagactcga

SEQ ID NO: 2451 - DNA, 531 bp, Homo sapiens
  misc_feature (506)..(506): n equals a,t,g, or c
  misc_feature (520)..(520): n equals a,t,g, or c
tggcggcccgctctaggaactagtggaatcccccgggctggcaggaattcggcacgagacttccacaaactcttcattgtctactgacaaccttacttctatctttactgagaccaaaaaaaaaaatcagatgagttatgcccatcacgtcaccgtattcccaaactacctgcctctgtgcacaccacctcactgcctgctgcagttactgtccagggccagcgcctctgcccatgtactggagcctgtccctccacccttttcaagcatgttactctatcaaataaatatccctttctcttttgcattatcagttttgctatctctctgttggccccaccagcactattacccatgctatattagcttttaaaaaattctctcaatctcacatttatctccaacgtttacatcattcttttgctgcactttgtagaaaaatattttgaattttctgtatctatttctacttccttacttcccatgttttcttgaactcactcgangggggggccggganccaattcggcc

SEQ ID NO: 2452 - DNA, 852 bp, Homo sapiens
gaattcggcacgagtgaactgcatgtccatttatcttaagccaacacctctacttatgtactagatcccattctttcttctcccctttctctcttgtattagcaacatttccttcttttactgtaccgtataaagatgctatattttctcccatctttaaaaaagaaaaagtctcttttaaccctatatctccctccagctactaactgtatwkctctcttgtgctttaaagaaaaaaaaatgtgtgtgtgtgtgttttctttttgtttgttttgtttgtttgtttttggtatggtcttaacggtcttgctttgtcacccagggtggagtgcagttgtgtgattgtggctcactgcagcctcagtctcctgggttcaccgggctcaagtgatcctctcacctcagctcctgaataccttggaatacaggcatgtgctgccatgcctggctagagaaacgttcttgaaacgtttcatatacttaatatttttaattccttgccttccattctttcttgaatccactccaatcagatttttattcttgccattcttctaaaactactcctatgaaggttatctgtggccttcatttttgtatgtttactccaagaaaattgttgtgataaattaccccagaatgtagaggtgtaaaacaactatttattacgctcatgagttttgtgcattagaaattcagacaagacacagcaggagcagcttctctgttccacagtatctggagccttggcttgaagatcaaagcctaggggcttaattgtcagaaatgatcgtgtgtatgtctgggagttgataccagcgtttgtctgggaacctcagttcctttcctgcg

SEQ ID NO: 2453 - DNA, 1847 bp, Homo sapiens
  misc_feature (1279)..(1279): n equals a,t,g, or c
gactccttagctaagcatacaaggtaactggccctgccttgctgttttgcctcacctgctaacgtgcacatgctctgccacgtgtacctgctgctagtgggacatgctgamttctcagtgggcctcatgggccagaggaagttgcgttgttccataaactcagctctcagaagtgctgtttcctctgcctggaattcgtctatctgcttcaatagctgaatgctgcttatccctcaagactcaattctggtggcacctcagttctgacccttccccagtctctctttcccttctccccacaggctgtctccccttgatattttgcctgcttgctacccatgtccttttctcctggtgacagtgctacagcctttccttggggaatcaaccttgtctgagagtggacagaaattatccacccctccatccagggatgaaccaatgacctggccaatcacagtcgctgtgattggtcctgggacaggcaggagactcaagctaggccacagagcatcagtgctgagactgaaactactgggaaaacaatatgctctttctgcctgaggcgcctagtggatacaatggaagccttgaggcagctgatcatctttgccttgagagaggtggctgcctaagaaggaagccaattgagaaaaagcaggcagagaaaaaaaacaggaacagatacaacaggcaagactcagctgatttctcatgtcagcaaatacaagagaaggagactggtcaagatagagatgtctgatgatactgagctcccgactccagccactcctgaagtcattcctaagcctctcgttacacaagccaatacatgatcttgktagattaaaaatagtttgactttggtgttgccacttgccgtagaaagcatycacgatgatacactctyccgtgtgctyccacaccctaatttaacctyctycatagcactgactcggaggccctatgagactgkgaactctytgagggcaggaaatgtatcttattcgtctccaaggccacgagacttggtgtatgatagatattcaatacaggtttgtgaaataaaaaatgaaggaatgtttatctagaaattaatgaagcttttcatttacttttttacttcagggcctttctgccaagaactcttaagatgccttaggatcttggttgcagccaggtggctgtcctccccagagcccttgttgtcagtcctctgaagtcattggwcctggagataacagggagggcaggtcccgactgctgagaaagtccaggnccccggatcctaccattaccatgctacctgttcacttgggcttcacccaaggccacactcatctccgtaccccttcccaacagtggtgaggggcaggagcacctggacatcaagaatcgagtgcatgcctgaacctgtccattacccatgcttctgcagctttgctcatgctttcccctccctgaaacgctcttcccttgtctacttaattattcaaagctcagaggaaaaaaaatcacctgctccaaaacgtcttccccgaaccctgcagggaaccaaattcaaaagccatcagaaggccgaggcgggcggatcacttgaggttaggagttcgagatcggcctggccaacatggtgaaaccctgtctctactaaaaatacaaaaattagccaggcatggtggcaggtgcctgtaatcctagcaactctggaggtgacgcaggagaactgtttgaacccaggaggcagaggttgcagtgaactcagattgcaccactgcactctagcctgggaaacagagcaagactaggttaaaaaaaaaaaaaaaaaaaaaaaaaaaaaactcgag

SEQ ID NO: 2454 - DNA, 748 bp, Homo sapiens
ggtgagctgtgatcgtgccactgcactccagcttgggtgacagagcaagaccccggaccctgtctcaaaaaaaaaattccccagttctcagggtgtggtagaggccgagtcagtcatggctgagacaaggggactgtgctctgtgtgcttctgtgccctgtgtttatatggttcatacgctgcctgtccaccatgtttttcccgagagcctcggcagcgcaggcatcatgggaatgactgggtcaggtggaaattcagaggccctgccctggtgggcagagaagcctggcttacctcccaagcacagcatgtgtgtggatcacttctgtgcactgtctcctcatctccaaaatgggagtcataactgaactcacctcatcaagttgttatgagatgatgtagattcagcgaagtagcaagagtaggagtttgggctttgataacagagagaagtgagtttccatctagattctccccctgtgtcacttttggcagttggcttcacctctgtgggcctctgttatgtcatctgtaaaatgggattaaccctaaaagccaccctcacagggtcattgtgaggattgcacaaggtgatgcaagtggcacagggtctggcccaggagagggggctggaagagagcgagctgccattgtattttggttgctgtggatctaaggagaagagatgtttaggagtctttccctggcatggttcctcctgccttcacccatcactcttttcctcgag

SEQ ID NO: 2455 - DNA, 737 bp, Homo sapiens
  misc_feature (1)..(1): n equals a,t,g, or c
  misc_feature (737)..(737): n equals a,t,g, or c
naaccagatgtttttccacacagaatgctagttctttaagacacaggctgggtgacatgtttccttagagtgacaatatttccttatagtgacattttccttgactggctccatgcagaataggaggatatagaataggaggagaaggtttctgctgtggcacctggagtggtacttggtgcacgccaggtgctagacaatgtgtgtgacaaggatgcacgtgaaatgcccccccccgagtgcctcagtgactgcagtaaagtggcccttgtcatggtcctcttcctctttctgcattcagtcttcatgctgggcggcatgaagagagaaacaaaaaccacctttcttgccagggtcttagtaccattttgctgctcttatctttcaagtaagggagaacatctaagaaacttatcaccgtattcattctagactgttagggatttaactcttcacctacttccctgagtggtctgggctggaggttcagagctaagtgggctgggtgtaaatcaggattccgtccctcactagctgtgaggctgtgggtaattcacttcatctctctgagccttcattttctcacctgaaaattgggcatgctaatacttttccatctccttcccagggttcacaggattaaatgaaattattaacacaaagttcttggcctggtagggggcatgtacgtggccaccgtcctggtgctggacactggggtaagagtttggaagctn

SEQ ID NO: 2456 - DNA, 881 bp, Homo sapiens
ggcagagcccagctgtttcttacacagtgacatcccaggtgccctggggtttgggactcctggcaggagagaagagaatgaaccaacccattctgagaagtcaggcattgttatggccctggagatgggtggtgaaggcaaaaccatgtgtgtgtgtgtctatggatgcctggattcctgaccgcagtcagcattgcccatcaattccaggtcaaaagaaggaaagggctgggtcccatggtcaccaagcccttgccgytctgctcttcttgtgaaagtgaccttcagagtttcatcagctgatagcagacagccagattgccctctagtaaagcctagtttaagatcagtttcaggaattttctgggtgtttttatctttgcagtgaagccataaaagccctcatagcagctgggcargctgcaaagttgatgcttccgagtggctcattagagtgtaatggcattcctgagagtagatgttgctgcaagcagcaggcaggaagctcatgcggcagcagcctgatggatactccgcgtcaagggggttctggtggatgcgtggcaggcaggcagcggctacactccatgggcggtgctgggttgcgaaaggggctgacagtgctgctctccggcagaggggtgggggcaggtgcatgcacattgcagatgaaaaggtgaggggtctcagtgggtgtgatgggagttagacaacagcactgtttaggaggtggtttaaagctttttctctaatttaaattgggtagtaaattctgaccctaacatgagtattgtatctgatgggattcagtttggggaaaaattcagtcttgaagtctagcaaattccagtttcggtctcaacctttgggtcatctcgtag

SEQ ID NO: 2457 - DNA, 993 bp, Homo sapiens
  misc_feature (474)..(474): n equals a,t,g, or c
  misc_feature (478)..(478): n equals a,t,g, or c
  misc_feature (551)..(551): n equals a,t,g, or c
  misc_feature (581)..(581): n equals a,t,g, or c
ggcacgaggaacaaactagggtagaaggcctggggccggcagactgatcatgtgatgcttagcctatctactattctctctaatcctgctagtagtagatctgccagtgttccatcttagctgatgttactggtgctaggggagtgaccttttgtggctttctagccattagcccctgtaggatagactggtttgtactggtgcagtctgtttaaaaacatgcattcctcatggctcatcagttttgtgtgttaagtctcgccatgcagtggtcttaatcttgttttcaacttgtagctctgccatacctgtctctctaaggagacctaactattgcctacttcccacctgcggccattcatccaccaggcccaagcttatgggtgttgaacaatacagctacttatttttgacatgtgtctttatgtgtgtgtcactccagtggaagtcaacccaaccgtgggtaggagacantacntgtatgaggaaagggatcacaggtacagaagttcacagaactaatgcacttttcacattttggtgctcataangcatttccccctatagatatgatttgaganagaagacactgaaagaatggaggaatagacaccaagttaatargggttcctaactgatgaatttcactcttaggatggctgagccagagaccaccatttcattctttttgctgtgccctgcctgtttcgatggttttccaggattcccaacgtgataagtgtgtcccagtgtgacgttatttaatctattctggcaattcagtgtcagtatccgttttcccttcaaatatttcaccaaagtatttatgccccactactgtatttcattgattgtaagatacacgctggtttttattagcatttctgaagttgaaatgcgtggaacattggtggtgtgtcataatactttaggatttgttacttagtggtacaccaaataatggtaggttgatggtgttttagattgcctcga

SEQ ID NO: 2458 - DNA, 264 bp, Homo sapiens
gtttaatatatgtgcagtggattattaagtatgacattctcttttcttctagagttttgttcagtggcccaaaggctaagattagcagatgctagaacatctatgcaggatattttaaaatggtttagtgactataccttgagggcagatataagtaagtcaagagatttatagggaaaggatttctttgaagattgttgcagatgggccaaatgaaggaagctctcaatagctatccaaaacacctggcatgtttcttctcga

SEQ ID NO: 2459 - DNA, 826 bp, Homo sapiens
ggcacgagaatatatggtcttttgtgattctatttataggaaatgtccagaataggcaaatctacagaaacagaaaactagattggtgatcgcctagagcttggggcagggggtggggagtgggtaatgacttctaatgagtttctttttaaggtgatgaaaatgttgtaaaattgattgtgattattgtactaaaaaccatttaacgtatattaaggtgggttaattgtatggcatgcgatttatatctcaacaaagctgtgagtgtgtgcgcccatgtatggatgtgtatgtgtgtgtatatatctctatacatgtatacatggatgcccatgtgtatctatgtagaatatgtaaaacaaacatgaggtagtttgatatttgagtctggagctacagagagatctaagcccagcgatcaagattcagaaatcagcagtcactgaggttgtagtagctaatgggattgtctaaaggaaatgagaggggaggagaatgggtttccacagacaaccctctttggaaactgaaaagaaatcactagacagaagggaatgaactagagaagactggctaacttggaggtcaagtgtgagcttcattttctgcctgcgaggtgggaaacttatttctaactgattctctgggtttcaacacatcctctgggttctccagggcataggggagtgctgctgtgtcactgtggcagtggggagtggaagactgaataaatattgcaaatggagggaccagccagagggtgcaaaggcctcgggagcatgagggaatgcagctcaccagcagagtttcaagcagttcactatgg

SEQ ID NO: 2460 - DNA, 626 bp, Homo sapiens
  misc_feature (1)..(1): n equals a,t,g, or c
  misc_feature (626)..(626): n equals a,t,g, or c
nttgagacctgcccatcgaatggaattgagcttcgtcaggcgcctacttctctttacattcttcttctccacattcagcccacccccacccaccccatgcttggaaggtcttatgtcctgcctgccttctccactaattaagaaccacggcgggctcccaaaccaaatccctaagggagataggaacgggaatatcagacactcacgtatcaccttcccctgctcaagctccactttgcagccggagtcccacctgggattcatcagatccaaactccatggactagttaggcctgggaaaagaccttagaggtagggaggtctttacagcttaggcaaacattctttgagtacctgctatatgttgaggtgggagacttataaacaagtaagttacactgcagtgtgaaaatgacagtgtagatgataaagctgaagcttaagcgatgctgacacatagacttctgttagctctagggctttttcctgccttaactgacagactttgacaaatcttctaggactgtgtgaggaatgaatatagatgatcgaaaggggaattcttttaagacttgtgaaagaagctacattggagaactgaccttcccatgtactgaggacggccn

SEQ ID NO: 2461 - DNA, 1153 bp, Homo sapiens
  misc_feature (409)..(409): n equals a,t,g, or c
  misc_feature (511)..(511): n equals a,t,g, or c
  misc_feature (1001)..(1001): n equals a,t,g, or c
  misc_feature (1089)..(1089): n equals a,t,g, or c
  misc_feature (1113)..(1113): n equals a,t,g, or c
agactatcctcaaggagcttacatatcagtaaataaattattaaaggtggaaaatgtggtaaaagagacataatgtctcggagagagaacaaatttctgctttaggagtgttcttagttaaggtaacattagcttctataatacgcacactcccaaatctcagtatttcaacatgagtttctctcttgctcatgtaaagactggtcagggacccaggttgacagaggctcttcagtacatagcttccaagattgctgtgggtgtgacatccagccagaaatctggtgaagagagagcaatgrttacacaggaacttttaatggaccaggcctgggacagcgtatgtcacttccaccaacatcccactcaccagaatttsgtcacagggccatagctatctgcagagaangctgggaaatggaacttagctatgtgctcaagaggaaaagtaaaacagttattgaataattagtaataattagcaagtaactacctaggggtcacagagganctctcaggtagaatttagacttaaagatgatgggggagtgtgtggaagagtggtgcagaatagggaaaggggggattgaaggaagaacaagctctagcttcacctgcatgggtagagcccacagtgttggtagggacatgttagctttcaacatcagcttcttaacagtattattctttcatcggaggaaattagtctatttctgaggaaaaaaaaatctgcaatacgtagcaatttacttacttggatattgaatgttaaagcagagagagactttgtcctcaaaaccctcccatttcagaagtgaggagcctggggaggtcatgctctctggatgtcacacagtgagtcactgtcaaagccagaatagaacccagacctctcagtttcccatwccagtgctctttctatgaggaaagtataagtttgagcatttttaaaccttaattatgtagaaataaccatgatattttatcgtaaattatttcantcatctcattttaaattttactccaaactaaaggaaaacggtactgatttaaaacatctatcataattcaatatagcccatatttctnctttaggaaaaatttttttttgtnttttatcctgaagacccgtgccctcttcctgtgtctcatg

SEQ ID NO: 2462 - DNA, 680 bp, Homo sapiens
gaattcggcacgagaaaaaaacaaaaatatgttaatattctgtggagaatattggtatttttgttttaatcttctgtgggttgtggttccatataaattcagttttctgagctttggcagtgttattcagatctgtcccacaagtgttccacccattggtcagtctgggatctgggtgtaggtctactcattatctcagttatcagagtttttattatgccaattggtatcagatgcatacctacacaggttgaggatgagcccagcagttcataaacaacattatggggtcactttcctatggacagagagagaagaaaaaaaacccaaaacaacagagtttgtcctgcccacttggaggcacggctccacaggatggagagaaaggttcccttccttcaaaagttttgttcctggaggctttccattcccagattcttttgttgttgctgctgcccccaccatggatgacctggggactgacacatgagagtatggagttttcccaagctgctgagcacagtggctcacacctgtaatcctagcactttgtggggatgaggcgggargataacttgagcccaggagtttgaggttgtggmgagctgtgattgtgccactgcattctagcctgggcaacagagtgagatcctgtcaaaaaaaaaaaaaaaaaaactcga

SEQ ID NO: 2463 - DNA, 877 bp, Homo sapiens
ggcacgagaacttcataaagatgatttttaaaatgcccagctctgagtgcaggtcctcagctttactcctgaatgtgagcctcgctgagtccgaagccggtcgcaggcctgggaaaccagggtgggctgaggaggcaacgggaggcagaagggccagcaggaaggatgggacccaaggctaggctggggggtcagcagcagacatgggttgaaggggagtgggtcatgggaagggcctgtgcaggatggagcccagcaggggatgggagaggacacaaagccaggcagaaggcggtgatggcagcagagaggagcacccaggggccgccgcttggccacgagtgtaggccacccaggggccgccgcttggccacgagtgtaggcccacggtgcccttcagcacagtgccccagggctcgccagccacccaggaccgagactcgtagtgctggggggctgcagctccttcccatcctttcctgggctgcctctagcccccatctctccaaattagcaggggagctggagcccctaagaccccagcctcacatcatcctcacgcctctgttgggagccatgccctgctgcacccgaatcttctgtttctccctgaccatgggctcctgaagttcgaggcctgtggttgttcctctcttcaacttggttgctgcggtgagtttctgggaggtttgtcttactagattctgtgcttccctccaccatgggaacctggaatctctgttttgctttttagcatgcaggtaatttccagcctttacatctgcctatcagacaaatcctatcttcatacctcaggcagtatcacccccaacgtgtggtctaaatttggacttctgtatgcatgaactcacctcga

SEQ ID NO: 2464 - DNA, 839 bp, Homo sapiens
ggcacgagggatgacctttcttttctcccagcactggaagatgtgtggggcttccttcttccttctggcctcctgggtttctaaaagtgccacggtcattcactgcggcatctgttgtcagtaccaggccaccgccgtctgactgctgacagaggatggctgccaagggctttttctttgcccccagttctcagcatttggttgcatgcatctgcacgtgtctgtgagccttatttggggtttgcttagcttcttaagtctgcaggtttgtgtctttgtgggaagttctcagccattattgctgcaatgtgtttctggccccgccccctttctcctctccctaggagtcagacatcagcctttttgggactgtcctacaggccctagcagggaggagacgcgcctcaatcccagagccctcacacgacccaggcagacttgctggtcttttgggtggcaagtggccctgaggccctctgagaagtctccatgtttctcttagtttgagtggatttctgtcccttggtttgaaaggattcctggaaaggcattacatgcaattaattcacacacatctactaccaccatgatgccagctccagatgagaaggaccaagaggcaaatctgggtggcctaggccctccaaggggacataggtctgcccaacaccacatcctacactcctccaaggaccccttttccaaaccaacccagtaccacagaacatgcaggagcagagcctctgggaagggtgccaggccccgtctgcccaggagcagaggcgctgagccagcacttggccacaggtggctccagagccacagtggacacaaggctc

SEQ ID NO: 2465 - DNA, 894 bp, Homo sapiens
tcgaggttagactgcatagaaaacaatttcagatttcctggaggctgcataaaatttaactatttaaagataattaaagaagcattaaaaataagaagattatcatctccagcaaaatatagaaagtagtacagtgaacaaaatataattagagaatttttgctcaaagaaaaccatctttacattgtaacaggaaaaaatgtgtgtgggttttaccaaatttttatttagaaatgataaggaaataagaagtctaaatggttccaaattctagtatgtcaaaataggaaatcaagtgataatatctaaaagtgatgaatcaacaaatagctrtagtcaatggtatttacatacatagaactaaatattagaaggaacaaccaaagaattgaacatctttgcctgtgaagagtcacttagggattcgaagggaaaagcagactgatgctttttttgtctcagcactatgcgatttttaaaattgttttcccacaatatattgatacaactaaaaattattttaaaattaaaagtttcttcagtgctcccctctgtcaaatctttaaaagatgaaagaatcatatttattttccaagtcagtctaaacaaagttttaagtccatgcctgagattttatccacagcgtacagcaacatttctgtcttgccaaattgagtttgttcagcagcttagaaacactggcaagatacaaaactagtgcaagcatattttatttaaaaaatagtcagacaacatctttcaaacaccattggttagttttcatacaaaatgcaagttttatcagggtatatttttattgtaaacttttcaaaattatttttaattatgtgggcattttttatgtctaactttatttgcactcgtgccgaattc

SEQ ID NO: 2466 - DNA, 691 bp, Homo sapiens
gaattcggcacgagatcctactatattttatgaataaagaataaaaatgagtgaagcctgatcctccaagagcaccaggagaaaatgaagattctagtgttccagaaactccagataatgaaagaaaagcaagtatatcatatttcaaaaatcaaagaggaatacagtatattgatttgtcttctgatagtgaagatgtcgtttccccaaattgctccaatacagttcaagagaaaacattcaacaaagatacagtgattatagtttctgagccatctgaagatgaagagtcccaaggccttcctaccatggcacgtagaaatgatgatatttcagaactggaagacctttcggaattggaagaccttaaagatgctaaacttcagactttgaaggaactttttccacaaagaagtgacaatgatttacttaaggttatattcattggttattgtagctgtaatgatgataaaatctctcctgcattcagtgctatagttagtagtggatagtcatttttctaaagatatcttacgtttgaagatattaactattaaatctaaaggaagtaaatgccagacatttatttattgaaagtcttaactttttaatagatgaggttatttatttgtaaatagtgcagtaattaaagccttaatagcgaaaaaaaaaaaaaaaaaaaaaaactcga

SEQ ID NO: 2467 - DNA, 1665 bp, Homo sapiens
ggcacgagcgcaccaccatgcccggctaatttttgtatttttaatagagatggggtttcaccatgttggccaggctggtctcaaactcctgacttcaagtgattcacctgccttggcctcccaaagtgctgggattagaggtgtgagccaccgtgcccggcatacatggtcttctttcagattcagtccttgctgtccttcctggcttcatcactcagcatcatcttcctcctcccacgctgcctgattcccccagccaacggcactgcagggagcagctgcagtgaattccagaccttgcacactttccatccccaggcctcctgtgctcacgctggtccctctaacctgtacacttttctccgcctctttgatttgtctgccaaggtctcacctttgatgtgaagtcctttgccaagtcttctctaacttcccttgagttaggtgctggtatcccttagggaaatttttgactactcataacagagaagtgacaactgtggcttaacaagacagaaactgaatttctcatgttaaatgaatgtggaaacagagtccagcgtggtacgacagcttgacagtcatgacagtcctggctccttttcttcttctttcatatctgggcaccgacctcctccttcttcttctccttctccttccttcttccttcttcttcttttttaaaattttatttatttattttaaagaatacagaggctgggcgcggtggctcatgcttgtaatcccagcactttgggaggctgaggtgggtggatcacctgaggtcatctgtactaaaaatacaggcgcctgtaatcccagctacttgggaggctgaggcaggacaatcgcttgaacccaggaggcggaggttgcagtgagctgagatagtgccactgtactccagcctgggcaacaagagggaaactccatctcaaaaaaaaaaaaaaaaaaaaaagaacagcgagagtctcaccatgttgcccaggctggtcttaaactcctgacctcaggtgatctgcccacctcggcctcccaaagtgttgggattataggcctgagccaccgtgcccggcccaagcacagacttctgttctgtgtgtcacctcatggtccaggctgactgtatccactctcacctccacatcacaggcagagggagttagagcccttcccatatggccatcatcccaagtctgcagcatccagccataactagactcctcctcccaactggctctagaagaggctagcagccttcaatgttaacccaaataagtcagggttcccttgtgatgaccctaatgttcactatcttggcatcctaccttctttatcctggcatttatcctctttccccagagttaccttcttacccctctaagagcaagtcagtacaaagattggcttgtcatgtttccttgttgactgttgtatccctgcacctaacacagtagcttgaacacagcaggtactcaatactggaaaaggaaagggtagctgtttggccttcaagttaggaacagaggcaacacaacaggttagatcaagcacatctcttttttttttcttgaggcaaagaaaaaacaggcaaggtcttgctctgttgcccaggctagagtgcagtggcatgatctcagctcattgcagcatcaacctcctggg

SEQ ID NO: 2468 - DNA, 1283 bp, Homo sapiens
ggcacgagcgagggaacagattcccagggtggggtggggtagggctgggcctttgctcctttgtctcctttcccaaggcaaagtgaagagaagagagtgactccttcttcactcagggaacccaggcagggatgaagcgcctgtggtgtctgagctgggtcccggggctgcaggggagcccctcagtgttgtcctctgtattcttctccgtgttcaaaccacagctgcattggacatgcagtcaggtgtcctctcactggcaccctccctgccttttcattcttttttctggatagtctttcatcaagttttctctgccttcaccttgctcttcctgaatcagttcaccttgaggggggttaacagagcaccttggcaggctctgttcctccaggtcccaggccagcccccgggactcagggcctgccttcccctcaccttcttgagcagcacaaactcgttctctgctgctgtccgcttgttgatttcctcctcatacctgtgggaatggcgagggctcattggttaatatctcactgaaagcccttgctttcacagggcagcgttgagcaaggagcagcgtgtccatcagaagatacaggtgctgggggccgcagagtactgggcaggggtaagtgggggaaggcttcctggaggagggaacatgctaaccagtttggaagaatgagactgttaaagatccagcttggcaaacgaggaaggagcacatggagcgaatgccctgtgggactctcagaggaaccaggatgtgaactgccctccccaaatttgagtacagctttacaaatgacaaagcgctccaatctgcatttcctcagttacccttgagagcagtcttggagccagatgcacttaaccctcctcttacatgggagagaacgtgagtggtttccccaaacattccctaaacccagagccagagataaccctctgcccactgcccagctcactgggcatttgtcctaagagtcaggccagaggctggaggagcagagagcaagttccagagttttgttggggtgactctgcttgatatgaccaagaacaatgccctccactgacctccaaagcatttaagctggggtgactgccaggggtcccttggagggacaagggcagttgtccagttacagggggactcctcctgctcacctcttcttgtagtcctccactacgtcccgcacattcctcagctccgagtccagcctcaccctgtccccagacagcgtctccagctgcttccgcaggttgctgatgtagcc

SEQ ID NO: 2469 - DNA, 524 bp, Homo sapiens
tcgagccccggctggcgggcctggctgctgggtctttgtcttctaggttcctctttctcccaagaagggctaagtggatcctgtgaagggagggatgcagtggggggaaggagctggccccagctgggtttacattctcagctgggacagcagagcctcactgtgtatgtgtgcagccagcagatacctgtgcacaggcacagacccaccaactcgtggggacacttcaacaccgcacaaagccattttgccactagacccatgcccccaaattagcagaactgctcgtgccgaattcctgcagcccgggggatccactagttctagagcggccgccaccgcggtggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcg

SEQ ID NO: 2470 - DNA, 721 bp, Homo sapiens
ggcacgagcttaaatacacttttatttgctatttctgtgaagcaaactgccgttggacttcccattaaacaatgtctagaatctttgccattgtctctctatgctagtcacacttacagcacctactttcagactcctcatctttcaacctgttgtctcctttcagttgctggattaagtatcatttgggctacatgttccccccttgtccctaaaattccttcccattccaccccagctattctaatgcatttaataatatgtctttggatatgtatgatttcttcaatgtacagtggaatgtattccaatttacataaatagttctacgttattttctgttatggcccttcaatcaattccaagtttcaccttattgatctcattctttctttccactcagtgcttaagatgtgtgtacaactatgaatgcatcctattcatggcatttaactgcaggatggtgttctagtattcatccgaatttcccttatctgatccactagtgatggtcattgtgtcaattaaggtaatgttagctaatggatcaaacacgatgagtttactaataggagtatcagtcatttctggctggatgcaatagctcatacatgtaatcccagtgctttgggaggctgagcagagggattgcttgaccccagattggagaccagtctgggcaacataatgaaatcctatctctacaaaaaaaaaaaaaaaa

SEQ ID NO: 2471 - DNA, 891 bp, Homo sapiens
  misc_feature (14)..(14): n equals a,t,g, or c
  misc_feature (398)..(398): n equals a,t,g, or c
agtgaaataacacnttacctgaaggtcaggttctgaagttagcatatgagatgaaaattgcttatggttaaaatatcctttcagagccttggaagtcaccagtaagcagggccagatgcacctggtttgtggggcatgtgggatcaaagacccactaaaggaacacaggattttcagctccttttgctccctggcatttgctcatcatttgcactattactaaatgctcttcccttccctgctccttctccaagcattggtacatgtctttgtgctagttaagcttgagtacattgtgatttcactagatcacactcccaatttcaagkkcagtgtgaagaatatagaggttctggttggtctagccttggccacgtatgagtagacacccccagttncaaaggtcaactccacttctcactagaattaaaaagctttactccaaatgtagttaaaacagcccaatatcttcctcttataagcagtaattaaactttagtgtggataagattcatctggtttgcttacttgaaaatgcagatctttggctcaacctctagaagatgggacagagccagagtggggttggatggggttgagaaatctgcatttcaacagtagtccacaggtgactctatgcagaccctggaaaacactctatttaagggctcaccacagccagggaccatattccaactgtcacttttctaggtctcattctcattatttgttccaagactctctcttatttttgcaaatttaatttaaaagtatgagcatttcctgaatgtaaccagccactctaagccagagctgacctatgagggacacatacgtggccaaggctagaccaaccagaacctctatattcttcacactgaaccggcacga

SEQ ID NO: 2472 - DNA, 917 bp, Homo sapiens
  misc_feature (434)..(434): n equals a,t,g, or c
gaattcggcacgaggtttcattgccctcaacattctctgttcttcaccgaatcatgtctgtttcctccaacctctggcaaacactgatcttgttactgtctttgtggttttgcctttttccagaatgtcatatagttggaatcatacaattgtgcagactttttagattgccttctttcacttagtaacatttaagtttcctccaccccttttcatggcttgatagttcatttcttttaattgctcaataataaatattccattatctagatagaacggtttatctacctagtgaaggacatctcaattgcctccaagtttaggcaaatataaacaaagctgctatcaggatttttcacagaggaaaagacagtgggatccaaaactgaatggtctatcaataaatgacgcatggtacatctacacccatgranccattgtgcatccatgagaaaaatccagatgtaggaaggtatgtataattttgcagaaaagagtatgtaactggaaacaccaargaaaaaaggaaatggatctatatatttaggtggagatatttatgtggctgcagaagaaatatattattattcatactagatagttaatgtttgcctttggtgggcaagaaaggtaaaaagggagaagggagcccaaccaaaagaggaagaggaagaaaaaaaaactgcactaagaaaaatcttttaaaagtatgtgatcacagccaggtgcagtggctgacaaatgtaatcccagctacttgggaggctgaggcaggagaatcgcttgaacccaggaggctgaagttgcagtgagctgagatcatgccattgcactccagcctggtgacagagactctgtttcaaaaaaaaaaaaaaagtatatgatcacatctgtgttaacttacagactagtctcga

SEQ ID NO: 2473 - DNA, 588 bp, Homo sapiens
gattcggcacgagatcaaaatggccagttctgtgacagtaaaagaggtttgtgtcttatttaatcttttgataataataacagctatggtgtatcacagctttaccaagtaccagacactgttctaagggctttgcatggttcactcactccttacgtcatccctcggtggcaggtgctgtaattatccttatattgcagacaaggacattgagacagaggtcaagccaccttcccaagggcacacatggcatctgcactgctcctgaccgaccgacagagagagctgctgtcacgatcctcaaatgagctatgcatgtcaaaagtttaaaaataaaaaagataaaaacatgcacaaaatttaaaaagtaaaccatttcaagctggacagactaaaactgagagatggccagagaagagtatgaaagataaatctatggacagagtaaaccctgactggcttgaaattagggcccttactcctccacactcctgacgggttggttcaagaccargaawtagaagcmcmttgtgagttctacgstgctgccctgggaaacacacaggctaaacacacccacaggctcga

SEQ ID NO: 2474 - DNA, 958 bp, Homo sapiens
  misc_feature (469)..(469): n equals a,t,g, or c
gaattcggcacgagcgcccacctagtgcacagccttagaggtgttacaggtaaaggaatggcggctcagagggaaggagagacttgcctaacttcagggcaagctaacgcttgatttcaacttgataaatttctgagtatgcagtgggtgcacatagcagagacaggtaatgagaagttttcttttttccttttctttttttgtggggggtggggacagagtctcactctgtcacccaggcaggagtgtagtggtgcaatctcggctcactgcaatctccccccaccccacctccaggttcaagcgattcttgtgcctccgcctcctgagcagctggcactacaggtgcacgccamcacgctgggctaagttttgtattttagtagggatggggtttcaccatgttctacgtttcaccatgttggccaggctggtcttggactcctggcctgaagtgatctgcctgccntcagtgtcccaaaagtgttgggattacaggcgtgagccaccgcactcggccgagaagtttttctgattaaaaaaaattttaaggcacacacttcagacagtggctgtgaaggaaccctgatgtgtatctaaactgtcgcctcgtgcacatcaccccattacttactctgtgctaagtgctgtcatgcattacatcattactccttagaacaggcctatgaggtggagtctgcattaggcccattttggacaaggacaccaatagtgtgggaggtggtgtaccttgcccaagcccccagcaggtaagtggtggtggggattaggacccaggtcacttgagtccatatcctgggctcttagtcccactctgcctggctgcctgctgctccatgaagccaaccctggacctagacctggacctggatcgtcatagcccagatccctgtgtgcttcccaggctgccttgtggcaggtggatggtgcccctcga

SEQ ID NO: 2475 - DNA, 1547 bp, Homo sapiens
ggcagagcccagttcatctcattgggactggttagacagtgggtgcagcccacagagggagagcagaagcagggtggggcgttgcctcacctgggaagcgcaaggggttgaggaactccctcctctagccaaggcaagccatgaaggactgtgccgtgagggacggtgctatctgacccacatactacgcttttccgatggttttcacaacccacagaccaaaagattcccttgggtgcctatacaaccagggccctgggtatcaagcataaaactggatggccgtttggggagacaccgagctggctgcaggagttttttgtttttttttgtttttttgttttttgtacctcagtggcacctggaatgccagcaagacagaactgttcactcctctggaaagggagctgaagccagggcacccgagtggtatgctcagcggatcccacccccacggagcccaacaagctaaatccactggcttgaaactctcgctgcctgcacagcagtctgaagttgacctgggatgctcaagcttggtgtggggaggggcatctgccattactgaggctttgtaaacaaagctgacagaaagtttgaactgggtgcagaacccaacacagcatggcaaagccgctgtagccagaatctagagaggcatctctagattcctcctctctgggcagggcatctctgaaagaaaggtagcagccccagtcaggagcttatagaaaaaactcccatgtccctgggacagagcacctgggggaaggggcagctgtgggcacagcttcaacagacttaaactttcctgcctgctggctctgaagagaggaacagatctctcaccacagcgctcaagatctgctaagggacagactgcctcttccagtggattcttgacccccgtgcctctgactgggagacaccttccagcaggggacgacagacacctcaaacaggagaacttcagctggcatctggcgggtgcctctctgcgacgaagcttccagaggaaggatcaggcagcaatatttgctgttctgcagcctccactggagatacccaggcaaacagggtctggaatggaacttcagtaaattccagcagacctgcagaagaggggcctgactgttagaaggaaaactaacaaccagaaagcaatagcatcaacatcaacaaaaaggacacccaagcaaaaaccccatccaaaggtcaccaacatcaaagaccaaaggtagataaattcacgaagatgaggaaaaaccaacgcaaaaaggctgaaaattcccaaaaccagaatgcctcttctcctccaaagtatcacaactccttgccagtaagggaacaaaactggacggagaatgagtttgatgaattgacagaagtaggcttcagaaggtgggtaataacaaactctcaagctaaaggagtgtgttttaacccaatgcaaggaagctaagaaccttgataaaaagttacaggaactatcactagaataccagttatgagaacaacataaatacctgatggagctgaagccaagg

SEQ ID NO: 2476 - DNA, 1077 bp, Homo sapiens
ggcacgagcggcacgagcccacagcctgcaggaccgaggcccctgtgtgagggactgggggtgtgaggagttgccaggagaagcagaccctgccaggtgcccatctcctctcagcacccctccccccaacacacttcctgtaatggcgtctccaatggggagcccattagtcctgcttagggcagcacctaagtactgtggctgataaatataacatgagcccatcgattagaatcctcctagtcctacagcagctcggctccctaatggctcccctcccctcagcacactgactacccacctctcaccccccaccccaggctgattttctggtttacttgaggctgtggggcaaacatgagaggagcagaagtgaggtgatgggtgcaacacccagagcccagtcaaaggggccactgcttggagacaggctggactggtctgggccctgaggcagcctggaagcccctcggtcagttaggggcagctaggggaggagccgcctgtgagttcccggggccccggccctgcggtaggacatggagcaaggaaggcagagggcccctactttctgtgaggcgcaagacacagcacctgcccttgggggcccttgggggctctcctggtaactcctcagagaaacctgcagtgatgccagctctggccctgtcaccacgccctcttctccctggcatctcctgcccaagcccccgctgcacctgtcccagcccagccaaccctctctgtcttcatttcacccgtctccagggcgtccacatttcctcatcagatcagggttctgagggcaggggctgtgtctcctgcatcagcttagggcccctaaggggtagggactgcttccccagggtgggggctctggaagtcatgaggcttttccccccaaaccaccaaatttggactgagaactgcatagggtagggtctgccgcaccccccgcccccaccataaggtaatcaaaccaattaggccttcagacttgttaaccatcagtgctgggtggaagctgagacagcagagtgagacagctctgctacacctccccccagcctgaaaccc

SEQ ID NO: 2477 - DNA, 434 bp, Homo sapiens
gaattcggcacgagcggcacgagctcgtgccgaattcggcacgagatttcatgggcagtgtctggaactgccttttagcattacttgaaaaacatttaattactttgtacaaattaataataacagtgctactagatttgctcagtgccaggcataagtgctttacatctgtgaactcatttaactgaattggtcccggggttgggatagaacagctgcccctccttcagcagcggttccagccgtcctagctctgcggcctggccactttgttttccccaatccctggyctccaggagcagggctctcagctcccctggctctcacgtcctcacctgagctgaggagaggacagggtggctctctccagctccamamtggtctgtatccaggctattycamcctcattcaaaaaaaaaaaaaaaaaacttcga

SEQ ID NO: 2478 - DNA, 1063 bp, Homo sapiens
ggcacgagagaagattttccaggcaaaacccagatctgctttagtgacttcagaagaaaaagatctgagggaggatgagaagccgatagccaatggtatgtgtgtgaaaacacgtggcagacacacatgctctccagcattctatctcagctgatggtcagcaagccttggggcgtcttcatctccttctccttcatctcactgtctttctaccatgccatctctatcagttcagttcccagtggaagacaggtggtttagccaaagaaaatctaatgaggggtctatttatctgtggtcagggtttgggatgcccatgtgcagtagtgatgccccagggatgagcaagagtgggaagctgtggccaccttgagacctcagggccaacagaagggactatgcttctggagccctggggagcgggagcttggaagagggcaagaggggtcacctcagaagctatagtcacagggagatgcaaccactgcccagactgtggcaaggcatggcgggagcagggggaatcaacacccagcacctgtccctttgaccctttgacttgctggtggcttgcattggctaaaccagaaactggagggcaagagcccctcagtgtagcagcctatgggggccaaccttctgaggtcaaagcaggacagaaggtggagaagggacttggggggacacatggagaacaatcaacaaagtttaccccctttgtcacttggcactggaaaatctgagaagcaccagatgttgtgagttacctaagaggggtttgttgcttcaatgtctttccaatttgggggatttttgaagaaagtgtttatgagcagggcagcttgcccctttacctagtcttccaagaataaaagacaaggcctcagtttttagtcagttgtaaacacttatattctttatttttaggttatgaggatgagggtcgctatccaaaggattgagagagtaggcttttgcactatgtagccatggattcaaatcccagcattaccattgattagcttggggcttttataaagttagttacctctcttagtctcga

SEQ ID NO: 2479 - DNA, 1154 bp, Homo sapiens
ggcacgaggtgccgtgtgtgtgtgcgtgtgtaagtgtgcatgtgcatacatgtgcatgtctgtaggtgcacacatctgtgtgtgtgtgtgcatgtgtgtgctgcatgtctgtggggaggtgtcctccgtgagagcgtgtgacagctgggatttgcactcttgcgtgctgccccagagaccacagcctgggcaggccctgaccttctgtgccccgtgcatcgagccggtctgctgcgggtgcctgtggccgccaatggggaactcgggtgagctggcaggagggtgtgcccagagccctggctgctgctactgccactcagcacagctgggccaggctgttgccccagagggcgtcagacgtgaactttgggaacatctttattctgttttaaagtgagcacaaattattagacactttccccaaaatccatgtgtttggggcgtcttccggccatgccacacatctgtgtttgcctggctgtttctgcaccgagttccgtccacagcccgggtttctgttgttttaagtcttgagccctgggccgggggccacttctcattggtggctggaggctcggccaagtgaggggctgcttctggttggagaggggagtttctggaagggggttccccatgtgtctccagcgcttcctgcagtctggggaggggcttggcaggagcaggtctggtgagaaagccctggccgggggtggaggctcagtcctgggagtgggcggggcagctgggctcggggtgttaacagggtcctgcggggggactctgtgctgagtcaaaggagccggaagctggtgtgggccgggtggggtggggaaggtgggtgcaggcaggggagggggcttggactgaaggtgagacccaggcctgggcaaggatgcggtgtgcccagagctggcagagtcatctgcctgaagcctgactgtggcctgggtggggtaaggaaggtttggagaggctttggggcctgcgggaaagggggctgtggagagagaggctgaccgagggctgccgagaggaagaccagtgttgctggagcctgtggtggagaggggcttggtgggtgaaccctccagggaaggcctggggcagggctcagaggacctggaaggtgtgcagagttgtgtccagcaggagct

SEQ ID NO: 2480 - DNA, 1248 bp, Homo sapiens
  misc_feature (310)..(310): n equals a,t,g, or c
gaattcggcacgagagcctgtaaaaaatgtttggctatcaattatacacatcaagttgatatgctccaggactgggggscatttatgcttgcaattaratctgaggggayktgaggagacccacatggttagccagccctcctttctccaccagactcagcttttttgaagcttgcagagatgaggaagcttaattaaacttatcggagatctctttttccatcctagaaattggagagccatgatcataggtatagagatgttgaaatcttaggtccttctttcttctcctcttataccatcccctctncccatgtactcacatagccacagtcacatacacatgcagatttyaagtcaaacaaatttgttaaaaatagattcttagamcagccacggtggctcacacctgtaacctcagtactttgcaggcggatggtggarattacttgaggccaggagtttgagaccagcctgggcaaataggtakaccacatctcagaaataaataaaaagcaaaaaataaaaataagtagattcttgacttgctttgggtctcatcagaagccaaaacaatcatccaagtctaagtatggccactgatgtctgcagtgctggtgtgagakattgggtcagtgcacaccaattctccacccataatcacaaatcagaggccacaccatggcttccagcctcctaatcctgtataaaagttgatggggtgtgcaatctaaaatgataagaaaagattctcaattaagcggtcttgaactggtgcagtttcagacccaaactcaacaaccccagatcttctttagcaatccacagagaagaaggattaatgttcagctttgctaacaaatattttaaatggtgttctacatacatctgagggctacgaaggttagcactccaaagcaggtaaatatttggcttcttttattttacttcatggattcttcctttcctttccttccctgcaacctcatactctgagataagaggacccagccaytggatytcaaagcaaatgttaaaataccaytccytccacattcattcagccactcaaatatttaattagtgtctatcatatctaaggcattatgctaggtactgttttcaatttagtacgagtactttttataatacaatattcccacagacagtgtgttagagtcaaattcatctttacatgatgtagtaccaaattcccaaaaaaagaacttcccttttagattgggcagt

SEQ ID NO: 2481 - DNA, 735 bp, Homo sapiens
gaattcggcacgagcttcttataacctaatctctgaagtgatatcatcacttctgctatatcctgttcattagatgtgagtcagtaagtccagcccactctcaagggaaggggtgtgaatatcaggaagtggggaatcactggggttatcttagaggctgctaccataacggaggaatattggcatctttattttcattaacctctaactggctttagtgtcacattctacaataaatgtaggcaacaagtcactgtggtatgaacagcacctgtggttttgtaaccagtataaatcagatatttcttattattttatggtkgttgtacctgcctctacttaccactactttggaaatatgggagttattagmcctactgcactagattttgttatttaatatataaaaagaaattcacattactatacaacaacttaaaaaatgcttggacaaaactattttatttgtaactttttgtattttgttttatgagatgtaaaatattattctgagaggtgatccacaggtattaccaaactgttaaggcgtttgtgacacaaaaatattaagaatccctaagcaagtgatattcaaagtgtggttctgggaacagcagcatcaacatcacctgggaactagtctgaaacgcaaattatcaggaggttccttccctgacctactgagtcagaaactctggcggagggacccagcaatctgttcaaatacaccctcga

SEQ ID NO: 2482 - DNA, 442 bp, Homo sapiens
gaattcggcacgagggctgagtgggggccatccttttccatggctgagtgagggccatcctttcatgtggctgagagggatccatcctttcctgtggctgagcgggatccattctttcccgtggctgagtggaggcccatccttaggtacctccagtgagcagcctacatccttggaggatggaaaattgatttgcctcttcacagacttctctggttctagctttgggctatttatgcgtgaagctgctaagaacatttcccaaatgtgatttgtataaatacctaggagtaggattcctagtgtgaggtcagagtctgtctagcagcataaaaacaaccaaaagattttctgagcctcagggcacatgggtggggcccagagagcacccaggaccgaagctgcccaggacctccctcgaggggggcccgtaacccattcg

SEQ ID NO: 2483 - DNA, 1274 bp, Homo sapiens
ggcacgaggaaagaccaactggccggtcttctgagcagatggattcctataggaccagtggggagaggattacacagtacctctgaaccctcaacacaaaataatatctcttctattgttggttagtttcactatctgcttcattcttttaaaatgtcaagtgttttctcttgagggaaccttctgaattactttgcctgcactatacctaattcttattacaatgctgtgaactttgaattattacccttgttcaccccaaatggaaaatcaaagctcaaagaggtgagtgactgcccagctcatgcagctgatagaatcaagatttcatttcaggtgtgtctggatcctgcacttacttgctcttttctcaacatggcctcctaaggatccagaaggaagcccgccatcagcaaccagcagcccactcaccccccacctcagtctcaccttgccattcaaacaggctccagtttcaaatgtcagttctgccattcacgtgatgctggacaagtcagttagcctctctgagattcaattttctcatatgcctaatggaaaaagagcatctaccttataaattgcatatttactcttccttcccactgactcaatagaactatattccccaytcccatagatgctggccttagacttgtgacttgcattggccaatgagatgagacatacaccaatcaaaagagaggcattaaatgtgcatgactggtttagcttggcctcttatgstcctgccatgcgtrattagatcatgcctgagtagccactgctcattcagcctgagttctggagtgagaaacaggtggagcagtcctggactccatccacagcccagagcagagcaccatggcccacccgtagggctgtaagtgagaaagaaatgtctattgttataaaccagtggttttcaaggcatggtccctcagtatcaacgtcacttagaaatttggagaaatgcacattctcagtcctcatccaaacctgcttaatcagaaactctgggggttgggcccagcaatctgtattttaaaaaggcctctaggtaattctgatgcaggctcaggcttggaatccactgttataaatcactgacatttggggattatttgttgctgtgtgaaagctgactaatacatctaccctttgaggttgctatgaggacacagtaagataagatgtgagaagctcctggaatgaggttcctcctgatagtcctaagcctggcatccaaaattcttcataatctgatcctcgag

SEQ ID NO: 2484 - DNA, 802 bp, Homo sapiens
  misc_feature (291)..(291): n equals a,t,g, or c
gaattcggcacgaggaaatatctgaaaacttacatctgttcttgtgagacacatcattgctttgacgtcagtgacctaaccacacgaactaagaatttttaaaaagtactcttgatggtatgttttatgatgttcagggtcccagccattcctcggaaatgtgtttttttgtttttttttttgtttgtttgtttttgtttttgatgaatgagtctaaaggctgagtggctatcaaacaattctttttggtttacattgtattatgaaaataatataaaaaccctgtgtacntttcttgttttcctttctatagttttggggaacaggtgggtttttgktacctggataagtctttagtggtaatttctgagattttggtgtgcccatcaccccyccgtgtactttaaaatgagtaagttgtgaaaatgtcaactagtttgctatttagagggtcctcataaagtaacaaaatgatacataacacatttgcacagcaagtcctcacttagagttgtagatatgttcttgaaaactgcgacttcaagtgaaacaacatataacaaaactaattttaccataggctggttgacacaaacaagagcttagttcctaccacacattactggtcataaaaacatgaccaaatctctaactaaagaccaaaagacttctaataataaacatcgagataaatgtgagctatacctacctttaagaaagattagtgtaaacaagtaaggtaatttactcagttattctagttcaggactgtgggtagccagagcctgtcctggcagctcga

SEQ ID NO: 2485 - DNA, 724 bp, Homo sapiens
gaattcggcacgagcaatagccctatgatgaagaaattattacagtgaagaaatatgaagctcagcgtcccactattaattgtcccattattaatgtggaattcaaactggatctgagtttggggcgtgtgtgcactttctactgctgttgctctatcatcattagacaagtgtataggaaatacatgatgagcacctacaatccaagaattaagttttattcacactcgcgctctcactactatttacacagtaagaaacttttaaatgagcaattaaaggaatwaaccaaaargargaaaagratacagactgggamccamcaaactggaatacgggaagacatgagaaagatgattaaccaatgaaaaaaagagaagaatttcattagagaatgggaatgggagaagagtttttgaaatgagtatcagattatcaattattcattacgaagtagaacaccccagagtaagcaaaaatttcttaacatttagtaataactacatatccactatattcaaggtcctgtgttaaaagctgtggtggaggctgggcatactggcttgtgcctataatcccagcactttgggaggctgaggtgggtggatcacccgaggtcaggagttcgagaccagcctggccaacacagtgaaaccccgtctctactaaaaatacaaaaattacctgagtgtggtggcgcacacccgtagtcccagctactcga

SEQ ID NO: 2486 - DNA, 1251 bp, Homo sapiens
ggcacaggtcagccaactaacaaatgaagcgcagggaaatgactcaattcttattgagtctagttgctcttaattgctgctctatttctttgggaagattgacatatccaggaggttttcatctaaaactagaccccttagaactctgaagtcagagcaactttccctctgtcaatcctactcactacttttgtamccttgaccagagaagttgcttaatcttttggggcctgcattctcatatacctaaagtaggaataaaaatacctgcttagagacttgctcagtccatcaaatragagattatacacaaccttcccacttcaaggatggctgcaaggacaaaaaagaaaaatgacataataaatataaaggtccctgcagactgtaatactaggatgagttattactacaaaggctcagggaaaagaggagagatggagtcttggttggtcatgtcatcatggtctattttagattttgagtttttagaggcaagaccacagttgtttaatttagtgtatacagaacattccacttattcagggagacattatactagggaaaggggtgggttcatggtgttcaaaaattcatactcacagttattattaaaaagaaaggattctctatgtgcttttattcagcccatggctttaaatatcatccatgtgcctatgtcttccaaatgtatttttccagcccagtctggtccctcgacattcagatccttatggtggtgccctcaccctatatccaaatgccaacttggtctctactctagtcagattagagatatcccatacttggcatgactaaaatggaactttaacttgtttcttatctctatctcagtaaatcacaccaccacagtgcatcattttcctaaatcaaattcctaagaatcatccttgatttttcccttccttttgtcccttgccatcccagattatcctgcaaaaactgtctatgctacctacaaaagtatctgccacatgtcatactaattgtcratatcctagagcaccmttcatctgccttcacctgtggtgttgctgcaattgtctccttcctggctgccctgattatatccattctccctgtctccaaaagcattctgcgcacagcagacacagatgtttcataaatgtaagtctggtcatgcgctcctctacctaaaaccattagatggtttttcattgcactcacaactagagtttcctgaccatgacttgcaggctaagctcgtag

SEQ ID NO: 2487 - DNA, 985 bp, Homo sapiens
  misc_feature (633)..(633): n equals a,t,g, or c
  misc_feature (642)..(642): n equals a,t,g, or c
ggcacgagcacacccccctgagaccagggagcatttattcaaggaaacacttgtctttagaggatgttgacgatgccccaaacttactgtagctgtcaggaaaattaggtgagctatttagtatcattgagcttcattttacagaaccagcatgttgtccttagacttccctctgatccttttaggtctcaacttacatattgccctcttgagccttctagttcccagactgagttaggaaccccaacccatgctggactcagttagtcctttccacattgtgctgtaattggctataccccatctgtccttcctgccagactaggagtctcctgcgggccctaacgttcccaatttccggtgtttggactggtgctctgtagatgtttagggaatgaaagggtaatgaataaattaatgaaacaaataagaatcatatagtattagcagcactagataaaaggtgtaaaatcttaagtgatccaccatcttttaaataattcattcaaacgatatttcaaatgcatatcacctccaagaaatcgtttctgcatttcrrstgasttctacgatgccwwrtgaatgarraarsrrgracakggyrtggttctggggggctgtgagagtaacggngcaatcctngtcattgtcgtagttatctggccatccagggcttctcaggttgccaaatgccttgtgatagtctctgttgcaatcttagaggaaaaataggcataattaatgtacgcattccaatatttagtgctctttcaacttacacaggaatcattcaaaaagatcattgcatttgataaactttagaaaaaagtaatccagcttcttcgtttacctttgagataattgagaccctgagcagtgaagtgaattgctcaagcagcacacacaggtgcaacgcaacagctcgttcacacaaacacgcctacaggaagcatgacacaggaggcttctcctttaaagacgaata

SEQ ID NO: 2488 - DNA, 837 bp, Homo sapiens
  misc_feature (474)..(474): n equals a,t,g, or c
gcttccaggctccagcctctgcccgcactgcttgcagtaccctactcatgtgtcctcttcatgtgcccctccccggtcatatgggtcccttctggcccctgcccagcttatactctgtccgatcctcacagtcaccctgtcccctttgcttttctttgctgccactgcaggcccacctcagcctcctgcacactctcttcagatcagcctcccaatctccagcgtctggagtgttctggggctgcctgagagagagacatgaatacatgtcaccctgccttcctcacatgtaccagaagtttgatttttttttttttttttgactgagtcttgctctgtcaccaagctggagtgcagtggcacgctcggctcactgcaacctccacctcccgggttgcagcgattctcctgcctcagcctcccgagtagctgggattacaggcatgcaccagcatgcccagctaatttttgtanttttagtagagacagggtttcaccatgttggccaggatggktttgatctcttaacctcgtgatccgcccgccttggcctctcaaagtgctggaattacaggcgtgagccaccacgcccggccctgattattattattattattttaaacaataatctgggccaggcacagtggctcacacctgtaatcccaacactttttgggaggctgaggcaggaggattattgagcccaggaatttgagactagcctgagcaacatagtgagaccctgtctctacaaaaagtaaaaaattagtccaggcatggtggcacatgcctgtagtcccagctactcaggaggctgagataggaggatcactcgta

SEQ ID NO: 2489 - DNA, 905 bp, Homo sapiens
  misc_feature (343)..(343): n equals a,t,g, or c
  misc_feature (879)..(879): n equals a,t,g, or c
gaattcggcacgagccgagctgccacgcctggccccaggatcctgtgactgcctgccctggtgcaggctttcacctgcctggccctgcgcccttcacggaggctcacggctgtgtgccatcacccccatctcgccaccgccaggcgcccttgcgcaggagaaacagggaaggaaggggcgggcctggccctgcgctctgcaccctgactccctgggcgatgatgggggctggtcactctggccgggatgcggaccccaccctcgcccgggcccaggactcaccttgtccttgtgctgctccagccactctcgcagcgtggccagcacgatctcggcggccgcntcamargggtagcctrargcgggtggggcgggagtgagtcctaggctctggccccgcccactcccctgtccgccccggcccctcccggcgtctgggtccaccgcccactcctggtccttgcctttcttccagactcaccaaacacgccggtggagatgcaggggaacgcctgggcggggaggggtgagagggggttggaacattgtcactgcgccccgcytcccgccctcccccgcgggccgtccctcaccaccgagcggagccggtgctccagcagcaggtccagactgctcaggtagcagctgcggagctcggcagcctgactggcgctgggctccccgtaggcgatgggccccactgtgtggatgacgtctacggggggcgayggggtcagaccggmgggggtctacgcggtcctcagctccctcgcttccccctgccggcctgggcagaagggggcaggaaacacctttccccccaagcgctgagcctcctccgcgaargcccccaccctgtgggccccctcgagcccgaantcgcacgcgcacagagccccgcgccc

SEQ ID NO: 2490 - DNA, 858 bp, Homo sapiens
cccccgggctgcaggaattcggcacgagagtggctggagtctggctgcagagggaagacatcagcagggagggagccagggcctgtcacatctttcctctggccattgtcctggtctttgtaagcccagaatctccccttccctgaagggaggccagcaccccaggagggcagcaggtgtgctgtgagggttggagtagtgtgagaggtcagggtacactagaatggccatggacaccatgtgggggtgctctgggctgggccacagaacagtgtccttcctgctgctcctcccctgcagcttcccccgaccttgtggtttatttggtttgataccaatcagcagaccctgcaaggtggaggctcccaggcctctcagtcccaccactctcatgtgccagtcacccctactgtaactgcccaatgagtacttcttgcccactgccaagatagagccagtttaccaagacaggggaattgcagtagagaaagagttgaatatacatagagccagctaaatgggagagtggagttttcttattacttaaatcagcctcccctaaaattcagaggtgagaatttttcaaggacagtttggtgggcagggcctagggaatggatgctgctgattggctagggatgcaatcataggggtgtagaaaaggtccttgtgcactgagtccacttttgggtgagagctaccaaggagctgctggtctgctggtcccggtagagccatctggtgtcaggaatgcaaaagtgtggccaggcacagtggcccacacttgtaatcctagcactttgggaggctgaggcaggaggaatgcttgagcccaggagctcgagggggggcccggta

SEQ ID NO: 2491 - DNA, 722 bp, Homo sapiens
  misc_feature (697)..(697): n equals a,t,g, or c
  misc_feature (717)..(717): n equals a,t,g, or c
gaattcggcacgagcatgagccactgcacccagccgatactactatatccccattttacagatgagcacatgggcaaattgagggtaaggcactgacccatgatcatacagctgagaagtggcaaaggcaggatttgaacctagaacctctggctccacacactagtaatctaaaccactctccctacaatacaacatacgtggtaaagatgtgtggtgggcacgcaatcaacgtaggtcccttcacagttgctgggagaggcaggaatttgcagttcctccgcgttctcctcctccgctgcccacctgtcctgggtcattcctgcagcstgccctgccctgcctggtctcaccctccctctgccaacagaagtctgggcagggttttatgggctctgataaggccctggcagggccgaagttcatgagcacttcctctttgcaggagggcgtaggggaggggacccaggtgatttgggtcctggctggtcaccagggaagctggcaagggaagggagactagggtgcgctctaggagaagccgacagcctgagagtcccagaagaggagccctgtggaccctcccctgccagccactcccttaccctgggtataagagccaccaccgcctgccatccgccaccatctcccactcctgcagctcttctcacagaccagccactagcgcagcctcganggggggcccgtcccaatttncctct

SEQ ID NO: 2492 - DNA, 785 bp, Homo sapiens
  misc_feature (716)..(716): n equals a,t,g, or c
  misc_feature (731)..(731): n equals a,t,g, or c
  misc_feature (772)..(772): n equals a,t,g, or c
ctgcaggaattcggcacgaggttttatcatccaggatatggtcactctcagtggcatattccatgtgcatctgataaggatgtatgttctgctcttcctgggtaaagtgttataaattcaaattgttgataatgttcaggtcatctatatccttaatggttttctccctgattcttttattaactactgagagaagaatattggcatgtccacctataattttgaattcgtctatttttctttcagatctgtctgttttgccttaaacattccttatctttcagaataattaaaagtaaaaaaacattgttacttgttttttccatttctgatgttctccattttgttgcatagatccaagtttctgagcttttaccctgtgaatcatagtcattttaaatttcttgtcatatgtgagagtttagttctgattactgctttgtcttttcagattgtgttttattgtgtattttcacattccttgtaattttttatgttaaaaaaattgtgtatgtgcmaagctgaacataggacagaagacactgaagtaaatgttttcatgcttggaaatgagcaggcctttcctcctcctctctttagtcgtgggyttgtgcttgtttagttgagttgggtttgaagtttgktcacctttggctttgggtctcctaacctgactttctgtgtttcctgtgcactgctcccaagatagaaactgnttctgggctatcttncagttggaattccttacttgattcttatcagcatgggttangaagggaaacatg

SEQ ID NO: 2493 - DNA, 591 bp, Homo sapiens
gattttgtagtgatgggggtcttgctatgttgcccaggctggtctcaaactccagcctcaagccttcctcctgcctcggccataagtcttttttaatcacagaaatatttcaaacacgtgtaaagctctctttaatggagctcgtgtttctcatcatctctctggtttgccaacattgcagtcctgacagtgctggggatctgtgtgtccaaacaccctctgtttggccgaggaccctgatggaaataatgctctccagccttggtgaatttgcactttcaaacaaccagagatttgtctgttttaataacattcactctagctgggcgtggtggctcacatctgtaatcccagcactttgggaggctgacacaggaggattgcttgaggccaggagtttgagaccagcctaggcaacacagacaaattagccaggtgtggtggcacgtgcctgtagtccagctactcaggaggctgaggtgggaggatcacttgagcctgggaggtcgaggctacagtgagctattatcatgctactgcactccagcctgggcaatggagtaagaccctatctccaaaaaaaaattgtta

SEQ ID NO: 2494 - DNA, 716 bp, Homo sapiens
ggcacgagctcagccacgtgaccaaccgggtcacatggcccgcgggacaacatggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcagttcggcagccgctcaccgatactcgcgggaggctaacgctccgggccccgtacccggagagcggcaactcgcgcactcaaaggtgctccatcgattcctccgaggcgggtgggggctgctcggttcctggacggggttggagtaggcaaagcaaggcactagtaggaagggaagtaaaggttataaccacaccccaaatcgagcacctgctgttcccgtatgaggagttccttctccgtgcctcaccggaagactccatttaattgaccattagggagtttggtttgagggttattgttacttctttaccccctatttctttctccctccaacctgttctcttaatgaggatctcataattttaaggcaatcaaattatggtttaaatcaccatttcctctcttattaacggaataaattaggatcctgggtctcagtatcttcaccagggttgttgtatacttatctgtagtctcc

SEQ ID NO: 2495 - DNA, 206 bp, Homo sapiens
ggcacgagcttttcccaccccgttggtggcctgacaagttcatctctaaggttggtttcactattgctaatgctagagacttgwcacacacatttccaacaatgaaactggaaaactatttatttgaaagcctttctttaattatagttgtttggtctctaagtaatagttctgaggtttgcagaaaagtaaaacaaatagtagga

SEQ ID NO: 2496 - DNA, 781 bp, Homo sapiens
ggcacgagattttcagcctttttggactggtttctccacatcttcgtggatttatctaactttggtctttgatgttggtgaccttcagattgggtctctgagtgaacatcctttttgttgatgttgatactattcctttctgtttgtttgtttgttttccttctaacagtcagggccctctgctgcaggtctgctggagtttggttgaggtccactccagaccctgtttgtctgggttttgccagaggaggctgcagaatagcaatgattgctgcctgtttttcctctggaagctttgtcccagaggggcacccaccagatgccagccagagctctcctgtatgaggtgtctgttggcccatacttggaggtgccttccagtcaggatacacaggtgtcaggtacccacttgaggaggcactctgtcccctatcagagctcgaacactgtgctgggagatccactgttctcttcagagctgtcagacagggacgtttaagtctgctgaagctatgcccacagctgcccctttccccagatgctctgtcccagggagaagggagttttatctataagtctctgactggggctgctgccttttcttcagagatgccctgccccaagacggggactctagagaggcagtctggctgcagtggccttgctgaactgtggtgggcttcacccagttggaccttccctgagcctttttttttaccctgtgagggtaaaaatgcctaatcaagcctcagcaatggtggatgcccttccccccaccaag

SEQ ID NO: 2497 - DNA, 1065 bp, Homo sapiens
ggcacgagagagaggtggggttaatgtgatggaaagttggcattgcttagtttctggggctgccttctagatagcttctaaaccccaaagcttctctccacagtgccatgcgtctactgagtactctgcttagcttttaccccttcagcaactgctttttgctcagtttctgtgattctcacccacccgtgtggcttaggaattcacaagtgtttccagaggaagttgtgtgaaaggtggctagaggaccagaatctttttccctcgtgtcctggctgtcctgtggccctggactccacatttttatcactagcccactgggcccccaccctgttgggtgtcagtgctccccaaactgacaagtgccctgaggaggaaacgctcggatgcaggcgcagctcagttcatttcctttctatgtgggatcctcaccttctatgtctttcttggtctccaaagcctcacacagctgttccttgctgttggcatcacttagtctcgcagtccctggtgtttccatcaggaaagtcaggcaggcgttagcttcactgccaggagggaatctcctgtggcctccatggcgctgtgttttcttccagtcttttttctatgcacagacacatcatcccctttgtttccttttgtgatgctgtttctaaaaggatctttatttctagaagaaactttaggaggcaaaaacagcgcagcccccttaacagagtggctctggtggcaactttcccttgttaatttgtcctgtagcccctactttcccaagcgcttgctgtttgtggggctacaggacacagcagctgaaaggggctgtgggcatcgccagcatgtaccctcttatcccatttgctgacaaggatcctgaaggcccaagcatagaaagaagttgctatggctgccatgtgtcagcagcatagccatggccaactcagggccctgactcctacctgacccccttctgaatgacactcaaggtaagggtccccttcccactcacaggtgaggtgaaacatttcaccttgaaaagcctcttgcccccagcctcccctcgta

SEQ ID NO: 2498 - DNA, 696 bp, Homo sapiens
ggcacgaggtggaggagaaatttaacagtcctctcatgcagacggagggtgacattcaaatgggagaatttacttctgtggtttgctactgtttcattctttcccttatcattggtagtgttgttaggtggcagggttgtggggcagagtggggtttcgccctgggggagcatatgtggcagagggcacaggaagatctgtaagcaagagggcatagcaaattaaatgaccacactgtcaggaaggttgacaggccaaagaaagatcagctcctccaaatctgctgaactaactctcccctcgtagccccagacacgttttctcaatttgagcacaatatccattactatttcccgtactgggtttcaattaaagagagtgagagtagaaagttcactggtgtttgggggttcatttatttccaagcaggatgcaaatgaaagggagccgtgggcacagagttgtcatgtgtgtttttcctccctcttctttccatttccttcttgcaaccttccctccacttcttgccagccacccagcacacccgtgttcccaaagcaaatgttttcawgtcttgaaaatccagttagggtgaggagagaaggaaggtgataacatcatacctactgatgccccctagagatgaagctgtcctgggggcacttaaggcttgagggaaggatttaccttctcgag

SEQ ID NO: 2499 - DNA, 785 bp, Homo sapiens
gaattcggcacgagcttgttcacactcagtaaacacattagttgaattcctctgattgtcaattagcaatggttttgccaagaatactggtattgatgctgtttttagcactgaaaaatcctgtgggagaaatgaggaatttaacacattgtaggtgttaagattcctgggtgtctgacagtatccctggaaccattatcattaattaacttttcaatcagaaaggcaaactactttgctgttaggcttccagatgaggttttttgaaaaaacagtaagataataaaggcttggattgctcctacttcctgaggcaagtcacatctcatattattcagaacttggactgaagagctcatagggcaagtgaggccaaggtcaggagtcttcagacatcttgggccaagtgccattctagaagaaatgattctcttcctcagtcaccatctatctatgcccccaggtttgactcgctcttttcccaaggagtgctgttcattcctgacacaagggagaccagaaaagagatcatgaatgacagtgaaaacctttatgacactgacataaagcagagagttagactgaatatgagttggtagcttttcctttgtatctgtgtaagttgaatcatacaaaattgtcattttggtgattcaaaagtgtaaaacaaaagcaagttcatatgattcaagcttacatttttttctcactataagaaagaggatttaaagaattgtattaggttagcgaatctgatttctttcatgcaaatacagctcctccga

SEQ ID NO: 2500 - DNA, 461 bp, Homo sapiens
  misc_feature (429)..(429): n equals a,t,g, or c
gtccagatcccactgctgcccactgtatttttgacacaagtcaaatcagtttggctgtattgtttgctgctcactatcaccgtattaaagatttgtgaggggcactgctactgctgctgcacttcagggtatgaatccattcaatgtttgctttctcacctctatctaggctggcaatgttaggtgtttgttgtggttgttgtttgggtttatttttagaaagtgatacaggaattaatttcctaaatttcaattaccttgcttcctacagttggtcctccaggtccagtaatttcaacaatctgggtattttttcttttttcttttttgagacggagtctcgctctgttgcccaggctggagtgcagtggcactatctcagctcactgcaagctctgcctcctgggttcacaccattctcctgccttnagcctaccgagtaactagggactacaggcgcc

SEQ ID NO: 2501 - DNA, 1146 bp, Homo sapiens
tcttttctgtaacttcatttagcactcaaaacaatatcactatttaatgttacactttgactacaaacttatctttctccttacaagctttttatgtatttaatattatcttggctatttctgtgcaaactagttaaatgttactttgaaattcttcttttctctacatcacctcagttactccagtggacagtaattgttacttactgtggtcctctgttacggttttgaatttcttcaaatgccttttgaatttaatgaaaatactacatgaaataatactggtggctacataattttcttccactttttcttaagtctctgcaatgaaacagctgacagtaaggtgtgcgtgagtggtgagatatgttaactcctatacttcactttagcttatgttgtcagggagtgatctccaaatgcaaaaatataaagtactctattcttggggaacaatgtgagcaatggaaggcttggcctttcttaggcagatccctcagattcaaaaggaacacatcttgatttaatatcaatctctatacaggggcctgagaatgggatgaggagagctgctggtctttgtactgcaatttaattcactctgattactttctatcctcccacccccactcttcctccagtctctttctgattagttatcatagtcttccccaagactctatatatgctctctgggttcctgtcaagaggaaatcctgtacacaccccctactcctctatcactgcttcctggtctgggcactctcactgtgcagcttcttctgctctggtttagccaacaatataatccatagattttctgaattccatcatagcatctggtctttgtgtgagtcctctttcattccgtgtctattacgggtatttttaaatatctttactgttgatacagtgagatttgtgggaaagaggatagaaacataagccaatctcccctcttgaaatggacatctattattaattaacactcatcaaaataaatgttcttattgttatatcttagttggataaagatgaaaagataagaccaaaatcctgctctctaatcacgatttattgtaacaataatattattgtattattggggggggcccgtacccaatcgcctcacatgcatcgtataca

SEQ ID NO: 2502 - DNA, 947 bp, Homo sapiens
ggcacgagcagattgtttctggcttagtagcatcatctaatggcgagcaggggcactgcagcccctggacgcaccttcctggcgatgatggtcacgtcctttttcttttgtatgagatggggatcatgggctgagcagatgccccaaaggtgtctgccatgctgtatgcaggaatgctgaggtttcatgcaaaaacgtatgttgggatcacttgacggggtgcatggaaagtatcctagcagagttttgctagtagagaatgtgccctccgctagtactctagagtcacagcccagatcctagccttcgggtggaggtgccgccctatgaacggccatcagactgtcctattgttcagagactccttttcgtcccttactacttcatctcaggcctgtgaggatctctaccaaagcagagcaagcccataaataaatagctttgtgctcaccaatgcatcagtggcgctgaaataactgtgcagtggacaccactctccctccctctgggcctttcagctgctctgtgtgtccacgctgttgtgtgccctgaaagaactttgagatttgctgaaaggtctccagctgcaatttcagaccatgtgggtaactcaaatgtctaacatttaaatatggctgaaaggggtcgactgctgggctggatggtggcagaagtagcaggctttcccttggatctctttacagggcagagatgactccttacaaatggcaccagtaatccctctgcctcctgatacccatctaacagaaaagtgcaccctgctcataagaaaaccccaggccacatttgtcttatgtgaccctggtctctggctacagctgacttgacacaaactaagacaatcagatttttttcttctggaacttgctgtgagacacagagacacagtggactggatgacaatgctgggatgtgaaggatgtgtc

SEQ ID NO: 2503 - DNA, 526 bp, Homo sapiens
gcaggggaattcggccacggaggggtttcaacagggcccgtggggtgaggtgcaracacaaagcccataagtgctggcctgttgggacaaatgagagaaatcccatagggtggtgatgacagcgcaytcagccatcytaytcctggggaaaatgaaacttgtgctcctatcaaatgctcagttgtaaaactggaaaaaaattttagaagacatcttgtccagcatctgtgtttatgtctataaaatgtagaaaactaaagcacagagatgttaaatgttttgtccaaggtccaacagctggttagcargcttggtctggtgacctttctactgaaccacagtgccgctgggggaagtcctcagcacagatggctgctgctatagctggggtatgggcagtattagtagttaaccagtcaacccaagttcccatagtctaggttctgcttcagctggaggttagggaaaaacacaagaaaatcccttaccactctaccagtgctgggggatgtactaagagatcccc

SEQ ID NO: 2504 - DNA, 570 bp, Homo sapiens
aaacgacggccagtgaattgtaatacgactcactataggccgaattggttaccggcccccccctcgagttgaattagagaaaacgacatggacacacgtggagtggttttaaggagcggagagtttaataggcaagaaggaagggagaagacagaaggaagaagctcctccatatggagacagagggaggggggctccaaagccaaaagaggaggtccccaagtgcagtggacaccagccaagtatatatgcagaggctggaaggggcgatgtctgatttacatagggctcaggggattggtttgaccacgcatgttattcacatagcccactaaaaagctggctctcccaccctagtcttttaatatgcaaatgcagggagccatggatgttctacacatgtggggatatttggggatgttctacacatgtggggcggccatgttgccaggaacatgtgaggcaagggtaagaaggccttgggaattgccatgttgggtggacccagtttctaatggcctgcatttgcatatcaaaggttgctcgtgccgaattcctgcagcccggggg

SEQ ID NO: 2505 - DNA, 1005 bp, Homo sapiens
  misc_feature (506)..(506): n equals a,t,g, or c
ggcacgagctcgtgccgttggttttccctctgtctgttcagtgggttctgaacattctttgatggctggatcctactcctctgacatcttagtgttggcaagatcttggaccctcctccttctttctgttttgaggttgcagaccgttggctcatcagtcacactggactcacaggtgggtattatttggcctgcagttttcaaaataggaaatcgtgttaaaaaacaaaatcaaataaaagaaaaacgacaacaacaaaaccaaaactgaacttccaatttatcttggagaattagcagacctagtaaaatgagttctgtattctcatatggcaataattttctggagctgagtacctgcttcttgggtcattcttaatcaactcattctttccaaacatcttatacccagcctgtgtcattcatttaggtgagctgacaaaggctagtaggaatataaatttatgacccttagtttatactctccccagtggatcttatttaantacccattwaaataccatatgctttaaaaagtcttctttcataacattgagtgcacacaatatgccctgaactatgtaccagacactggggatacgcggtgaatkacgcaagtcactctacttccaaagaacttaccttctatagaggggagacacacacaacagtgataacataaagccaaataatatttgggctgggcgcagtsgctcatgcctgtaatcccagcacttcgagaggctgaggcgagcggatcacgaggtcaagagattgagaccaacctggccaacatggtgaaatcctgtctctactaaaaatacaaaaattagctgggtgtggtggcaggtgcctgtaatcccagctacttgggaggctgaggcaggagaattgcttgaacctgggaggcgaaggttgcattgagccgagattgtgccactgcactccagcctggtgacagagcgagactccatctcaaaaaaaaaaaaaaaaaaaaaactcgta

SEQ ID NO: 2506 - DNA, 235 bp, Homo sapiens
  misc_feature (227)..(227): n equals a,t,g, or c
  misc_feature (230)..(230): n equals a,t,g, or c
ctgtggcctcaacatatatctctgtaagagtcccctgggcctaccataaaaaaaggaccccaaactgggggacttgaagcagcagaaataagattctctgcttgttgaggaggccagaaggctggaaggaaggggtccctggggttgattgcttctggaaactatgatggcatattcatttcatgcctttctctttttttttttttttttttggggaggggggaaanatnccccc

SEQ ID NO: 2507 - DNA, 1122 bp, Homo sapiens
  misc_feature (380)..(381): n equals a,t,g, or c
  misc_feature (402)..(402): n equals a,t,g, or c
  misc_feature (499)..(499): n equals a,t,g, or c
  misc_feature (505)..(505): n equals a,t,g, or c
agtgaaaagcagatgttaagtggcatatgtgtcttcagtcacctctgtgtgggttgttctgtagtatagagggtgttctaaaaatgatctttaggaatggagtgaggcttgtttttgtttttgttttgttttacacttccacacaatcccttttcaattccttgcaaactgctgagtatgtactattttgccagcaaaggctgagcctgtatgaacccagccatgtgctttgtctgtgcatgtccccacacaggaagcacaccagagaaagcgatacttcagggtagattgatttcattaggaacttcattatcaccagcctcaaatggttctggccagcagtctttttctatctgtatgattaacccttctctgccgcnnagcacctcctcccaccacctnttctcagtgttaacaggtgatctagactcctactctcagagaaaattgaagccaacaagtagaaagtcttttttgctaccaaagacacaaacctatnttgttntgcatccatcctcacccccgctggtgcttgttcaacacaggagtcctctctccacctacccaaagcctgtcccctcctgctgtgccctggatcttatctctgtcattgccttagaaacctttcttgtatatattcatctttttccttcaatagatctttcttattggattttaagcatgttgcagcctcttctgttaataaaacaacaatcaacaaaaacactctcccttaactgcatgctttattccagctactaccttatatcattcctttccttcaaggccaaagtcctcagaagaggtggcaatatcctccatcatttcttcacttcatactcattcttcaacacatactaatctagtctcttaccccataattcattaaaacacttattcttgggtcatgggtgacttctgtatagctaaatccagtggatatttttcaggcctcctcttccttacattttagtatttcaccctattggccattcttttcttcttgaaatactctctcctttagcttttatgacactgtactcctggtttttctcccatttcttgtctgctcctgcttagttccctctgtaaacttggcctctttcacaaggccagtaaaca

SEQ ID NO: 2508 - DNA, 532 bp, Homo sapiens
tcctctaacttagaggaagactatgtattataaaattagctaaataagagccacaattattaaagtgaaaatcaaaactgtttcaaggtacattatcgtgtttaaatttgatctgggtctttcttttgactgtggccatggcactactaacctaaagaacccttcaggctcccttcacggtagagtcctttccttcgtccctgccatacctggaacatgctcctcctcctatcactctcaagtcctccccacccttcaagacccagcttaaatccctacttcttgactgaagcttttcctgactcttccaccctgagtcattttcctctccttaagggcactcttaacacatcaattatgagtatctctttacatacctgacctccctccttccccctcaactcaaagctcccacagagcagggacctggtctttctatgccaagtgcaaattaggctcttggtacttgaacaagcaaacaaaaactatttctataaatagaagaaatacgggacaaatacagattcattcc

SEQ ID NO: 2509 - DNA, 780 bp, Homo sapiens
gaattcggcacgagcggacgggacaggggacctggctgttgagctgtccaagaccgacccggcgagcctggagacaggccaggacagtgaggatgactcaggcgagccagaggactgggtcccggaccctgtggatgccgatccaggttagcttgccccacatggtccctttcaccagtgtggggggcgcttcagccaggccgtccgctctggactcatcccttgtcacagagcttggctgtgtcaggtgtcgctagtgtctcagaggcttgagggtgtcaaaggtcagggcagtgctccgccacctgccagcctgggcaggccggtgatgggctgttttcctctgtggctggtcactctggccgtgggggatgccctgcctcccaccgcttgtgagctgtggggtgtccctgccccgccactgcacctggcagaggagtgaagatgtgggtgacccctgagctctgtactgatttgggcctcaaagtcccgttagggtgccagctcctgctcagagcccatctgtgcctggccctcgtctgcgagggctctgagggctgtggggcccaggcctggcccctgccctggcacagatggtaagtcttcaacacatctttagtctctctcagaggaaaaccccaggacctttggcttgtcccctaagcctgcatgggagtcccggaaggtccctgtggggtgagaggggctggggattgaagctgttgctccaggacctgactccaggtctcccgggaggctcagggctgctcccagcctcga

SEQ ID NO: 2510 - DNA, 674 bp, Homo sapiens
  misc_feature (504)..(504): n equals a,t,g, or c
gaattcggcacgagggcactcagagcccaatgaggaagaaagacacatgactggctggcaaagccctattgtgaggggcacggagggaaggggcgggaggaccccgggtcggctgctgggtggcctcgtggtacagagacctaaggggtgggaaggaggccctcagggaggagcagaggctctgtaccgacaggtgggctggcccctcatccacccatgtcctctcctggagcctcagtctgtccatctgtcaaatgggcagagggacagcaccatctcatggagctgtcgtcggggctgcaggctgtgaatctgaaggcttggcacatgggaggtcctcacgaggatgasattcttcgctgtgttgtcgagttttcccagcagagggaagcgtgcagargcgcagcagagcctggtgtgctggaggaacagacgtgtggtcggggggctggaggcacgggctgtgaagtgaggtaggggttgagggtcaggttttgctggganagccttgacttctgtctcacagcggaaaaccagagtccttcaagcagggagtgactggagtcccaatttggtttytcaattatcagggaggagggtgagctytaggggttgccagggagatgggggtytaccgtggtgggtgcagggcttgctggaactgttytggaggt

SEQ ID NO: 2511 - DNA, 1030 bp, Homo sapiens
  misc_feature (431)..(431): n equals a,t,g, or c
gcactgggggcactgccttccttctcatgcccaacctcctccatttactgctttcacctagaagatatcctagtgtgtgtagggtaagtttgggtgagtgggccatggtgcacagagtttatctgcttggctgttttcactgttattctccaaataatgactctgttgcttgtcttcatattccttcctgttgtgggattccaccagttctacactctacagcagaactctgccattcatagtcaaggactgcagattccctcttcaatctcatctttgtgtttcttaaggatttcctggttgtcaattttgagttctcctttttgtttcaaacttaactatccatgtttcatgtgcacctatttgtttattatgcacaacatttctattatttttagggagttagcatgggaagggaagatgaacatgtnatctgtctgatatttttaaacttgargycctgkttcattttcagttcatgccctgctcttgctaagattgacttgtaatggcagtactgtgactgggtagcatgtaatcactgatgaasaagaaagctggttagattttgggccatttgcttccacattactgcctatactgtatgtcatcagcaatgtgttgaactggattcagttgaactggaaaagtatgggtggataaggtggggctgaggagttgcttatagtggagtaatatctatgcacatctgtacctgcttaatttttctttattcagtcattgtcttatctgaaatatgtatgtttgcctacacctattgcaaattcaaacatcaaagtattatatatagtaaatgaaatttactaagatattatcaagtattaacaagtgttttagacaattgtagagttttgggggaaaattgttggttacaatagggaaataaaacgttacttttcagtctgtattggattaggttagaccagagaaaaagacatgatgaggtatagttaagaaggaaataagaaatttaggaaaatatttatgactttgcctaacctagtctcga

SEQ ID NO: 2512 - DNA, 601 bp, Homo sapiens
tcccccgggctgcaggaattcggcacgaggtcggcacgacactgccccaaaatcaaaatggctcaagtccactttcaaaaatgtcagtgctcaccaacagtgggtgaaaaggctgcctgacccagcttctcagagagccagtgcctcaaatccaatgcatggcaattgctctggggcccctggttttaagctggctttgttatttgtggctgacactggaaagcctctgcacaaacaagatggcaagtgatgagccggtcagtcatcactgccttcccagactctctgaaccacccttgacattctgcctggaagcagggggcttggtggaggtgggtgacctcttgaagtcccgggccaggcctgtgattctgtaatctttgctttaccataattagggagggaggcagaagagcaggaggagaaaccatttattacttctctgggattttgacagcttggaaaaagagagagacagagaaacagtccagagaaggagccagccacagtgagtttaacctctcagtaaaataaaaatgggctggacgcacctcatcagctgccctctgtcaatacccgggcccatctggcaggactcgta

SEQ ID NO: 2513 - DNA, 598 bp, Homo sapiens
gaattcggcacgagctggctgcaaggtctgttgggggagggtcctcacttgacccttactggggtcagtgtgggtcaagggttaagtgtcaccctcggcccttgggagcctcattgctgagggtctcagcgcttaccactggtcctggcgtcacggactgtggagctgggggcagcccgtggtgggttttatagcaagtggtgagatgtgggcgctgtgctccaaaccagaccccgttaagtgccacatggtcaacagtttagtgtgcagaaatgaatttccttctcttaatttttccttatttttccagcctgttgggggaggtggaggtggtgaaatgttagcagtgaccagttcatcctgatctgcttgggaccttccagttttagcactgaaagccccacagcccaagaatcccttggatatcaaccacggttcctccttccagaatgtcccaagagccttagggcctggagacacacaggtgggggcctgagcccctgtccccctcctccagatggagcaggcagggccccagggccccagggctcacggtgttctggggtccacagtgtgctgtgcggccaggctggtcttc

SEQ ID NO: 2514 - DNA, 481 bp, Homo sapiens
  misc_feature (322)..(322): n equals a,t,g, or c
  misc_feature (365)..(365): n equals a,t,g, or c
  misc_feature (379)..(379): n equals a,t,g, or c
  misc_feature (390)..(390): n equals a,t,g, or c
gaattcggcacgagcatagtgttaaccactagaattcactgcccttcctatccaaaaatgacactactgatcatttttcttccttttscttttacaacattmacaaattcaggtggctctttcccagtacggtaggctgattcgtatggatgcaccacggttggtgactccccccaccccacagagtttctggcgttcattcggttgaacccaaggccagcaagggctgactgggaacaaaccgaacactaggccgtgaaccaatcgtctctccgtgcccgggagcgamcccgggggcctttcactctcccaaggactccangggggggccgggtacccaattccgcccctatagtgaatccgtnattacaattccacntgggccgtccntttttacaaacgttccgttgaactgggaaaaaccccttggcggtttaccccaactttaatccgcctttgcaagcacatccccccccttttc

SEQ ID NO: 2515 - DNA, 925 bp, Homo sapiens
ggaaatagtaggaaagtggagcctccagaaccaagagagacaggagtgggaggcaggctccagcacgtacacatggaagagaggtatgaactctcattgccatgggcagagccacccagaccactgctgagcattctgggaagctcccagggccctatcagtgcatggcatggaagctggaatcactttatttgaatagtgaagtctacaacaacctctgaagtctgaagacgagaatccttcaaggtgacaggccttggcccatccctgaaccctttccctcatcctcccaacagtccttccccaatgcctcattttcttctacttgtagcaaaaaccattctkatcaactcagaaatgaacatgtctccagagtatagccaaacatgtctccagaatacagccattcaacatccagtaatcaaggagaaggatatgcagccttgggctggcttgtgccctctgcttgttttgtggatatctggtcatctccattgtatatcagcactgctgcaggagagaggtgtgggagtgtcattatcttctagatcagatgcctgtaaagctgcacacagaattgggaccagctccagctaaacagtgggttgtagcatctactgaggattgcaaattaggacaaatcattatcttctccctctttctctcttcctcagctctttctcaatctttactacccttttacacacacacacacacacacacacacaaacacacacacttagactagaagagtcatttaacatgagaacatgaacatctagagatatggtttggctatatccccacccaaatctcatcttgaattgtagctccaataattcccatatattgtaggagggacttggtgggagataattgaataataggggcagtttcccacatgtgttctcatggtagtgaataa

SEQ ID NO: 2516 - DNA, 978 bp, Homo sapiens
gccaaaatgtactgcatgccaggcgcattccattctcagaaatacagagacgtcagtgtctttggctgtaacaaaacagcacagcctggggtcttcagcaagacatttattttcccatacttctccaacctggaaatccaaaatcaaagtgccggtggattcgttgtctggcaaggaccttccttctggcttgcagacggcctctttctcactgcctgtacatggcagagggaggaagagtgcaagggagcaagatactcatcccaccatgaggccgcccccatgacctctgctaaccccagtaacctcccaaaggcctcatctccaaataccatcacatcggggttagggcttcaacatgccctatccttgcaacaaaaatgtcatgcaacatttttggaggggacacaattcaggtcaaggtagttaattactgatgttaccttcatttcatgaacaaagaaacagaagctcagtttaagcaacttgcccaggttcacacagccaggaggtggcagtgttggaattcaaacccaggtctgtctgaatccaagatccgtgccatgctctctgcccctycttcctgcccctgaccactaatggcaggcgccaacagtccagccatggggggagtttggcatgatcaatgaaggcaaagaggaacaaggggagatgggtggcagcagggccaacggcagctactgcatggattgttctaacagtgcaagctgcctgccctgaaggtaaatgcccactgcctggagtctgtgccccgatcacctgggcccccagttatctaacagctggaaaggcgaagctggctgggccgaggacttacaagcctgggccagtgctaaaggcagcacaccttcccatggggcagcatccacacaccaccccctggtggcagcctttgttcatcatctctgtgagcagataccctccccgcactccaaagcagcactaatatctgacctc

SEQ ID NO: 2517 - DNA, 940 bp, Homo sapiens
  misc_feature (726)..(727): n equals a,t,g, or c
ggcacgaggagtaatgaggctgaggaccagacaaaagagcagaaggcagaggaaagaaaaaatgagcaggagaaagagcaagaggaaaatgaagagaaagaggaggagaagacagagagccaggggtcaaagccagcctatgagactcagcttccatcccttccctaccttagtgttctttcaggtgctgacccagagctgggttctcagctccaggaggcagctgcttgtggtgagagctggtccccacccaccctggcccctttttgacttgccccattctgtgaccccacaggcctcccacacctcagtctaacttcagttcccatccttcatcccaggcactaactatattgaagcgtcttgtgggaaccctcctatcagccacagggaagctggtcagagccagacctcgtgcctggggaatggggatatgggtgctggcattgtgggtagggtgcctttgctcctctacaggcctgcctgtggtactgaccaatgtggagcttggtctaaggtgcgaaagaactgcaatggcttgttgcaacgggagcagcttagtccaccccaggtgcagcctggcttctgtctgtatctcagcaccaccctctccctctgtgccatggaaaaaggtgaggcccagagggcaaattgccagcacagttgtgtggacacactaggccctcagcaccagccctaagagggcttcactcaacctggcccagnncaggcacaggtctatagcagggagccatactccctgtctactctaccccctggctctgccaaggggaagaggttaagcatctcccatgttaccccaagtgctaggttgtgaactgctaaaggggctgaatgtgttggatctgggcctgaacatggaaatactggaagaacagatgctgcatgaaatcttgtgcagagagtatcctgaactcga

SEQ ID NO: 2518 - DNA, 638 bp, Homo sapiens
  misc_feature (573)..(573): n equals a,t,g, or c
  misc_feature (605)..(605): n equals a,t,g, or c
  misc_feature (613)..(613): n equals a,t,g, or c
  misc_feature (624)..(624): n equals a,t,g, or c
  misc_feature (630)..(630): n equals a,t,g, or c
ggcaattgcctcagttgcctaggctgtgggagtttgtgatggcaatgctgtagatgagggtactgagctgatttctggccaagacatgtacaggctaaaatggctgccaggctgtctatctggttttccagggaggcagtagttgctgctgtggtggctgtcgtgctgggctcaggcctttgccgcggtggcctgctgggcagctctgtggctatgtagggaaatggggctactgcctggttggctgttgctttgggctaggctcaaatgcttttgtgcagtggggctgggcagtttggcagcagtctatggtagggggccagggctaccacaggaccagttggactgtgtgctgtgggactgtgggactctgggactctatcgtggccagttttaggggacaggaccactgaattaccagctgtcaggcagggcgtgggcaggtggttctgtgatgggttgtgagggagtrgggctgccgcaggattggctttttggctgagtactggcgtgwrcatacttggcagcccagatggttgtatggaacaggggtgttgggtaaagcgctgccanctggtctaatttgaatggcttcctttgcctgntgcaatgncttgcctggtnttcctnggaatggg

SEQ ID NO: 2519 - DNA, 715 bp, Homo sapiens
  misc_feature (354)..(354): n equals a,t,g, or c
  misc_feature (618)..(618): n equals a,t,g, or c
  misc_feature (637)..(637): n equals a,t,g, or c
  misc_feature (646)..(646): n equals a,t,g, or c
  misc_feature (694)..(694): n equals a,t,g, or c
ggttttaataacaatttcttaaaaccccttttaaacatatattcactgaattcaagagaagtataacacatagttgctccttccaagggggcttactgtatacttaggatgaacataattaagtaactaaagatgcataaataactataagccttccatgtggtaccaaagagaagtggaatgggagttagggaaagcagaagctactgagggaagtggagctcacagtgatcttcaaggaagttaaactggagttttaaagatgggagaaacacttgtgtcagtgtttctgaaacctccagcactgacttggctgcttagagctatctgtttaatggtccagacatgggctgngggacagagatcttggcctcaaagcctggctctcccatgttacctaaacaggtaattttagtaccccatatttcagtttcctcagttctaccagagaatgaagtgaataatagtgcatactttatagcgctgttgcgaggatcagatgaattaatactgataaagtgctaccagcacttattaggtactcgatacatggtaggtattattttcttgcccactaaaatagcatttatccttgggaggtgagcttcaagcccaagnagttcgagaacagtctggncaacatggngaaatccggttctattaaaaataggaaaaaattaacccgggcatgggnggcaccgccctataggttcaa

SEQ ID NO: 2520 - DNA, 662 bp, Homo sapiens
ggcacgagcaagcctggatgtccctgacgccacccactccggttctctttctctttctcagcctcctgtgggctcggttttttctgtccaggcttaaatgcccaggtggctgtctctgctggcccttacttctctcacggggatcctcagcggcaccctgggcttcagtccccatggatggagcagcccacgccgccatctcagccccaggcctgagtgtccagctgcttcccagacaacttgcaagtccctcggccaacactgagctcagagtcctcctcctccctgccagggtgcgccactaccttccctccagttttcaccaggtcttgggttcatcctgactccctccttcttctctccccgtccctgccacacctcactgctcacaagaaagacatcactgtgtccgttctccttttttcttttcttttcttttttttttttttttttgagacagggtttcgctctgtcttccaggctggagtacagtggtgcgatcttggctcactgcctcccaggttcaaaaaattctcatgcctcagccttccaagtagctgggactacaggcacgcgctaccacacccagttacatttttttgtgtatttttagtagagatggcttttgccatgttggccatggctggtctcaaactcctggc

SEQ ID NO: 2521 - DNA, 1431 bp, Homo sapiens
ggcacgaggtcatcggcactgggagtgccaacagctacggcctctacaccatccgtgatagggagaaccgcacctctctggagctatgctggttccgtgaagggacaaccatgtacgccctctatatcaccgtccacggctacttcctcatcaccttcctctttggcatggtggtcctggccctggtggtctggaagatcttcaccctgtcccgtgctacagcggtcaaggagcgggggaagaaccggaagaaggtgctcaccctgctgggcctctcgagcctggtgggtgtgacatgggggttggccatcttcaccccgttgggcctctccaccgtctacatctttgcacttttcaactccttgcaaggtgtcttcatctgctgctggttcaccatcctttacctcccaagtcagagcaccacagtctcctcctctactgcaagattggaccaggcccactccgcatctcaagaataggaaggcacggccctgcaatatggactcagctctggctctctgtgtgaccttgggcagctccgtgcctctctctgtactccctcagtttccttctctgtacaatgtggctggggagggagaggatgggaccaggttggaccacgtggcatcagaggtcccatccagatccaactataggtccaagagtccacgtaagcaggtttgcaaggctctaaagttcctatagtcctgagaccccctgccagcaaagagtgacagtcacctccatgccctgccctcattgcaaagccctcactcaccttctggtctcagcaagggaggagagtctgttgctggcatagccctggaaggagcccccagcctctcccctcctcctccttgtcactggcctcccacaactccccttctggctgcctgtaaccttgaggggcattcaggaggccagcgttccctcaggcactgggggtttgttttggggggtgggagttgatcctcccacccagtctgcccctggtctctgcccatccaatcagagcccaccctcctggaagagacccccgtgttcagagtgctggcagccctgcacgtgtccagggacactgcatttcaaagaaccactgagtgggtgagctaccttgggcaaaccccccactcctgactctgactgccacgtgggtggcccgacctctgacctgctgtcatcgtagaggtagaaagcaaacaatctgtggctcagcacacctgggggtgctcccactcattcagtgtgtggggcccctgagcagaggctgggcattgccactaggacctgagctcctagagaacaaggacctgggtggcctcgcttactgttccagcccaggccaagcacagggtctggctcgtggcaaaccttgaataaatatttgttggctgaaaaaaaaaaaaaaaaaaaaaaaaaaaaaaaaaaaaa

SEQ ID NO: 2522 - DNA, 607 bp, Homo sapiens
  misc_feature (567)..(567): n equals a,t,g, or c
  misc_feature (571)..(571): n equals a,t,g, or c
  misc_feature (580)..(580): n equals a,t,g, or c
  misc_feature (598)..(598): n equals a,t,g, or c
gcaagtatctgtttccagccaacatctctaggcttgtatgcctggtagggggacagtttcatttggaggccacacatgtttcagatttaagggatttaaaacaaattatctacctccttaacctacctttttcattttccctctactcatatgtggcagtaccatcgactcagctgtacagcctggcagcctgtgattctctccttttctctctcagttggtcaccgaatcctcctggctcttttcttttttattcttcatctttctattctcattgccactgaatgtagaccttggtattcatttcacctggtctccttgccttcgttcttgcctcagtttctcctctgccttgctgkcatttgtctctttggcttcactacgctgctgttttccttttgttgccaagtccatgttttgggacactgacatgtatggttattgacctggccaagccttatcctccgcttgacaccacacccctgtgttacatccacaccataacgctttgcggtttttcaaaaacaccaagttgttytatatttccatgttccaggggtccttgcnattngatgaattngttaatcccccaaatctnagctagaaa

SEQ ID NO: 2523 - DNA, 2095 bp, Homo sapiens
ggcacgagtttctctctcgtctctgtgcgtccgcatgtctctctttgtatgtctctgtatctctgtgtgtctctacttatctctttgtctctgtctttaaatgtctctgtctcagtatctctaaggctttgtctctatttctctcctcctctctctgatgctatctctctgtgtctatcactgtctctctctgtctctccctttctgtctccctctctagcactctgtttcctctgtctctgcctctttctggcccagtccagagcccttggcatgaggacacgggtgagtcagggctggctgcaattggacacctcagggataccagccagtcctggtccctctaaaggggagcgatatgtgtactttcggggtggtagggggtgcgggtagtaatctggcggtacattctgtcccggccccttatagggaatttactctcagttggacccacctccacccttacccccaccagagggctgttcctggcaaagcagagcagcttcaccatcaggcacaggacatgccagtttcgagagacgtttaggatttatgtgcaaccaatgaataaggcaagtattacatgggacatttgactagtttatcttgatcactaaatgtctaggtggtcacaagacaacctgacagacattactgggagaacttgatatttggaggtcacttacatttgagcaagggtagcattcatgttcacctgcgcatttgaggggcatggggactggtgtgcccagagcctggagggcccccacgtggcagccaagggaggctgaggagccaggtcagtttccacagcactggctcctcctggtcagggcagacctctgctgtcatagcctgagcaccaaggtgtggcccaggagaggatccatggctctcttgccatctggccctgctcctaggtgctcacaaaagtaatgacagcagaggggatggggcacatcctgggcacagcgtgggggctgatcctcccagcccaaggctcagcaaccacaaagggctgggtcagaacaagcatgcggtgtgtcgtcgggtgtgaggtggaggaaatggccatctgtggcctgtggaactcagatgggcaaagagaacccatgaaaggcacctgagtggtgggtgacatgagcaaataatgtctctgtagaaaggcaaacccggcagctctgcactgggtgcatagaattagaggcatgacaggccctggaaaagagactgatctatgaaatgcagcctccaagcgcagatctgatctgagaggatccgcaactccatgaccctgcagcttggtagtgtgtgcacctgtgtgtgtgtgcatgtgcatgtgtgtgcatgcgtgtgtatgcatgtttgtgtgtgtgcatgcatgtgtttgtgtgtgtgtgcatgcatgtgcgcatgtgtgttctgacttgtgtcttccactaaacttccatctttgaccactccccttccctccctgctccttcctgcaaatccactcctgggagaccctgaagaaagggtgggcaaataacatggagctaaatctttcaaagctgggggagggaatggggtcagaagactggtgccaatcaaccttctttcccccacccatgaaagtgaccaattaagagattcagcaaatcccacaggtgcttgttcatgcatcagccgtgttcacaacagcccataaactcctcaattgttcagaccagctatggtacatccacacaccggcatgccactagtgatgaaaaggagctgttttcatagcagttgaggaccctgcgggactctattcctgagcagttctgcaaccggctaaaggctcctggcaatagaacacacatcagtggttgccttgggggaggccaggacttggggggacctgagagagttttctgggatgatggaatattctgtatcttgacggtgtggtgtttacacaggtgacaacatctgtcagaaatcaatgggttgagcctttaatatctaccttattgtatgtaaattctaattcaagaaaataaaataggctgccaattcagaaaaagaaagaaaaaagagggagcaggaggcataggatgtggcctgactt

SEQ ID NO: 2524 - DNA, 704 bp, Homo sapiens
aggaattcggcacgaggggcctgtgccatccacccctgccacttttctggcgacgtccccattcccttttcccttgcacaatggcctcctggccattcctcagccccatgggcccaatcgccttagctctcctgacacaagccctctcatctcccgtaggtctctgtttagctctcacttgctcacggagaccctcccctgattccgtttgtgcatcatgcaggttcccccttgtccccctgtgctgccagccctccttacccgctctgcttagacctgtcagccactgtagataccctggaacttccctgggtatcatgttgattgtttattgtctatttctccccatgagaatgtcggactgtgagggcagggacctttgtgttattcgttgccgtgacccaagcccctggaacgatgcctagcacataatcgcaggttctcaaatatttattgaaaggatgtttaaaagacaagggttgtttcacaggatggttcgtgaccagtggcaggttgtggtcctgtgcagggcaatggggcctactcctccacctgccgtggccgtcgccccagaccgagctgccaccgttgtttcccagtggatgctggagtgtcatcatggggctgtttgctctgctgatttataccacactgttgtcacttctccccatcaaagccaggatgctctttaaaacatgcaaatt

SEQ ID NO: 2525 - DNA, 521 bp, Homo sapiens
  misc_feature (406)..(406): n equals a,t,g, or c
gattgtgccactgcatgaggggcagagtgagaccctgtctcaaaacaaaaacaagaaaaaccaaatgctccttgatgtaccaaccccacacacagagctggttcccctggtgcttgatcctaagctcctcccaggcagggaccagaggactcagttggcacttagcaaacgcacctgtaaagccggggatgggtttggcttttgcgctgattagacttgattctctccttacttgttatctcccctgcmtccatgtcaggctggtgagagctcacacatgcacctctccaacccgtccgcttctctcttatcagtctgtgcctgcagctagcatgatctgcccaccctgtgaaatcccccatggagaagggagtttcgaggtggcaggtcggtccacagaaatgtnacatctgcctgtggagataccccgtctgcctggacaatgtcaacagagtcagaaaacacacccccttgcatggagctgaggtgtgtcagggaaatcttgggaacccctccctccc

SEQ ID NO: 2526 - DNA, 1898 bp, Homo sapiens
gaaaaaaaaagatttcctcctctgtatgttgcagtagagtcctcttgagcactataattattttaattaaaattcaagttgtatgtatcctccagtagctccctctttctgggggtgtgtctgtttcttctgggcggtcccccttgtgtgttgcagagactcttggaaggggttatcactcttcgttggctcagggggcctgggtctggtggagcactgatggggttagtgggcctgccctggtgggagagaaggcggctcttctgtgtccagagcggaccccgcatgaccttccctttacttgtgggctctgggacttgcagcgccacctgctgctttgcccctggagcctgggaatccaggcggagcactcaggatggggctggttttcctccagggcccgcagtctctccaggccagcctcccctgaggcctttggctctaagatcctcatcctgaggctctggtgctggtctctccagcttgagagggaagaagccctacactggacctctccactgggaactacactgagtgcacccagccacttcttctcagtgctgtagagacagaagggggacaagtggagggtgagargcgatgttgggctcaamcatcttcactcagatacctgaaaggcttgatctcaaggaaaagagtaaacattgacagggcagcactccacttaaattattttatttcacacttaggtttaagtattgttatccccatgaaacagacgttgggagattaagacacttcgactgtaagtattagtggtagagtcaggaattgaatggggtgtgctttggtcaaactcttaggtgcttttgcatccacccatgtttctgttagagaagaggcctggaggcatgcttgccatagactaagcacttggtgttagctgttcttgtctgataggactctaacgacctcacaattacacaccgatgggcagctgggaagaaaatgatggagtgatgtgcggttcacaaaggcttgatcttgtagttgcttggatgaagacaaggatccattaaaagcaggtctccctaacaaacctcattctggaacatcaagttcaatggtcatataagcagttgctcaaagctaccatatcattggcagagagtcacatgtgttctaccagactaaatatataatcattgagacatattaaaatgktgctggctgggcactggggctcgtgcctatcaacccagtgctttggaaggccaaggtggaaggactgcttgagccaaggagtttgagaccagcctgggcaacatagcgagggcaagccaaggagtttgagaccaacctgggcagcaaaatctctacaaaaaattttaaaaattagccaggagtggtggtatgtacctgtagtcctacctacttgggaggctaaggcagcaggattgcttgagcccaggagtttgaggctaaactcagaggcaaagccccctcccccaacagtgagctctcttcacaccactgcactccaactttagtgacagagcaagaccctgtctataaaataaaaagttaaaatgttgctattgctatcattaaaagctttttgtttgggtctgtagagatagcttctcactttctatctggagaagcgttcctggaccttcctcgagggcagcgaggagaggcgttaggccacgtggacttctgtgggcctgcctaggccgtgaactcccaggcccactccctctagggtgatgacttgtgtgtgaacacggatgtcagtttcatttagaatcaactcacatggaatctgtagctcacaagaaatgtggttacagaatatgcttagtaatgcttggcatgttcatttctttttttttaaggaaagactggaaaaatctgagcctgaaagtttcatctgg

SEQ ID NO: 2527 - DNA, 1747 bp, Homo sapiens
ggcacgaggcaccgggtctctttgtcccacatacatttggatgaatgcgtgcacacatactcttataccaggactcagggcccccaaccagggtatctggtcctcatggaacagtggaggcctcgtctctcccctcctgccccctactctcccccaccatctctcccctatcttgaagttgtgccaccctctgcttggcctacaggcccccatccaaaggtaaaagagctgggccatgtgcaaactctcatccttccaaactctcctcttgcctcctcctcctccaggcagtccacttggatatctatggttgggaggtgctcgatcctgtcttctacccctcagaggcatccctctctcagctgggagggtctgggaggttgacaaccaacaattggcaacaattaccatttatggagcacacactatgtgccaggcaccacattgaacctaagtacagcccaagagatagacactggtttttgcccattttacaggccaggaaaatcctgtgcttcaggtcgcaagattagaacatgtagagctggagctcgaacccatttctgtctgacggcaaagcctagcccttgactccgctcccgcagcctccgtctgggagctcttgaggctacacaagacattccaggccctagagagactggagcaccctgttcccggcagagccctcggctctgagctcggcccagcatcaaaacatctcacggagccccagctcatctcatgagctaccccatcccggcccacacctgggcacacctcccaccccagcagtgggcatgaatcaggcagggccagagccggagagaaaatgccaagtgccatgaaaacagggcaccaggccggagcagggacagagagctatagcttcgcagggacagaggggtggccagagtgacccagagagaaagctgggggaagggggcatcagggaagccccagccatccccctcccatggaaggagtgttgggggagctatgcagatacagaagtacaggaacgttcggctgcttgtatggccaggaaaatgggcgtaggtcgctgcgtgtctgagagcgggtgtatccgtgtgtgcggccatgtatgtctttgtgtgtgtcagcaaatgtcggcatgtttgcctttttatccctgtggcaaggagggggaagcacgcattggtgcatatttgtgtgtgtgtgtgtgtgtgtgtttgaaaaggtatttgtggccgggtgcagtggctcatgcctgtaatcccagcactttgggaggccgaggcaggtggatcacgaggtcagaagttcaagaccagccgggccaagatggtgaaaccccatcttcactaaaaaatacagaaattacccgggcgtggtggcgggcacctgtaatcccagctactcgggaagctgaggcagagaattgcttgaacccgggaggcagaggttacagtgagccgagatcacgccactgcactccaacctgggcgacagagcaaggctccgtctcaaaaaaaaaaaaaatagaaaaagaaaagttatttgtgtacacacctgagcgagccaactgcattatgtctctgtgtaaagatgtgtatccatccatctgcctgtccgtccttgggtccatgtgagcatgtgtgggggtgaacacacatttgtgtctacctgtatccaagcatgtgctcagggctccatgagtctgggaggtgtcgtggtctccatgtgccttcgtcgctatctgtatcat

SEQ ID NO: 2528 - DNA, 994 bp, Homo sapiens
  misc_feature (292)..(292): n equals a,t,g, or c
  misc_feature (381)..(381): n equals a,t,g, or c
gccggagcagaggccgcgcggcagtgctggcatgtgggtgggcggtggtaaggaaggcggtggatgaggatgcagggagcagatgggctgcgttgcaggctgggcccctatggccctcaataggttttgtggtcaacatgctttgtggagttacaacaagcaatggtggccctaacacatatattcatttataggtccataaatctgcattcatagagataaatgagtaatccccagggtgaaggagaactggaagagacactggagccaggtccacccttggccaggtttnaccttgactcggcgtcatcactaggcactggtttttttctctctccttcttccctgaccaagaaatacaacaaattcgttatgatatcnacttgtcatgatccgaaattgaagagcaaccatatatttatttggcaagataaatacacacattctttacataagattagtagccaccagtttctaaaagcatatattgtcatttatttgccaaaacaaaatacatgcccacatgttatagatgggaaagatgaggcccagagctcgggtgcatggctgaggtcacccaattagtggatggtggtgctggcacttctgtctgggctgcttcaccttgtcacacactctccactccatgcaggccgcacctctctggggcctagcagggtttatcacccagcttagtatcactagtacccagcacactcactctgtgaaagacactgcaccgtgatctgtagggtctaaagctaggggtccatgtcacatacagaatggcacttttcacagaaagagaggacagatgctgcatggctggtctcagtgttcattctgaacccccacactccggcgtgagtaccaaatggtcatgagcattgatggagcacacagtgtaccctgagttctaaagacgcaggactgtgtctgagctgccataacagaataccatatcaggtagctgacaaaaaaaaaaaaaaataaa

SEQ ID NO: 2529 - DNA, 619 bp, Homo sapiens
gcggcacgagtgatatttcacgtcacatggctagtgagtgggtaggcctctcttcacttattacacttctgcttctaagctgtgttctttcctgtattacactggaggaaggagaaaaagaacttgtatttggtccttgactgggtggaatatcctttaatgtggctgtaaggacatgggtagaatactctggtcaattcatttcttatttaaatagtgacaaaggtatgtccatgttaaccatttctcacttatgctttatacataaggatggcttatagggaatgttgctttattatatcacttaaaatgtttggtcaggcaatagtgactcatgcctttaatcccagtacttttgaaggacaagtcaggaggatcgcttgagaccaggaactcaggaccagcctggacgacaaaacaggatctcgtctctacaaaaaataaaatagtcgagtgtggtgatgcagtattgtagtcccagctatttgggaggctgaggtgggagtatcgcttkagaccaggagttcaaggatatagtgaatgatgatcgctccactgcattccagcctggacaacaaagcaaaaccctatttctaaaaaaaaaaaaaaaaaactcgta

SEQ ID NO: 2530 - DNA, 1113 bp, Homo sapiens
gaagatttgggagcatctgaagagccagaggagttagaggctctgaagcacagtgacttgatgtctaagctgtttctttgttcatccccctggttggcttaaatctaarctgtctctttgcttgtatgatcatagtctcctgtcatcggtttataagattctccaaattcagaatgcgcattgcaaattcctcatggtaggctggtgaaggacttgacaatctgatgataaattactttgtgaacatgaatgaaaaatattgcatcatatattggtgaggagaaagtggagtaaagaaaaatctccatctatacacaatacagctttttaaatgcagcggactttcaaatatttgcatttctacattatacgttttgtttcaacttacgcatttattgttttctttcctttttcttcctcacatgttaatggcccatgtgagaaaaacattcccctgggtaaatagatagaagagatttgtgcaaatgcaagagaaatttcagtgtatctgctatgatttgaatgtgtcccccaacgttcatgtgttgcaaatttgattcccaatgcagtggtgttgggaagtgaggcctaatggaaggtgtttgggtcatgggggcaccgccttcataaatggattaatgccattattgtgggaatgggttccttataaaaagatgagttcagtcccctcttgctctcctctcaccctctctttgcccttttaccataggctgacacagcaagaaggctcttgccagatgctggtaccttgatattggatttcccaggctccagaactaaaaagaatgaatttcttttctttttaaattacccagtctgtggtaaatttatagtagcacaaaacagattaagacaatatgtctttcagatgtcttagcttatttcattggataactgtaagaagagtttactgcttttctttttttgaaattaagaatttagctgaatgctgttgctcacacctgtaattcccgcactttgggaggcggaggcgggctgatcacctgaggtcaggagtttgagaccagcctggccaacgtggtgaaactctgcctctactaaaaatacaaaaaaaaaaaaaaaaaactcgta

SEQ ID NO: 2531 - DNA, 596 bp, Homo sapiens
cttttcacccttagagacagggtttcacttttttgccttcttaatggagatattcagttttctttttttcatttaaacaaagaaaaaaaatgtatctactctaccttccctctgctctcctccctccctatcctacttgcccatatgagcacggctccccatggccacatactcctgcaaagcttttatgctgcttcgcttttctctaaacagatctgatattgctgctcctgtggttttctcaaaattaactttgccgtggtttttaaaaaggaatcaaaatgcattgttgcattaagctttttcaataaaggaaaattacggaaggaaaataggcaacaccagcaaattatatgtggacaggttctaaactctatatatacatatatatatatatatctatatatctatatacgtaatcatctagttctgtcatcttactgaaaggaataacacttctaaagatcaccatttctgagaagttcttggaaatctttatgtctaagtgattgtattagatcagcaataatgactatgtaatctcaaaaaacaaataaaatattcttaacatggaaaaaaaaaaaaaaaaaactcga

SEQ ID NO: 2532 - DNA, 997 bp, Homo sapiens
agagagtcctcaacagaacctaatcatgctggcaccctaatctcatacttctagcctccagaactgagagaacataaactccagttgtttaagctacccagtctatggtatttgttattatagcccaagctaagtcaggtggaaaggcagaaatattttgagaagartcatttctacaaaaacagagttgttctaaatgaaatggccagatatttcatcttcttcatactagtatttatgaaagtttcattaaacaccacttggccagcacccaggcctgccaccctcagaacggcaaacaaaagcaaatgatttgaggaacaaaagagtggacacagagcctctcagaagatggctccatcttctgagatgatcttctgagatcatcaattttctgcacctgatgtcctactccaattgtagtagataagagcaaagacacttcctgatcctgtggaaaatgctggagccctgctgatggagaggctgacactgggaccaacagaaggccggacatttatttgctgcagcccttctgcacctgggccctcttcaggccttgtaccttgcactccccatgccactgtagcacctggtaagctgaagttaggtatttgaagagataatttgcccccaacaaagaattacttaaaagaaaaaggaaaccactaaattccacttgacaaaccagtttgttcagttttgacttttgcaaatttgaaactttctctttggcaccatatgattctgttacattagggctcatcaatgctaagatacacagctaggtctaccagctgccagtggtcaagaatgaaagaacctctcagagagagatcagtttctaataacctaacagttttccttggstattacmaaaaaaaaaaaaattagaataaaatgtcagtgccatgcaggcaagtacagatatggaaatgaaagctctgtctacaactgcaagatttgtttgttaataaaattgattgggatcactcga

SEQ ID NO: 2533 - DNA, 734 bp, Homo sapiens
  misc_feature (396)..(396): n equals a,t,g, or c
gaattcggcacgaggtgaatttaatttcccctaatgacttatggtattgagcatcttgtcatgtgctcattggccatttatagatctactttagagaaatgtctattcaagtcctttgcccattgttttgttttgcttcattttttattttaggttcaaggggtgaatgtgcaggtttttacacgcatgtattgcaagatcctagagcttgggcttctaatgatcctgccacccaagtagtgaacatagtacccaatagggagttttcaacgcttgccctccttctccctccccacttttggaatccctggtgtccactgttcccgtgttgtgccatgtgtccccagtgttgagctcccacttatgagtgagaacatgtggtttttggtttctgtntctgcattaattcacttaggataatggcccccagctgcatctatgttgccacattgtacatgatttcattcctttttctggctgtgtagtattccataatgtatatgtaccaattttcttttcttgtcttttcagagacagggtctcactctgtcacttaggctgaagtgcagtgacatgatcacagctcattgcagcctcaacttcccaggctcaagcaatccccctatctcagcctcctgagtagctgggactgcaggtgcataccaccacacctggctaatttttgtatttttggtagagacgaggtttcatcatgttgcccaggctggtctcga

SEQ ID NO: 2534 - DNA, 701 bp, Homo sapiens
gtttttgtgtatctgtcttaggcttttttatttgaggttaccattaagcttgcaaataacatgttataagccattatgttaaagtgatgacagcactgattgaaaaagaaaaaaacaaattaacaaacaagcacagagataactaataacactacatttaattttattcccctttttaactttttatttatttatatattatagtgctatgtcttgaaaagttgttgtagttattattttgataggtttatcttttagtctttctacacaagatatgagtagtttacacactacaattgcagtgtcataatattctgtgtttgtctgtgagttttgtaccttcagacaatttcttattgctcccttttctttcagaatgaagaactccctttagcatttcttatagcataggtctggtgttaatgaggtccctcagctttttgtttacctgggaaaatctttatttctctttcacgtttgaagtctatttttactggatgtactattctaggatgaaagttttttccttcaacactttaaatatgttatgtcactttctcctggcatgtaaggtttccctgagaagcctgctgcaagatgtgtgggagctcatttgtatgttatttgtttcttttctcttactgccttcttttaagattctttctttatccttgacctttgggagtttgattattaaatgc

SEQ ID NO: 2535 - DNA, 1126 bp, Homo sapiens
  misc_feature (1124)..(1124): n equals a,t,g, or c
ggcaggactgcatgactggcaagctttggctgttgctgcctaggttgggccatgctgcagccgcccccaccactgcactctctggatcagaactggaaggtacctcgatatctttgcttatagcattggacagatgaagggctggttacctgtcaggaagtgaagagcgtggttaagagtcctctatgctaggttgtcacagtcaccagctactagactcttggctacaacatttctcaccaagagcagtgtccttggggaaaaactaaacagggatgagaaaggggttaggaataaaactytctcctagagaccaggtcagaatacataatgggtttaacttcgcaataaagtgacaaggtgcacttgaataagccaccctgatacacggaaagcactgggcacagaagtaactttcccattgaatcaggagttgatcccataaaccttactattagccaagtttacatttatgaacattttacacacactactcagttatatattaaagacaaaaattgataaaatacttatactttggtaagccatagagccaattctcttttcaacctagttgttcatttcaccagtgggcaaaaatcattatttttaaaggtttccaatttaagagcacagaccacccagctattatagagctctatagtttagccctcgaaggtgagtcccagatgcagttcagggatggtctgaacctttgaacagggcaaatccaagcactctaactcctggttccctgctctatccctcatccatgccaccttttttaagcatccatatggattagtgaatctcatttccaaatctatgcttggttagcataatctctcatccagaactcccctttgaatttgagatcctatatctaagggcccacctccattcctcccttcaggtctcacagacaccttaaagtcaatgtcttatctgtttccctttcacgctcccaaacgagtcattgttcatcttccactccttatttcagtaactggaactccatccctccagaagcacaaaacagaacctgggagtcatccttgattcttgctatttcctcacctcccatatccaacctatccccaagtcctgatgactttacctgctgnaa

SEQ ID NO: 2536 - DNA, 605 bp, Homo sapiens
acgagctggaaatcaatgatcagtcataaaatcagactgggaaactraggcacagagaggggcatggatttgggcattggtccaggttatgaagcacatccaccagggtggcctggtggagttaaaggccatccctactgggcaggatgtgctggtgccagttgggtgagttcagaggtggttgggagagagaaatgctcagagctctctgtctgtctacctgtccctgactctcagtgccagcacccacccaccccatggtccccactcatccgggagcttacagcagcccctccacctctatccagccattttctctagccataacattggtgactggcaaagtgtcccagcacaaggcctggcacacagttggtgcttagtgtttgctaaatgaatgaatggattaataagaacgaatattgtgcagaaaaagtaaattcttctggacacttccagcctatatgtggaggggacaaagttttttgttgttgttgttgttgttgttgttgtgttttttgagacagtgtcgttctgttgcccaggctggagtgcagtggtgcgatcacagctcactgcagccttgatctcctcagcctctcgta

SEQ ID NO: 2537 - DNA, 779 bp, Homo sapiens
  misc_feature (16)..(16): n equals a,t,g, or c
  misc_feature (22)..(22): n equals a,t,g, or c
  misc_feature (35)..(35): n equals a,t,g, or c
  misc_feature (49)..(49): n equals a,t,g, or c
ccggctctgtcggcgntaacgncttgaccacctangctgaaaatatcgntgtgatggccgtgaccaaaatctactcgacgctggtgtttgttgctsctgccgtcatcgccatgctgttgggcttttcaccgaaatttggtgcgctgattcataccattccggccgcggttattggtggtgcatcaattgttgtgttcgggctgattgccgtcgcaggcgcaaggatatgggtacaaaaccgtgtcgatttaagccagaacggtaatttgattatggtcgcagtaaccttagtgctgggcgcgggtgattttgctctcacgctgggcggttttacgttgggagggattggtacagcaacctttggcgcgattttactcaatgcgttgttaagcagaaagttggttgacgttccaccgccagaagttgttcatcaggagccataaacagaaaaccgccggggttaccggcggtgcagattgttgacaacgtacgcattgttcatgccggatgcggcgtaaacgccttatccggcctacaaaacagtgcaaattcaatatattgcaatcttctggtaggcctgataagcatcgcgcatcaggcaagcttacatttgtcatcagtatcaaccaccgggtaaccggcggtgatggctttttgacgagctacagacaaaaatgcattcgtcattgattagcccggctagttgtcgcttttgccgtgactgctcttaccaccttttttacctgcttcagatgcgcgctgcgggcccgtacccaatc

SEQ ID NO: 2538 - DNA, 1528 bp, Homo sapiens
ggcacgacggataatggaggctactataaaaattgaatgagaaagtcagtgagatgcactgtttaatttcctttctggctctttcactgtttctttacgtgtgtttttcccttttccttgccaataaaaaatatttgttgagtaactcacgcctactgtacaaagtaacaattctctcctccctttccatcttcttcctctccagttctacttctgagaaagtaatccttaataacagtttggtgtgtatccaaaaaagcttttttgtagcattattctccaaagtgtttgaagcatttcttctgataaagtttctttagtctttagccagaactagtctttggcccacttagtctattgataaacaggaaatagcacatattccccccttgaggctagaatggcaggcctaaaatgagtaggagaattctgagaaatggaaactttaaaaaggcggcaaccttctagtttcattctcagaaataccaaagcagcatttttcctggacttgttctgcagagcgctcagatttgaaagccatttctagcctttgaggattaccactgtcctcagccaaactgcagggactcctaagtagatcagagctcctggaactttctcatcttttcagcatctcaaccctgtggaatcttttaactcccaaggtaagtacagattgtccagagagatctaagccatgcttattcaatggaatggagagtctctcaaagagacctcataactctaagatgaaaatctcctctgtggctacagacttttccagatatacccactttaggcaagagaggatgaagtagacactttaggtctacacttttaataaataagtgaaatagacaatgagaggagctggtccttagactgtactcaccttgtagctgaggccagggatgtaggactcaagcccagaggaacctggctgggctgagagaaagagatgtagagggttctcatagttctggggaacaaaccttcagataagacaagtgaggagacttgggaggaagggatgcctgtgaagattctcttttttttttgagacaggttctcactctttcgcccaggctgtcgtgcagtggtgcgatcacaactcactgcagcttcgaccttccagggctcaaaggatcctcctgcttcagcctttgaaagtgcggggactacaggcactgagcgtgagggtgcctggctaatttttttcgtttctgtagagaggaagtcttgctagattgaccaggctggttcaaactctgacctcaagtaatcgtcccacctggcctcccaatgtgtgggattatagacattagccaccgtacccagcttcgcctgtgaagattatttagcagttagctgattgttcatcatatgaaaaggggtttcttatttttcttattgttttttttttgagacaggctctcactctgtcacccaggctggagtgcagtgatgcaatcgtggctcactgcagtctcaacctccctaggctcaagtgatcctcccgtctcagact

SEQ ID NO: 2539 - DNA, 1496 bp, Homo sapiens
  misc_feature (450)..(451): n equals a,t,g, or c
  misc_feature (454)..(454): n equals a,t,g, or c
  misc_feature (1485)..(1485): n equals a,t,g, or c
  misc_feature (1492)..(1492): n equals a,t,g, or c
gaattcggcacgagtgaccacagatatctttggctttcagcctcaccacaatgctgtccactatgttttttttaatcgattgacatctcatgaatccacaaatttagccgcttttccatcttttccatctttgtcatagcttcatcacgcacgatggaggtcacttcagcactatccggagcggcctcacggacagatcrgtgaatttccttttcctttttcttgatgtaccggattgtcgactcgttaacattgagctcatggccaacagcactgtaactcatgcctgattggagcttatccaacacgcggamtttctccgtaaggsamatcamggtcttctttcgcttaggaacactgggcararcttaarcactacgcttgggggccattttagaaagcaaaaccacccacaaaaagcagaaaaaaaagtgtcagtaaacagactgnnganaggactctttgtttacagcacaggagctgcgactagaaggcggcgcttctccccagttcaaacttcagctgggaaccttacctccgccaactccaaattttcaccctctgcgcatgcccgggaaasaaacccccagaacagtaccgtgatgattgattttagggttacaaatacattttagcaagtaagtgaatttggcattacgaattaatgattaatgaaggtcacctgtatttccatagatatgtaattttatttaagcaggtttattatattaaggcggsgaggcagcgccgaagactacaagttccagcatgcaccgcgtccgggcgggttcgggctcccagcgagggcttcagggacgccagcccggaggcatcggccggaagtgtcgtagggcaaccacgtagtactctctgcgcatgtgcaaagcgctgtcgggggccgccctagctgccgtcgccgccgccggggctctatggtctctccctagagctttgccgttggaggcggctgctgcggtcttgtgagtttgaccagcgtcgagcggcagcaacatggaggaattcgactccgaagacttctctacgtcggaggaggacgaggactacgtgccgtcgggtgagcgattccgcctgaggcgagaagcgaattgccccgccccacgcctcacgtgaggcgcgctctgcccccgcgggcgtctgccctgtggcccaggtggtccaggggggctcctgttctcgagcgtccgctccctcaggcccctcatcctcggccgctccggcccgaggcgtgtgcgcgtggcggttctgtgctcccctcccgttgggcagctccggccgccgccccctcttgcagcgcgggaacggcacatggacacggccccttgtcgctagggacgctcgtcggtcagccccgaacgacaacgctgcttcagaagtcggggcggcagttcgagccttggaagtttttttcagccctggcccgagagagctgctggccaacaacccgtccaagatagagctgtccgntctccgnctgg

SEQ ID NO: 2540 - DNA, 966 bp, Homo sapiens
  misc_feature (8)..(8): n equals a,t,g, or c
  misc_feature (586)..(586): n equals a,t,g, or c
ccactatnggcaattggtaccggccccccctcgaggaagataaggtgcagttcatgccagaatccccagcttcccatgcaggctggggacatagtgggttctcccgaaatactgggtcacttgaatttgatatgatgtatatatattcacctctagtccataggtacatatagtctatatattaaaaagacattggattttgacttaaactagatgtttctcaagcacaccaagacggtgctagagcctgggtttggccagagaattgggtcccggtcagaagtgagtggggatggctggcgagcaaggtgtctgtagggcagcacaggatgtctggtgagcagacagcaagcttctgtcctgccccgagtgctgaggagcgaggtgactgcctacatggtgatgsaaagatttgggcacgcttccggctttcaggccaaacaacctcgcttgctccatggcaccactgatcccagcagtggcccgagggagctccttcctgctgcttcatgctctgacactttggggggctcctttccccaccacgtgggtctcctgtcagcctcgaagtgtcctgcgcccctcncctgtacgcccaggtgtgcctcccctggccgcacytcctctgtgctcctgcgtctctctgttcttctttagagtggttctgcacgtcagcagcatctgtggtgtggccctgggacccttcagaacaggggctcctgcccagcttctgggtcccccacctgtggcccagggaaggctctttgttcctcagccccaagctgtatctggtgagaacagatgcgtagtcccggagctcaagttctgggaagggcagtgcccttttctgtggggccctgggcttgttctgcattgtttcaagaggagctgccactcaaataggcagccctgcaatcggagggctgcgtgctccccctgatcagcccccagctgcttcctcgtgcc

SEQ ID NO: 2541 - DNA, 750 bp, Homo sapiens
tcagagttgttgctttacagaagtgaaaaaagtattgacatttctaagcccagaactattttttaacaagctagaaaatataggaaaaaaaaaaaacgggtagaacatgtttctcaagagaatgcagtgtagctagaatgtacactatttttttcccagcatgtatttgggtaaaatatgtgcactgaaatttcaggccaaatcctaatgcagaaataatcccaaatatggagatttataagctaggcaatttttatttatttgctaatgtagattcccttaagagctcaaatgttctactttttactcttggcttctccttgaaaagacttacctgtaaggtctcagcagcgtaaaactccaagctgcaaaatcgtctgaattcagcatttgccataatctcctttgcccatcaactcaggttggtttggaattgacttgccactgtacctgtttggtaattawaawtcacaattaaatggcagtacaaataaaycagcatgtctgcaggcttggagcctccactctctgtgttatcttccttttatttgaggatctgaaagaaaattagaaagaaaggtttgagtatctaaagtcttccattcaaagctttacctcccttagttttgggacttcttttcaatctgttttggatctttctttcaaagagaaattaagcatgtaccattgtcagcctgtgtgatttacactgaggagtagagatgtgtgtgattccctcgtgccgaattc

SEQ ID NO: 2542 - DNA, 812 bp, Homo sapiens
  misc_feature (443)..(443): n equals a,t,g, or c
gaattcggcacgagtatggcccttctttggcttctgggtatttaaaaagagctcttgggactcttctgaggtcttcctgggagcagaacagtacacatggtctggaattgggttgcatggaataactttcaaggaaagccactgaataaagtgccctgcattcctgtccattggatactgataatgctataagatgatctttctcttctttattttgtttgagattattgtgactctctggctaactcctacttatcctcaggccttttctgaactcacaattcaaattacagctccctttggttctcttccacagcagttgtacttacatatgtctattatataattatgaattgtttcatattgtcgcccttacaggtaaactaatgaatttggggctccatctgtttgctcaccacttgatcctggcagtagcacacaanggctgctcaatacctatttactgaatgagcaaakggactggaccacttttagagactggagtatttccttawaccakgtgagattgawttttgaggacagtttaccactggaagcttttgcagaactaaggtcatttttacagtatacataacctctgctgtgtttgttgatactgtaagtttacattttcttatgactctttttaagtagagcacccctgtgtttaggaaagctagagctattgtgatgcctttgagtttgcttggctgattgctgggacttgaactactgagcttatctaaaagcctcagaggccttgtagcctctgtcttttagagagtgtaggtaaaggcttgttttccctcaaa

SEQ ID NO: 2543 - DNA, 403 bp, Homo sapiens
ggcacgagcggggccctagagagcactcggaggtccaaacccctcatcctaaagaaggggacgctgcggccatgacattccatgcctcccaaggctctagagctataaaatggtggagccatgactgagggcctgctgtcttctctctcattgttactgtatttattaacctggttacttatgctttccaaaaagctttatgtgcaaatgatcttttgctataatccacacttcagtcagatggatgcatgcaatggaaccagtcagaagatccacaatgctagacagtgcacctgatgtgcagttcctggaatggagctctcttccccaaagccaaatgttttctctgaaaccctctgttctttaacgctgaagtcctggatgcctgctaggagcagctcga

SEQ ID NO: 2544 - DNA, 792 bp, Homo sapiens
gaattcggcacgaggtgaagcacactcacatactcaaatgcacacacactcatacacacagccccacacgctagcacatacactcccttcactccgcccctcttgtaaggcgatttcttcttcccaggacaggagctagaggtgcagcctgggaccactcagccaagaagccaagggccaggcatgcccgggcctggagcactttattcatcttttacgtctttttattacacattctcgaatcaccagctcctccttgccttgcttctcctgggtttcattgcctcttgcagtttcttcctctctcgagtgtttctaactttttccacccaattatggaaaaagtaagaaccgagaacagcgaaaacaaccaaaacaaaatctatagctatttctcattgaaatcctggaagaattttgggtttycccttcgatttctctcacccactcacgcattcaccaattatgtatttgtttactcaatgagtgcagctcaggccgagggtgccagcctccacgggatgaggggctagacactctgatttcaccccgacacctgctgggtgcaagscgctcagtctgcagccagctctaggtcccgcccctttgcgttgggctgcgggtgggcggggctgcttggcctgcccagactcgccaggaaagacatgctgctgcggaccaatcagagtggcccaagctgggaggaggccttgccccgccctcccctgccccgcccacttggcgctgggaataaccacgtggaaacccaactccgaggtctctggcgctcga

SEQ ID NO: 2545 - DNA, 819 bp, Homo sapiens
  misc_feature (762)..(762): n equals a,t,g, or c
ggcacgagccaccccaccccaccgccacagcccagagccgtgccaggaagccgcctcgacgcagccgtatcttgaggctccagccccatccccagggtaccacgccacgtagagacactatttttcacttcgtgtttgtcactcctaaagcatgtgtgctagctgcaccaaccctgggatgcctcggtgcatarggtttatgtgcgtcctcctccttccctctggagctggtcccccgtgggggaactgctgcccagactgacctgcgtccttccgcacgtgcaggaaaatgtccacgtgcacttgtcarggtgggggccacacgggcaccaccactgatcatctgtgggatcgagttactgcccatgcagatcccacgtgcagggcccagtcgctttggtgagagagtggacgctgtggtgactccacggtctgtggctgtgctcaggaggacagagaggggacatcctgagatggtttgggcagcccgcggatcctgtgcatgtccccagagcgtccactttctccatggagcagttgagtggcgttgctgagacagaaagttcaggttctccactccccatgcagcccccactcccctgtctccggccaggcacgcgtctggggtggagactcccggtgcccgggccctccagacctctttccccaccccagggagcaggcgggtacttctattccgtttggcttcagaagggaaaagagaacgtaagttcagggagttctcgtccattcctctcccgngggccgggcaggcagcagggacagccttcaggaaacaggaggggctcgagggggggc

SEQ ID NO: 2546 - DNA, 1373 bp, Homo sapiens
ggcacgagagcaaagagaagtgtccaccaggcccgctgcaccaacgctgcgtctttaacagctctggggctgggcgcgtcatggctacgagaaagcgcatgaccacttccctgtttggtttggtttgtgttgtgtgtcagggcgcaggggtttctgctttcactcaagttaatttattttccttttccttggtaattgtgaaaaaacaaaataaaacctcctgtgagccttttggaacttctggaaaagtccctttgctgtgarcsgctgactctgagaagagctttgagcagggctggaaaccatttttctgcaaccttttctttcctggggtatgtctgggtgcacacaggctccccacaaggcaaaggctgtccctggatggttggcaaaatgcgccacaccagagtgggtttgtgttggcaggaggcatgaraaaaccttgctgatggcaggggaggacggcgacaccacgatgggaacaaaatcctcctccttacytctaattacaaagaggaaaaagtcactgaaaaaaaaagtttaaaatgtcttaatataagagtcatatataatccaaagctaccaaaggccaagtgtttagggggaagtttctggtggttaaccccacttcagggggatttaaagtggttgtggtgaggatttggttccaggtatgcgtcctgccaacctgggtgggtgttccctttggtggagcctcttgaaaaatgarggartggctgggtgcagtggctcatacctgtaatcccascactttgggaggccgaggcggccagatcacctgaggccaggagttcaaaaccagcctggccaacatggtgaaacttcatctytacaaatatacaaaaattagctaggcatgatggcaggctcctgtaatcccagctacttgggacgctgaascaggagaatctcttgaacccaggagtaggaggttscagtgagctgagattgtgccactgcattcccgtctgggcgacagagcaagactccatctcaaaaaaaaaaaaaaaaaaaaagagggagtggctgggtgcagtggctcatgcctgtatcccagcatattgggaggccaaggagggaggattgcttgagcccaggagttccagatcagcctgggcaatctsscaaaacccgggcagtacaaaatccataaaaattagcggggcatggtggtgcgcgcctgtagttccagctacttgggaggctaaggttggagagttacttgagcctaggaggttgaggctgcagttagccatgattgtacctctgtacgccagcctgggtgacaaagcaagagcctgtctcaaaaccaaaaccaaaacaaaaaacaaaacaaaaaaaaaaaactcgta

SEQ ID NO: 2547 - DNA, 553 bp, Homo sapiens
  misc_feature (507)..(507): n equals a,t,g, or c
ggcacagggctatttgcccctctctccacatgacagaactgctctaagtttctttgctgctcttctcagctgtcagacggcttgctgcttgttttccacaccaccatgtctattctttgctgtccttwactctgcctgtttttttccttttgtatttcttctggctcttgtcccttttcccacgtgtcwcagctttcctttattgccactttcagtcagagcagtcctgtgcttctggtgccggcatacaatacttacttgagtttcttggcttttcttgactgtgcatctcttacttcaacataggaatagcctgtcatagaatttctccagttccagggctcaagagggagagtgccagaaaattgagactgttttccctgtcttggattgaattcataaagcaaaaccagtgtttgtgtgagggtttgctgtgtcatgcctataggttgtttgggtgcaaacctatagaatccagcctgcgaaaagaaagraaccagagaatancagcatcagaacaatgcttgacatcatttctcaatcaagcagtcca

SEQ ID NO: 2548 - DNA, 924 bp, Homo sapiens
ggcacgagagacctccagacaatcccagaagactctattgacttattctgtcctgtttctctttctaagcatgaaaatccagcaacacggtttccacaggctcctgaaagtgtcctcggagctcggttcttagctcacctctgtgacccttcctgagtttgcttttcacccatgggttgctgacctatttcacccattcggggtgatatgataactaagccaagtaaaaggggcataatttactgcctgcccctgcttttccaattatcccatttgagcctcgctaatcttttcctcacctctctcacctctcctcacctcaccgagttcttccatttgctctgtcagaccactgggtatagtgatgataacctgctttcactcccggtgtcatctcaaacaaaggcctgcttcaccaaatggggtgtttcagcagcgagcagctcacctctcacccacagctgctctgcacgtggctcagggagagtctctgagcacagatgtggaatgcagagtccccggcctcatgctcacccttcttttagctgtacatcagcaaattctagttggcttacctgtgcaagttggttggagtctctgtaacactgatggtcctaaattgctctgtggaagacaaggtctcatgcttctcacaggacatcattgccaagcaagtaaacataagtcacaaggtctttgaaaatttgctaggtactctggccatgagctccactagacttccctccaaggatgacatccagctgtatgagatagtttaaagagatgcaaatgcacccaaacaggattatgcacaggattttaatttgcctgtgcctaaacagttactctaagaaaattttcaaatcaacactttggtgttattctctgatatggtttgactctgtgtccccacccaaatctcat

SEQ ID NO: 2549 - DNA, 313 bp, Homo sapiens
tcggcacgagggatggggtctttgagtggacatgcctattcctgtttgttagttttccttctgacagtcagccccctctgctgccagtatactggtgtttgctggaggttcactcctgaccccgtttgcctgggtatcactagtggaggctgcagaacagcaaagattgctgcctcttgtttcctctggaagctttgtcccagaggggcacctgccagatgccagccagagctctcctgtaggaggtgtctgtcagcctctactgggagatgtctcccagtcaggatacataggggtcagggacccactcgag

SEQ ID NO: 2550 - DNA, 436 bp, Homo sapiens
tcgaggggcccggccctcggcgtcccccaggctctcacccgaagccgccgggctccytccgaggtccccgcggtytccggtcccctcttccggaggcggctccaggtgtgcggccaacacaggtgaaagggscggggccgcgggaggggccggggcgctccctggctgcctgaatggccgggcggggtcgagggagagtcgcttcctcctgggtggggggcactggcccaacctgctgtggttgcaaatggcccggccagttaactgagcatctactgtttgcagatcctacattgaggtagcctccgctcctttcccgtcacgactgccttgccctgtggggcaggaaattattagcaatgacaacaacaccgaatctgacatcttaagcattctgctaagtaaactcttttttattttttctcgtgccgaattc

SEQ ID NO: 2551 - DNA, 721 bp, Homo sapiens
  misc_feature (7)..(7): n equals a,t,g, or c
  misc_feature (644)..(644): n equals a,t,g, or c
  misc_feature (718)..(719): n equals a,t,g, or c
ttatcanagaccctgtgggggaatggggtggactctggggggttagccttcttccccaggctgggagtgggtgagacgagactcggggcctctacatctgagtgtcccccaaaccgagcagtcatgtcgcgagcaaacaaagaaatcatgttacttcttccagctgatgttccacttgtttattctgttgtttctgtggggagagtcacattaaggtgatggagggtggccccctcaactctattccccagagcaggaagtggtaggcaggggccaggaatggattttaaaggcaaagttctcagacccagtgggaactcgaactggtaaactctcctcaagctcccaaggacagaggatttgggtctttgttggcttttgtccacagccacagaactcaaggtctgaatctggaatctcttgacaggacagtaacataaacctctagagatggagtttgagaaaggcccccccttctgccagcttgtgatttagaaaagtgcattcattcaataaacatttactgagcacgtacgggccaagtacggttcttcacagaagatttagggcggaaaaggacagacaggagcctttggccctgaggtttccattctaggaggcctttaaatctcagactctcagantaacagagactatgattactcactattcctctggaacacgagccaaaagagagtgctgtcagatcaagacaatnngg

SEQ ID NO: 2552 - DNA, 770 bp, Homo sapiens
  misc_feature (744)..(744): n equals a,t,g, or c
ggcacgagccctatgctgttcttgtgataatgagtgagtctcacaagatctggtggtgttataggcatctggcatttcccctgctgacgctcattctctatcctgccaccctgggaagaagtgtcttctgtcatgattgtaagtttcctgaggcctccccagctatgtagaactgtgagccaattaaacctcttttctctataaattatccagtcttatatatttcttcatagcagtgtgagaacagataataccgtaaattggtatcacagagagtggggtgttgctataaacacatctgaaaatgttaaagcaaatttggaactgggtaacaggcaaaggctggaacagttkgaagaacagttaagaagaagacaggaaaatatgagaaatcttgaaacttcctagagtcttaaaggtctcagaagacatgaagatgtgggaagctttggaacttcctagagacttgtttgaatggctttgaccaaaatgctgatagtgatatggacaatgaagtccaggctgagcttatccagacagacataagaagctcgctgggaacttgagtaaagatcactcttgctaggcaaagagactggtggccttttttcctctgccctagagatctgtggaaatctgaacctgagagagatgatttagggtatctggcagaagaaatatctaagcggcaaaaccttcmagaggaagcagagcataaacgtttgaaaaatttgcagcctgacnatgggagaccaaagttaaacccaatt

SEQ ID NO: 2553 - DNA, 566 bp, Homo sapiens
  misc_feature (400)..(400): n equals a,t,g, or c
gggttcctgagctgactaggtaggtagtgagcgtgtgtgtgctggagacaggccagctggggcctgcagcgctctgtcgctctgtgatgttgacatgggtgtggtacttaattatgacctcagtgcttcaagcctcggtttcctcggtggtgagagggagcatattggtgggagggagtgaggactgtrgggaggggggctcgttgatacaggtcagtcttggctatgtgttggctgcaagggaggacaggcaggagtgtggaccggacaccgtcagttgtccaccagggatgaggctggactgagactgctgcagccccgctggttggctggggtggggcagargcagggggccggtgaggcagcctcaggaagctgctgcccctgaactccccgggangttccccaatccctctccctctttgttcactggccgggcctccgtgtggaaagggctatttttagccctcgctttttttggttaatgggcttttcgcggcttctctctttgaaggggctawttcaggagcagacatcartgtctgcatttggactccttggctcga

SEQ ID NO: 2554 - DNA, 893 bp, Homo sapiens
ggcacgagtaagggataaagtgggcctgagcccagtacatcctctgcaggaggctgaagtttctgaaacaagaagtgggagagggttcagtaggaaggtccacaagtgaggtcgaccaaagagatcctgctgtttccccatgagtgccacaagggactggggtggaagggctgaggctggaccagtcctggatgcagtggccttttctgtgtgttcttcctctgctccctcaggtctggagggctgggagcctgctgcgtgctctggaactttactcagtcttgttgagccactttctttgggaaatgtggaccatgtctcttaaagaaccagaattgcttctttccaccaagtcattaactgtgtggagarggagagagcccctgtcagaaattgggggatgcagactgaacaatgaaggaacatagcaacaatgaaggaacatagggacaatgacwccaccttgagtccagtggaatgaggtgcggctgcattaaagaatgaggaamgggacagagacaggtgtaagagacgatggaacaatcasccaagaaagtcagggggttggctgggcgcggtggctcacacctgtaatcgccgcactttgggaggctgtggcgggcagatggcttaagcccaggagttcgagaccagcctgaacaacatggcaaaaccccatctctacgaaaaatgcaaaaattagccaggcatggtggcatgcccatgcagtctcagctacttgggaagctgaggtgggaggatggcttgagcctggcaggcagaagttgcagtgagacaagattttttaaaaggccaggcatggtggctaatgcctgtaatctcagcactttgggaggccaaggtaggcggatcacctgaggtcaggagctcga

SEQ ID NO: 2555 - DNA, 793 bp, Homo sapiens
gattcggcacgaggtttcatgttaattttttgttttggtattgcctgaatcatacaagtagtgtaagtttggacctcacatcaagagaaataacagaattggggacttaaatttttaattttaaatttttttctacctcacatcagatagagacaagcctcattgccatctccctgtaccagaatgtggaatttttcttgttcaaccagtatttgtgagtatggctttttaaaatttctggttttatatttactttccacttctatgtcttcacctcttataggcccagaacctcactctccaaccaagtgcaaaattaaatagaattcttgtgatatcaggggaaacaaaatatctccctgaccttctctagatgtctgtactatcagttcacgagtttctgtctctaaagcatagtccctgtttctcctgatgttttctctctttctggcaaaaaagratgttattgcatattacaaataatttttgttagtttctactcaaaattttaacatatttgtagtgagaaagatgttacaatatttatttcaccatcctgccagaacaagatgtcaaggtggtgttttctgaaacacaaatgggtgtgtcacactcctacttaaaatcttcaatgactttatatttctattatcataaaattccatctccttcatattacataaaaggaaatcctacctttcaagtctaaccctttgctatggtctccttcacactcagttttcagcwatatggagctcctttcaggtcctaagatgttttggtgtttcctcga

SEQ ID NO: 2556 - DNA, 1997 bp, Homo sapiens
ggcggcacgagaaaaattcttaaaggtgagaactcaaggttcgattcttcaggtgggagatgtggctgatgctgattctctcattgacatctggggaaactgaggctctgagagggtgctgctccagctcctggacatacggtgaatcagcagcaggcccagcagaccaggccccctgcctgtgagcacactgacccttcccctcctcactcagccctggtgtgtcatctccaggggaggggtgctgcctccacgtgggtgatcagagcagtgccagggaaagcaccaagttcagggtgtgcagctgcaaagctctgcgtgtatgtcccttcttcccttccaccgggcctcaccccctttggctggctacctcccccaaacactctatctgcttttattcaccctctgacgcccctcctggcaccaagcctgcttcccaccatcactacatccgtcccccaaggctggagtccaatgccttccccaccagctgcctttgaccgccagtgaccctggcagctggtggggagggtgtcctccgcctagcctcagactctaggttggctggccttgtgcccccgcaaccacgtgtcagcctggcagtagggggatggttgtgaaaaggacagcatagacaagaccctggcaggattgcaacatccctctggccagctcagagcttccagtccctgtcagccccaggggcccccctacttccccaactaagcccagcaccccccaaacatccacccagatgtctgcttcccagaccccacaagaatagcataacaatgctcctgcttttccaacctcatcctcccctctgctataggggtttctctttaatagatggggaaactgtcgcataaccaagaacatccagtagggctcagcgaggggcaaagatgggggctactggctggttgcagtggctcacgcctgtattcccagaactttgggaggccaaggtgggcggagcacttgaggtcaggagttcgagacctgcctggccaacatggtgaaactccgtctctaccaaaaattcaaaaattatccaggcatggtggtgtgcacctgtggtcccagctactcaggaggctgaggcaggagagtcgtttgaacccatgaggtggaggttgcagtgagccaagattgtgccactgcactccagcttgggtgacagagtgagactccgtctcaaaaacataaaaaaaatttaaaaaagggggctctttgtccttctccttcccaggctccaggatgtctctgtggatggttgctgggtcagctcctgtcccatacgactccctgccagcctttgttctggaacctccttcccatccttgtcccacctctggatctgactggggatgtggtgagatagggcaccctgtctgcttagacatcttcataggttggtggggcgtggtggctcacacctgtaatccaactactttgggaagctttggcaggaggatctgcttgagcccaagagtttgagatcagcctgggcaacatagtaagaccccatctctacaaaaaagtttaaaatatggccaggcattgtggctcactcctgtaatcccagtgctttgggaggccgaggcgggtggatcacctgatgtcaggagtttgagaccaacctgaccaccgtggtgaaacctcgtttctactaaaaatacaaaaattagcctggtgtggtggtgtgcgcctgtaattctagctactcaggaggctgaggcaggagaattgcttgaacccggggggcagaggttgcggtgagccaagatggtgccactgcactccagcctgggcgacagagtgagactccatctcaaaaaagaaagaattagccaggcatggtggtgggtgcctgtggccccagctactcaggaggttgaggcaggagggttgcttgagttggaggctgcagtgattgatgatcgtgctactgcactccagcgtggtcgactgagcaaggcactgtctcaaaaaaa

SEQ ID NO: 2557 - DNA, 519 bp, Homo sapiens
gaattcggcacgagctgagaggcacaggagcaacagccagtgccccctgcagaggaccactggggtcacagacttcaracctgatgacctgggctcagatcccagctctgcacctaccagccgtgtgacaaggtgtcctctctgagcctcagtcacacactgccttaacggttgggcctcatggagctgtttgtgaaggttaaatgggaagacataaagcacttagcccagagccaaggacatgctgaataggataatggtggcctcctttggcgctgtgctggtgcaggtgtgccgaggaaytgggcaggggtgacagatacctcttctaacctagttcctttccaagaacctaattggtgtctctccctcccccaggcaattggaaggaggaggctgggccccagccccagaatacgggaggtttctcaccgtggtagggaaattgctgggttgggggtgtgggcaaccacagtgatcgtctctctgcaggacggatgaggctttgctgacagaggc

SEQ ID NO: 2558 - DNA, 1607 bp, Homo sapiens
ggcacgaggaaaaacttatttatcgatagacctcatttatgcaaatgtttgtaaagtatcatgttattatggtaattatttttattttcatacttatcacatcagacaagcatggtgaaataatatatattaaatacatagatagagttatcataacagagagaatctagtaaaaaaaaaagacatgaaaaacatcccattaaagaaaaagcctttatatgggacattattcacatttctgcaaatggaattttctgattaactgccatatattatattatttgaataactttaggraagrttaatttccaagctctgtccctggtagtattttttcctggctgaaattgggctttaaaacaaaacgtcagcaatgcaagctgacgattccagttacaggttcagaaacttcgagtgcaggcagttaaaagtgatttaagaaaggcaaaatcattctttcacaaatgtgtatgttaaacttgtaaattgatatatcaaaaccacaaccggaatatagcaatttgtctctctttgcctgctgtggtgtctcccgcagctgcctgccagataatatactgattgtaactttcctaatttacagagcctttaagtctaatctcctgggccagcctaaagggcttcttcatccattgaaatgccagaataattgaaattgtcttcagcagacagtcaggcaataatgaatattttctctgctgattgcatgccaaggttgcacatagcactgcaaacagaaatgatcccaaaccgagcyccccagggaggggcagccgctaacctttggcatgaggcacaataccgacggcttcccttctcacgggctcctgaartcacggacgcccaccaagcttctgcacaacgaggtgcagcacagttgccgcgtgaacaatgatgccattggcttccctgactctccagaggcagcttaaaggctgggaaaggttgtggttatggattttctgatgggggcagcgggagagatgagcagaggaggctgctgttggcattaagaggaaatataccaatagttaatcaaaagaaacccggcgttgaaggggcatgagaggacgctggcttgtcagctctggagcagcatttcccatacctttgaatggtttttgtgaaagccgggagttctttcctgactcaggatcagtgctgcttcattggcgtcctaatgrtgtgctgattgaaattaaagtgtttggtagccgaagccaatcactaatatcttcaaaaaatctaaagactagtttaaccttcatctacggaaaggttgaagaagttttgaataattaatataagcaactaatcttagattatggctacttccatgatatgcgttagaggtggaaattgggggatgagaaaggaactaccctaagacaatatggatttaagccacataggaagtgtgcagattaaacagccgggcgtggtgatgcacctctgtaatcccagcccagctactcatgaggctgaggcaggagaatcgcttgaaccctggagacggaggtttcagtaagccgagattgcatcactgcactccagcctcaaaaaaaaaaaaaaaaaaaaaaaaaactcga

SEQ ID NO: 2559 - DNA, 1112 bp, Homo sapiens
  misc_feature (1105)..(1105): n equals a,t,g, or c
ggcacgagcaaacatccaggagtgtgcaccggtcatgcaaggtgttttgtttggctttgtctggctttttagttttttgtggcaggagaataaatctagtgcctctccctccacattagccaaaagtggaagtccctgtccagtcagcattccttggatgcctggtgtattagtccgttttttcacactgctataataaaaagaactgcccaagactgggtaactaataaaggaaagaggtttaattgactcacacttctgcatgtttgggaggcctcaggaaagttacaatcaggcagaaggtgaagtgcgttcgtcttaatggcggcaggtgagacagtgtgtaggataaactgtcaaacacttataaaaccatcatagctcatgagacctcattcactgtcacgagaacagcatgggggaaccgcccccatgatctaatcacctcccactaggtccctccctccacctgtggggattatgaggattacaattcaagatgagatttgggcaggggcaccgagccaaaccatatcaccttatatgtgcccagtgttgacctaggcgctgggatgcagaaacaaacacgacatgggctgtgccttggggagctcacactcttgctggagaagcatgctgattcctaaataagaaatgctatgtgctgtgtacagagtaccatggaaggcaggatgaactctttgggaggaagaagcaaggaaagctttagagagttgctggcttttgagggatggagcaggcattttctacatggggaaagtgtaggaaagagtattccaggcagagtggagagcaagagcaaaggcggagaagcctgtgctgcgaattccttgccgggcaggatccctgtcttactgctgtttagagatcaatatatgtcaagtgactggaagtgtggtttttgttctgggactagtaggtagaacagaaagagttgggatggagtgagcaacccatggagaaatagaggctcggggtcagctgatacaaggcgttgtataccaagctgaggagcacaagatttggaacataataccaaatgctggggagccatgggagggccatgggagctctgatagtgttntctcgag

SEQ ID NO: 2560 - DNA, 509 bp, Homo sapiens
  misc_feature (43)..(43): n equals a,t,g, or c
atgtgagtttagctcaactcaattaggccaccccaaggctttnacactttatgcttccggctcgtatgttgtgtggaaattgtgaacggataacaatttcacacaggaaacagctatgaccatgattacgccaagctcgaaattaaccctcactaaagggaacaaaagctggagctccaccgcggtggcggccgctctagaactagtggatcccccgggctgcaggaattcggcacgagtcaccacgtgctgagtgctgtgcatggcgctgtgtgtcttcaatgaacagccggcgaatgcaggaagaaggcgaggaacactgaystwcatggtgggcggagaaggagcacccaaatggggatgtgtcacctgtgtgtccatgtcggtctactggtttctctgtttccatctcaggctgcaggcttcgtgtggatgaggatggcacctttcctgttcactgacagatactcagtgcctagcacagtgcctgggacacaggaggtgctcga

SEQ ID NO: 2561 - DNA, 999 bp, Homo sapiens
gaattcggcacgagcaggagggcaagtcaaattttatgggcctccaagactctgcagaagagactcccaggctgaatacaagccttaggccactggaatatgctggttttcctaccattcaccgttttggtacttatcagttacattttttcctcccactccttcaaccccttatttactctatgtgattttgagcaagtacttttacatctaaagatattttctcatccctaaaataagaacaaggtgatagagaatcactgtaactacaagtccaatagaataaggttctatttcagattgtctcagccttaatatttagtctactaactgggcaacatttagattctattccaaattccctcaaaccctttctaacatcaacagactaattcccttagccccactccttcctcattaaaataaaatcactgggctgggcactatggctcctgcctgtaaccccagcacttcaggaggccaaggcaggaggatcacttggggtaaggagtttgaaatcagcctggggagcatagtgagaccccatctctaaaaaaaaaaaaagaattaaccgggtgtggtggtatgcatctgtagtccctggtactggggaagctggggcaggaggattgcttgagcctaggagtttgaggttgcagtgagctatctttgttgcagtgagccatgttgttgcaaataaccagatctcattcttttttttatggctgaatagcactgcattgtgtatatgtaccacatataccagcctgtgtgacagggcaagacgtgtttctaaaaaaaaaaattttttttaaatactctgcagtattttttcaaaatctacagtcactttttcctaataatcaactttaaaaaatatttcaaaataagcttgaatttggccctttgctctcacaacaccaaaacaccattttcccaattacagcacagcaaacacacgacattcatttctgtcttctgaattttgggggccccgta

SEQ ID NO: 2562 - DNA, 662 bp, Homo sapiens
gaattcggcacgaggttcccatggcactttatatgtgtgcatagagagccagggagcagtggggttcagggtgggcccatgctatgtgctgcagagctggtgggtcacagtctccccaggtgatggtggtgttaataatcatcctaggcccgtggggtggggtgaggattgatgcatgagaaagttgaggcgggggccctggcatggagcagggctcaggccgcttgtcacccaggctcatgtcagccctccggagcctgtgggtgtataggggaagcgcaggggttcttcagccagagggacaggttcarggcctgctgatgccccttgctggttttgggaccttgagcaagtccccttgccttttggtgctgtgcctcggtttcttcttctataagaaggaggtgatgatgtaacccacccacccagcccctctaccccgcgcatcagggtagcaggcgagctagcactgtggcaccaggagtggagctggcccctggcgggcccacgctggagaggcatcgccatctctgctgcccccctgtggcgtcatcatatcaacctgccagtccccctcacctggtgttaatctcccagaggatggggactgrttctgcatattctttgctaaacaaagacgctagtttggctgtggctctcga

SEQ ID NO: 2563 - DNA, 748 bp, Homo sapiens
  misc_feature (60)..(60): n equals a,t,g, or c
ggcacgaggtaaggtctgtgttccacaggacgggacaaggtcttagatgtttctcaatanataaggaatgaatctctgggttggccaatcccgaactcattagctctgaactcccaacacacattcaggtgcatctgccatacacggtcattctcagggtatgctcaagttattgctatcgggcacatctgccctacagaattccagcagaaatacccaatgggagtggtgggtctggaaacaggaatgtgggcagagctgaagctgctctcctgggggagggctgctattgctgtgtgggtgtgcctgagaagagtagttaggggrggacacagtccaccagcaggtcaaggtgggcagggagttaaggtccagtgggaaggagtgcagggatcaggaagtggccagccagaagacatgagatgggagaagctacatgtgaggattctgatgcagggcatgcatggagccccacaggatgacatcagatctgtccacggctccacagcatttcctgactgcctccatctaccctgcagacccacctgccctggggtttcctttggatctggctgaccagatgcccttgtgggagcctggaggctggaggagagtggatggtgagacccaggcctccagctctcaccctgccaggccacagtggtcagggctatcaggttctaagcccaaactgaggtccaaggggagttggtgggcaggtggcgggtagctggaaaacacactcgag

SEQ ID NO: 2564 - DNA, 761 bp, Homo sapiens
gaattcggcacgaggacagcatgagatggtctttgttgttcttctcccggaaatgattcccctcactgcagaggagggtggaggctggaagaaaagcagaagtgaccctaagacacttcctgtccaggcatttgttttcaagtgccaagcctggggacccaggaggagaagggaaggacttccctgggattcctccaaactgtctcccttgagcagcactagactcactacctgctccccacctcccacctcaggaaggggactgcagggtacacaggaggctgcgccctggacaccaggccccagccccaccaaaccctcagtccccaaagccccagaccctgaacttgccaggaccatgcaggctgggctactgtgggtcttggcagaaccagcaaccaatggagggcgagaaggaaggagatctctaacattttcacagaacaaaccacgcaggaacccaagaaaggctgaagttctattttttgccaatccggtgtaatgagagtataaagccaaaattaacttgaattctagaaaataaagacaagccatatttcctgaacctgagtcaatggactgagattccatccaaataaaggaaaggctaggagggagacgggtggcttctggctccagtgagacccgaggctatctgctgcagaccccagattgcaggccacggtccctgtccagtggcagggcaccagcctaccttgccactgtgggcagccatcagggagagggcagccactmtcgac

SEQ ID NO: 2565 - DNA, 673 bp, Homo sapiens
gaattcggcacgaggtcctagtgtgtgaatcaggccctgtgtggacatggtcgtgccagcggactcgggaggcctgccgcgccgcaccgagaagctgctgtgtgtgatgcttttgcttctggagaggatggcactgtgccctgtgcttgatgtacacacacatttggggtgcatcatctgtgtggcctgccagcctgtccgcactgttctgtctcttctgacagcctccatccaggaaggctctagactatctgggcattttcaaacactgccgcatcaaactgatacaactttccacaaaggaagcaaattatagagctgagaccaaaccagttttatcctcctcccttaccccacccccggcatattttgaatcaaacaaactcttcttgtaatgtccgctttccggacagttcccatcccacagtcaggcggccatgaatttgtttggaggcaacgctttccaaggaggctgagtccatcgcccgatggtgtggctggtccggccggggcacagtgcagagctcctacccgggactctctctgacacctagtgtgggagccaggcacactgcacagacagacacatggctgaggtatgaccctcctagccaaccaaaaggcaagcagaggcgcacaggatgcaagcacgagaagagcaacttgtcctcga

SEQ ID NO: 2566 - DNA, 706 bp, Homo sapiens
gaattcggcacgagcaaagatgaggctgtctacaaacttatgtatcattctaataaatattttaatacagaatgttctaaattttaataggaaaataatatttaagttccttccatgtgccatgcataatcttatatcaagtataatttcatttttatataatttctgtgccttacctcttgcttctccccaattcacaaatgaagaaagtagttacaccgcccttcgttcatgtacaaggggagggtttgaatccaggtctctaggaacccaaaagtcatgcaccttccaaggcaaaggagattaccatgttacagcatagataaaaacataatagaattaggaattggataagtatagagggttcaatagtgttcccccaaaattcctctcaacactgaagctcagaatgtgaccttatttggagataggatctccaaaggtaatgcagatgtaatcagttaagatgaggtcataccggattaatttgggtcctaaatctaatgactggtatccttttaagaagaagagaaaacacaggacacagacacaaggaagcagcaaacgtgaagacagaggctgggggtgtagtgatgcagctataaggcatggggccaccggaggctgggaagggataaggagggacccttccccaaagccttcagagggagcagctgacactttgaatttggacttctagcctcga

SEQ ID NO: 2567 - DNA, 1089 bp, Homo sapiens
cacgagctgaaaggtgggggaagggaacgtagacctagagaggggaattcttacagaaatcctctttttttggtcccttctatttttcagtctccggcagcctcttggtcatgaaagccctcagattgtcggcttccgccctcttctgccttctgctgatcaacgggttaggggcagcaccccctggtcgccctgaggcgcagcctcctcctctcagctctgagcataaagagccggtagccggggacgcagtgcccgggccaaaggatggcagcgccccagaggtccgaggcgctcggaattccgagccgcaggacgagggagagcttttccagggcgtggatccccgggcgctggccgcggtgctgctgcaggcactcgaccgtcccgcctcacccccggcaccaagcggctcccagcaggggccggaggaagaagcagctgaagctctgctgaccgagaccgtgcgcagccagacccacagcctcccggcgccggagagcccggagcccgcggctccgcctcgccctcagactccggagaatgggcccgaggcgagcgatccctccgaggagctcgaggcgctagcgtccctgctccaggaactgcgagatttcagtccaagtagcgccaagcgccagcaggagacggcggcagcagagacggaaacccgcacgcacacgctgacccgagtgaatctgggagagcccggggcagagcgcgtatggcgcgctcctggggagagtccaggcgcgtgtcccggaggcgcgccctgcgcccggccctctcattcaggcgcgtatgccgaaggggccttccgaacacagtcgggagggtgtttccccaaaaactagggagattggaccctgcaagcgtcaggggcgccgtccaagggccgccgaagcaatctgggggccagggagaagcccttcaacagctgcagagcgggcgagggagcaaacgagcgggaaaaaggggcccccagacatatgggaccgcggccgtgggcggggagaaacgaggcgggcgggagaaaaacactgcgatcgccgcgttctatcaatattcttcttcgcaccggaggacaaa

SEQ ID NO: 2568 - DNA, 583 bp, Homo sapiens
  misc_feature (15)..(15): n equals a,t,g, or c
  misc_feature (64)..(64): n equals a,t,g, or c
atamcatttcmcacnggaamcrgctatgaccctgattacgccagctcgaattaccctcactaangggaacaaaagctggagctccaccgcggtggcggccgctctagaactagtggatcccccgggctgcaggaattcggcacgagacaggtgcatgcacacgccactgtgtgtgtgtatgtgtgtgtgtgtgtgtgtgtgtaggggaatcttagtctaaagcatcccactgcaaactaaaagctctttaaagtatattaatgtcacaaaaagttaaggcatttttccattcttgttagcatgtttcttttaccatttttctcatttcaaattactttgactttaaacgttccctgaaacttaaatatactgaggttctgggaagagctaacatgccaacatttctattttgatacacatatctttctggcaagctgctgagtacctccagttaagaagcacaggcctaaactctcagtgtacagcattgataaaatatatctcgagggggggcccggtacccaattcgccctatagtgagtcgtattacaattcactggccgtcgttttacaacgtcgtgac

SEQ ID NO: 2569 - DNA, 1194 bp, Homo sapiens
  misc_feature (1172)..(1172): n equals a,t,g, or c
ggcacgagaagacatggagtcttaagtgtgatcagtgggagggggctggaatcatttagaggcatcttcattcacaaaaccaggagctgatactggctgtcagccaggacttcaactgacctatgtagaacctgtccatgtggcccctccttgcagtctccccatttgggctggtttgggcttcatcacagtccggcagcttacttctaagggcaagcattccacgacaacacagcagaagggcatggcatttttacagtgaagtttggcaatctcatagcgtcgcttctgtcctactttatttattggtcagggcaatcacaaagatgtgcataggctcaaagaaaagagacataaccccgaccacgcgatggaagaagtgacacggtcatgttatgagaggagtgtgtgggatgggagatagggctgtggccacctgcagaaaacagcatctgctataggctgtcatggaagcgcaggatggggatttagcctacctgaggggtcagtcagcaaaggcctctgggaggaagtgagatcttcggctgaggatgtgaagggctaaaaggagaatgaggaagagtttcagggagaggaatcaatgaaacgagtccagagacgctggtgagttggatggtttgcttcagtatgatgacaatacagaggggcaaggagactggtgcaggagaagagagaaggtgccatgtgctctgggtcgtgtcttctatgccagactcccttagaagaggagcagcctccagtcagcggtgtcccaggaacacggaggctagacaggacaatggcagccaatccctgctcccaaactggtgacagtggggaaaagctgcatggtctagatccaccctgctccctggccccagtatagaagatcaaattcaatctgcccaatcttatccagataaagtaaaggaagactggaaaaaagaactaatccacggctccatctgcccatgactttctctgctgatgccggaggcagctatggataaagagacggcacacggcatgtcccgacgctgtggaggtggggagaccccgcaagtccacaggaaaagagttaagttgctgccacctgggcatccgctattctctgctcttctgcctcatcctcaattcagaccatgatggagctgattgtctcccattttatnccttggattgaatggtctcgag

SEQ ID NO: 2570 - DNA, 1534 bp, Homo sapiens
ggcacgagtcaagcaatctgtccacctcagcctcccaaagtgctggaattacaagcataaccactgcacctggtaggcatcaaattttgaatagagaagttaaccatgatgaatcaacacttgcttgaatcgtttggttctccctcctccttgttcattgtctttattctgctcatctggatgttgcaaagatgtaaagattttttcctttgttgctatagagtagtgctaactccatcattctggcagaagcaccaacacccagatcccaaaattaagcatcatttgaagctatactcactgaaatacagttcttctgggcagaacaacttcagaaaggacaaacattggctttctggccacacggaagaggcaaatttaataaaggaagaatggaagtaatgttcaatatcaccaggatagcctacctgaaatttcttagtacaaatgagaagcaatgtggcccatgtggctgctatatgagcacgtggaaagagtgatcttaagttctccactgatcctaatctaatctgttgtattcgcgtgtacccttaattatccatttaaaaagctaattattgctgttagtggtggtggtggttgcatgtatatacgtgtttcaaaaccatctgacacagcctattcaatgctttcctctagttcatacctctgtactggtttcctgtgtctgccacagaaattgccaccaaggtagcttaaagtaatggaaatctgctctctcacttttctggaggctacaaatctgcaatcaaggtgtcaacaggccatgctccctctgaaggctctgcggaagaatcctttcttgcttcttcctagttttgatggttgctgccaatccttggcattccctggcttgtggctgcaacactccaatctctgcctcaatcatcacatgaccttccttgtgtatctcctttgtgtctctgtgttcaaatatttcttccctttctcctgtacatataccagtcattggatttagggttctcttgatccagtatgatcttatctcaactggattatatcttcaaagaccttatttgaacgccttatttccataacggtcacatttccaagtacaagggttaggacttaaaacataccttcttgggggccacaatttaacctattatatcccactacacagtatatgccatgacagaacctctttcatgagaccaacatgaaatgtagagtgatatgattctttatgtgatcaatgagtatttgcagacaatgctgatgattcccctgagaatatcatggctccctcccttacttatttagatatctgttcaggctgggtgctgtggctcatgcctataatcccagcactttgggaggggaggaaggtggttcacttgagcccaggagttcaagaccagcttgggcaacatggtgagaccttgtttttaccaaaaaaaagaaagaaaaatacaaaaaattagctgggtgtggtggcacatgcctgtagttcctgctacttgggtggctggggtgggagaatcatctgagc

SEQ ID NO: 2571 - DNA, 555 bp, Homo sapiens
  misc_feature (48)..(48): n equals a,t,g, or c
  misc_feature (50)..(50): n equals a,t,g, or c
agctccaccgcgttggcgcccgctctagaacttagtggatccccccgncntgccaggaattccgccacgagcaaggtcacagagctagaaaaaggcagaattgggacctatacccagaatttctaactctagctctgtaaagctgggacactggagaagcagaggttttggtgtagtactcctctgagctcggggtcttagaagtccacatggggctgctggagtggtgaggggagatggaggtgggaagaagggagaagacccctattcccctattctctttcaatcagagaggattcctcgacttatttacctgcctgtgatctcatctgaagagaattctatgaccccccaaaatctgcgattcactctgttccagttctgttactctttatatctggagctagaactgggcttcagatcactgtcacaagaggtgaccagagaatggtgcttgagttacttctttttaataaaagtttgctggcaagttcctgtgagtgagttcctgcttgtaaaagagaacccattcttacttctggagaaaaaactcga

SEQ ID NO: 2572 - DNA, 1689 bp, Homo sapiens
ggcacgagtgcattgcaggatgtccacctgttgtacctcagcattgcagtacctcctggcacttttccccctccctgcccccaattgtgtgtcctatagaagtcaaggcagcagctgttacctgcttttacagattcagaaaccaaggctcagggaagagcctgagtggccccagccacagagcaagtcaatgcgaggcagcatgaagctaggcttctttccacattgcacccgcctcctcccttcctggggaggcgggggcagatgtagtggctgacatgacagtagagaaccctgtctagggagtgcacagggtgagatctggctcccctggctgtggaccctggcctcccacccctgcgggaaggctgggaatgtgggggtgcctatgtgggcacgcagcactccccaaatctggagtatagtaaagctgagagcaccctacaccaacccccacccatggtctctctagccccatgggagccaagctgtgtccccaccccagcctgtcccccaggccctggctcagggaagccccagcagctgcaccatagtccacaggcctccccagggctccccggaacagaggctgcagcagtcaattcccagcactcaggagactctgggtcattcagtattcccagcaagcccctaatgcatcttccccctcagactgcaggctgtaatctccgcactgaggtgaagtcagcattgggtggtggtgttggagggataggcagaggccctgagtgaggcctggtggtagaagtagtgagtgggcctgaagcccagcgtgctcctacggtgcagcccctggggccttggagagtggcatcttaggagctcatctaccaagccttggctcagtgctgactccagggagcatactctgaccctccctgcactttggtcagtgcccacaggctccctttcctccctccatcatacactgcacttaccataaggctcgtgggccattagagcccagtcactgtaggagtctgcaaactttccctctaaagggccagacagtcagtattttaggctttgcaagccatatggtctctgtggcaactactcaacactgcagttacagttaaaacagccgtagacaatacataaatgaatgagcatggctgcgtccaatgaaatgttatttatggacactgaaatttgactttcatataattttcatatgtcacaagatatttttgttttgactcttcacaaccatttaaaaacataaagactattcttagcttttgggctgtacaaaaataggtggcagatcagatttggcaggcccatgggttagagcaaggtccctggagccaacctgcgtgggtatgaatcctggctctgctgggtgtcctttggtaagtgggtcaacctctctgtgcttcagagttctcatctataaaatggggatgatgatgatgatactttggggatgtaacatggtgcagtcacattggaaaagtttggcagttcctcaaaaggttaaacataaaagttaccatatgatccaggtgtggcagcacatacccgtagtcccagcaacgcaggaggatcacttgagccctggagtctgaggtggccatgagcgatgattgcactactgcacaccagcttgggcaacagagcaagaccttatctcaaaaacaaaagttaccatatgacacagctcga

SEQ ID NO: 2573 - DNA, 510 bp, Homo sapiens
gaattcggcacagtcttccacacttgcttgtcaaggtgataaccctgacatctgtcaagtgtaatcctattatgaatatagcaagagttatttactgccaagtaagaaacagattagttatggccctggtaatttctgcccctcccccaaacagcccatgtaattgcttcttttttatctttcttttcattttgcctctcatttttcctctcttcaaaggcctttttgctacttttgtctttttctaagtttttctttatcttgttcttttctttctgttgtctcaaattctcacatttggccagtctttctcttgtcgtctcccggggtgtaccttggacccggaaacacggagggagcttggctgagtgggttttcggtgccgaaacctcccgagggcctccttccagtgatctcattgactgatttagagacggcatctcgctccgtcaccccggcagtggtgccgtcgtaactcactccctgcagcgtggacgctcctggactcga

SEQ ID NO: 2574 - DNA, 756 bp, Homo sapiens
tcgagtaccctgaagtcctcctgctgttgtttccaaccaagaaagttttccatgagtaagtctgagcaatgccgagctgcttgcccagctgccctggagcaggagctatcactgggcaggggctggtgggggtgggcaacagaagggataggaagccagattcacccagtcagtcccccagcatcaccaaagcaaagcccctccctcctccaaagcatgtgggataggtgtaatagttacacacatggttctttgcagtgggacagactgaggcctccacctgttctgccaccttctatctacacaatcaggacatgttctcaaaggttatttgctgcagcccagtcctyttcctattctcatatgaatgtcagagggcccctgatccagccccacaacacccagggcccttttcttaccccaagcctctcaagcctgctgttccaccagagcagcccagcytgcacactgtcagcytggcctctgtctaggtacgcccagccaggctcagcgctgctgaccacaccaccaagactgcagagaggctgagcaaacagccctgctgggggctctcacacctcatcaccacttaccactttgagggaccaaggcaggccaggagacatccatcttgagaaatgccaggcctgggccaatcatgtgacagctactttcccagtactctccctccctctctcgctctttcctctctctccagaacttcttgaggagtacaaggcccctcgtgccgaattc

SEQ ID NO: 2575 - DNA, 2136 bp, Homo sapiens
gaattcggcacgagccagtaactctgcgaggagtcgctgtagcgcctgctcagggccatcctgggtacaccatggtgttccaggtctcagtagagaatggatgtaccaggcatgacttcattcctgctcctgggagggtggagggcccttgtcctagggctgagtgctgagttccaagggtctctaacctgcccctgcccctcttttccctmctgggccccctcataaccatctcttctcttatttccatcagcagccaaactactggagtttcaaggtcagtgtgtgatgcctctgctcccatgacaactgcatgtgctctccctcccctgcccctgcctctcccttgcacaggctttgcaccggggtgcgcatctgcacggacaccttctggtatgggcggtgggcctcggggctgcaggctgtggctgctgctttgggagagtctgggttcgcctgtcaggggcttgtggatggagtaggagtttgggccacccctgctggggatctgggctagagatgctcagtccccaggcatccccagcccctgaggggcattttgaaatgacatacattttccccagcctggagagactgctgcctctgagttagggacttagacccttgttgtgggccctcttctttgaattcatatctcacctcccaggraggccctgtgactgtgatgggtcccccttccttttcttactgtccaccatgggggctggtccgtgctaggcaggagactcatggtcctacaccctcaagcctgttgtctaagtggagggctaagctgagggataggtgccttcttgcctcctcctgagctctggcctttccagagctaagacagctgtctgcccctcccagggtatcctgttgacccctgggagagcaccctcaggcacctgcttgcctcctggagtctctggcctcccaagtcccaggcatcatgacagcgggtgggaggcatcccacccagactccccaggtgtcttatttgcatgcattcttcctagcactgcaagaagtccttgaatcagagaatcatggagtcaaagtcacactgtcaagcatagcctctttggaggaggcagttgagggtagtggttaagcgcatggacccaagagccaggctgcgtagtggtgaattccatacagtctgctgctaactagcttggtgacctggggcaagccacatatcctcttagccttggtttctcctctgtagagtagaacgacaatgtctgcatcatagaattgttgtaaagatagggaaaaaaggccgratgtgctggctcacgcctgtaatcccagcactttcggaggccgaggcatatggaatgcttgagcccaggagtttgaaaccagcctgggcaatgtagtgagaacttgktggccaaggagggaggctgaggtgggaggatcacttgagtatgggagattgaggctgcagtgagctatgtttgcacctytgcgctccagcctgggtgacagagggaggccctatctcagaaaaaaaagaagaaagaaagagagaaagagagagagaaagaaggaaagaaagaaggaaggaaggaaggaaagaaggaaggaaggaaggaaggaaggaaggaaggaaggaaggaaacgaaacaaaacaaaacaaaacaaaacacgagaggatgcatgttccaggcagtgcctggctcctggtgagccttacatggtagctgacctcattagckactaawtcataractctgccttgattctcaaacctagaaatcagaatcgccttaggaacttgtcaaaaatctcgaaccccaggctccaatccccagagattctggttcagtgaatatggggtcctggaaaggtatttttaaaagctcccaagtgattcttccctagtctatggacaacctmtgggaatctcagatccatgagctgctccctggaacactctggtgataggcgctctctacctcccatggtggtccctctcctgtcttgggagagctctgcttgaatcactgttttgttcttctgccatctcccttatggtggggaagtcctggatgtttcactttcctctgccctattgtctcagcccaagmatggagagaagtgccagcaggttttccctcctctcga

SEQ ID NO: 2576 - DNA, 751 bp, Homo sapiens
  misc_feature (750)..(750): n equals a,t,g, or c
gcggccatggtgaccatggtgacagggtcccagccagaaaccacaatgggatggaaactcctggggctgctgtcagcagctgggagacacagcgctgggggagaccaggcattccccaggcccaagggagaagcagagtcggcctcgcctgagccagacgcaggccttgggtttaccctccatggaccagacgtaaagtctaatggtgacatgagatttttaatgtctttacatctgcagatgtacacgtcagcaaaattgcatcacacaaacctcactgcaggcccaggctttcctctttccaggtttcaccaacctcctccctccgtcttggctgcctgtccctccaccaatcagctctcacctgccccaggtgacccgcgttaacagtggcacatgaatttctcacattcatacacacataaatgcacgtctcttcaggcaaatacacatttggaaaggattttcctcctggcttgtcctatgaacgtaagaacgtgatctgcacgtttttctgagagttgctctttctcctaacccactcctccctgtgccccacccatgtggccagccctccgtgtccaccatcctctgctccctsccagggctttgctccaggaacgaagtcccaggcagcctcctaggacacaagtttctgttccttctgctcccttggggtttcctcgtagaatgaagactcccagtggagttactgggtcaaagaagacctgtatttttagtttccctcgnc

SEQ ID NO: 2577 - DNA, 1132 bp, Homo sapiens
ggcacgagcagctacccttatttgcagacatcctgagaatgcaatatgatgagcaacttctgtttccccaatccttgctgaaggtaaataagatttattgttgccaaaactcttcaatctacaaaatatttttttctttataaaatgcttttggtctcttgtttcatgtctatatattttctaagccctcttcttctcccattgcatggctctcctcaccctcactcttacctttgttttgctgtttgcaggacctcctggtctctgtcagaaaagacttgtaactttccaaatgaaatgttgcaacttcctatttttctgaaatctatttactaaatgttatgcaagacatgaaatttttgcctactttattccaccatcatttgttttatgaaacaaacaaacaaaaaaatctctaaacctaacccaagtagaagatgcttaactttaaggaaacactaggcaacaggcagtatcatggggtgtcacaggatatgaacaatggaaaggtctcttggaactggaggaggtgctactgggaactagcagtgctctctccatctctcagggcccaacccacatggtttccagtttctttgattctctctatctcctcttttattctgctgctgctgcttggtcagtcctgaatcaaagagcccttgaaggccttttcataccatggattagttaacgaactttctctcttatagaacatgaaggatgtatcactggatagctaattggccaattacctgtccttgtttaagtatctttgtcaaggtaggcaaggaaggcagacaacgctgaacgcataggccatgtgatgtggatcgaatacggcagctgcacaggcctctcccatctcagattgtgaaatgattaattaatattttcagttagtaaaagaaactggggtcagcaactctatgtgtgtgtgtgtgtgtgtgtgtgtatctgtgtgggggtttatattcacaaatatctgtatatttgattagaaaacccacagagagatcaagggctctctatatcctgctaagttctgaaggattcccccataatgtgcccccacctactcactaccctatcctccaatgtcataactgcaatagagatccacttccatctg

SEQ ID NO: 2578 - DNA, 1279 bp, Homo sapiens
ggcacaggttaaacgttgtataaaatgtttcagtggggctggagacagtggcttcttggcatcagctgcacagggttggaccacagagcaggccccgcgaagtgttattccgagcagccccgcctcagctcgcagcctggactccaagtgttactgtgtccatgctgagtataattgatttgcttttcctactttctccaactttcggtttaatcacagaattgcttttcagtccagaagttcccaaagctctttcctgccctctgaaggctctgggaggtggttctcattcacatgagcccctgggratgtttgctccagttcctccaggctgtgaatcaagtactccattccccaagggcctgggggccagtaagatcctcaccctgggggctcaggctgaattcaggaggaggagtcactgaactgcattcaggaaaataaacacatcttgctcagctgagtgagcctttgaatttttctccctgggaagtcacatgtggggtggccaraggtcaccgtgtggtcagccagggatcttggctgggcaacgatgcctcccacagacccttatcaagaccacggcagtcttcactttggccatctcctctggtgtgtgagaagaagccattctctgggttgaactgaggggcttcagatgaacaattctgttccttcacccttggctaatggcccactggcatgcagacctgctagtgaattcaggagtttcccagctctaaggtgagtcctggcagctctactgggcctggccaactccatctccaggtcaggtttcccgtcacaaggcaactactagggagacccccgamccccgtccagctcccaccaggctgaattaragtccccstkgctgcccctcacccaytcccccatattcaccattccagttacttttgctgtgaagtaggccacccaaactagggagaataaaacaacaaccattttatgcagctcatggctacagtgtgggaagaatttaaacagggcatggaggagatgtctcctgtctgtctcaaaatgtctggagtctcagctaggaagactcmaagtctgggagtartttggcatctgggggttgggatcatctggagactcctttactcctgggtctttctggtccacaggctggaagggcktcagaattaggaccgccagccacagtcctgagcttggcgtctccatgtggcttggcatcctgcagcacacacagcagcctctgggctcgaggggggggcccggtacccaatcgcctgag

SEQ ID NO: 2579 - DNA, 801 bp, Homo sapiens
gaattcggcacgaggatgggatttcaccatgttggccaggctggtctcgaactcctgaccttaggtgatcggcctgcctcggcctcacaaaatgctgagattacaggcgtgagcaccgcacctggtctgattttttttttaaatgcaaatcagactatgtcactcttttgcttgaagctcctcagtggctgcctatggctgtcagggtcagagcctcaccacggcctgggtttcctcctgtggcccctggctttcgcctcctgctctattcttatcctgaactacgccaagccctttctcaaccccgccccttgctccctctgtctggaactaccttcccaggcctttttgtgccgttcattctcaagtcacctcctcagcgagccctccttagtcactccctttcatcaccctgtttgcttccttcccattatctggtttccctggaggcttatgtctgtctcccctcagtggaatgtgggcctcatggcacaggcccatcggggtcactgctgtgttcagggctcagtaaggatgcctcggtgcgcttggatgtggcgctggccggctggctgggggtgccacctggcgtgatttgttgtcacttgctcacttgtcctagatgctgtttataaaagtactaatagaaccaggcacggtggtttatgcctgtaatcccagcattttggaagcccaaggtaggcgaatcccttgagcccaggtgtttgagaccagcttgggcagcagggcaaaaccctgtctctactaaaaaaaaaaaaaaaaaaaaaaaaaaaaactcga

SEQ ID NO: 2580 - DNA, 844 bp, Homo sapiens
  misc_feature (416)..(416): n equals a,t,g, or c
  misc_feature (471)..(471): n equals a,t,g, or c
  misc_feature (490)..(490): n equals a,t,g, or c
  misc_feature (732)..(732): n equals a,t,g, or c
  misc_feature (835)..(835): n equals a,t,g, or c
ggcacagcggcacgagataggaagcttggcaggggcagctcccccagtgcgcattgccctgtaactcgagcgcctgggagtggggagaggcttggaaatggagcagggtggtggacctcgtcttctcctgctcatcccaggcctcctccataacacctacctagcacggcctggggacttcccagcccaaggaacaactgagaatactgagtgccagggtagccctagccccatttcacacctgggcaaagtgaggtcactggattcaaacactcagatttaaacctcctctgtgtctgcagcacctgtatataactgccagcctctgctgcccctctccaaaaagtctctgcccttgtctttggcacctgtctctgtcctccccattctctgctcctcctttctccaactcagantcaccctgttagttcagcaaatgttcatcgagctccataatgtagcaggacaggnctgtctaacagattctggncttgcaagggtgagacaagtactctccatctttctctcatcttcacagatggtctgctcaacaactttgcactgaattgtaaataattgatactgcataaaacattgatgttctttaagggtagtccagcaaggtggcaagtcttataatgataactgctcaaggatctctcagtgaagcatttggggstgctagctctgcctatgggtgaggtcagctatctcacgccatctacttccacntgcccccccatgccaggctcaccctgagctgagatgcctgagcaggtggcagaaaggagccacctggtttatgcttcgggaccacaaactcctctatccagangacagtttt

SEQ ID NO: 2581 - DNA, 982 bp, Homo sapiens
  misc_feature (554)..(554): n equals a,t,g, or c
  misc_feature (615)..(615): n equals a,t,g, or c
gaattcggcacgagtggccagctgggtaatgggaacagaacagagcctgggatatagggtacagggcttattattggtgttatcacttcatgtctcccagagaggcctctgtgggtcactgcccccctcaatgagttctgaagagagaaaacagaggccgtggtccagtcagtatggggagcactgtgttcccgacaccccactgcgtgttaaggtcaggcgccacatcttgtagtcagttgctttgccgagtggctccagctttctctagctcctctctgggcctcagtttccctgcctgctggccaacagagggccctgccaactctggctgcctatgaccagggtggctccagagggtgctgctgggaggggtgccaaccctamctctctgcaagtgaaactgggcatgccamtcacctctctggggcctcagtttcctcttctgagcattgaggaaatttgggggtttccatgttccttccagtcagaaaccagatgctgccatgtcccccaacccaaggcctcaggaacagtgctggatggtcattttngaggttttctgtctctgtctctccgaktgaggtttgcttggaaagctaagaatagaatccnagcmaggctgtaktggcggccagctggaacctgatataktcacatatgagaactggtaggcctgcatgccgaccctctatggaccagaatgggacagaggccagaatatggccatgctcttcatcctcactcctgccccactgccctcagcccagtcctcctgttccatctgactgaaaatcagggcatgtagggtgatggtttgggctgcagccaggtctgtgcctgctgtggcctctgagctctggagtcaaatggggactgtggaagaggctgcctagagtggcagaaaccctaccctggaatggggagctggctcagctgcgggctcactgtgtgagcctcagcaacttgccatccctctcga

SEQ ID NO: 2582 - DNA, 753 bp, Homo sapiens
  misc_feature (720)..(720): n equals a,t,g, or c
  misc_feature (730)..(730): n equals a,t,g, or c
  misc_feature (736)..(736): n equals a,t,g, or c
  misc_feature (741)..(741): n equals a,t,g, or c
ggcacgagcggcacgagcagccagttgctgactggcacatggcctccagcgtcccggctggtgggcacactagagccggagggatcttcttaattggtaaattggatcttgaagcttcactgtttaaatcttttcagtggcttccctttgtacttagaaaaaaatgcaacttcttctgctgggactcatccgctcacagccttcccctccaccctctctctgcctcatgctctgcccctgcctgccatgcctccgatactcaccttttgtaccccagcacccgtgccctctgcccctcgatctttgcctggctggttgctcctcactcagtgttcaggacaaatgctcctggccctaccccatctagccagtctagcccggtcttccctgtcttccctgtttcattcatggctcttattgtttgttwacttgtgtgctgttgacttttaactctctcagtccccactggaatgcaagcgatctcccaagctcctagaattgttcctgcctcttcacaggcccttacgctgtgtgtgctcgtgccgaattcggcacgagggtatgtgcacttgctggtatgtatgtaggtgtttgctaacacatacgtgcacacgcagaatgcttccaggggactgcacagcctctagttcgcagcccccacccctccctttgsccctgcactctcccctctctgagctgcattcgcatgaaagggtgcanggttcctgancccgcnagcgncacctcctggga

SEQ ID NO: 2583 - DNA, 1001 bp, Homo sapiens
gaattcggcacgagtactcttaagagcactcaatcaccttttgaatgctttgctgcttagaaatttcttctgcaagacatcctaaaacatctctctcaagttcaaagttccacagatctctggggcagagacaaaaatgctgctagtctctttgttaagcatagcaagaattacctttattttagttcccaacaagttcctcatctccatctgagatcacctcagcctggactttattgtccatatcactatcagcattttggtcaaaatcattcaacaagtcactaagaagttccaaactttcccacgtctttctatttttttctgagccctccaaactgttccaacctctgcctattacccagttccaaagttgcttccacatttttgagtatyttatagcgsaccccaccctctgcagtmccawtttmccatattagtcmcttttcmcattactatgaagaaatmcccagcctgggtaatttattaaggaaagatgtgcmattcactcacwtctctgcactaccagggagatctcaggaaacttacatcmtggcagaaggcaagaagaagcagacaccttcttcacagggtggcaggacagagctagtgcaagtagggaaaatgcccagatgcttataaaatcatcatwtctcatgagaagtcactcactatcatgagaacagcatgagggaaactacccccatgatccaattgcctccatctggttcacccttcatatgtggagattatgaatattaccatttgagagagattttgaatgggagcacagatccaaaccatagcactgccttaaggtatctaataatcaaactcccaaaggtcaagggaaaagaaaggattctaaaaatagcaagagaaaagaaacaaattacatgcaatggagcaccaatatgtctggctgcagatgtttcagtggaaactttattggtttaggagagagtggcatgacgtgctaaaaaaaaaaaaaaaaaactcga

SEQ ID NO: 2584 - DNA, 506 bp, Homo sapiens
  misc_feature (13)..(13): n equals a,t,g, or c
gaccatgattacnccaagctcgaattacccctcactaaagggaacaaaactggactccaacgcgttggcggccgctctagaactagtggatcccccgggctgcaggaattcggcacgagcacctcctgaggaatatggtgtaggaaagccacccgcgtgctttctggctgggatggctctcttccttggctgctggaggcactggagagaggtctgataaggatggctgtatggatcagtgggtcttattcctcattctgcagcagaagcaactgggatgttttttctcctaatattgtgctggcttctctgcctttctctttccggtctgtatccaaggctgctaaaccctggtggctggctctccctgctctctttccagatggattatggctggattctgccatggggagcttgtacagtcagacatggaaagccaggaatgggaaagaggtcaggtggttctctcccacacctcactgccttggtgctatgtctcacctcga

SEQ ID NO: 2585 - DNA, 751 bp, Homo sapiens
gaattcggcacgagagcctcgcaggtggattagacccacccgaggctcgggagaaaccacggcaccttgttgttttgagccactaaatggcgggacgcttgttcacgctgctgctatggcaagagctagcgaggcggctggtaccgggtgatgcttcaccacggctttccagaaagcgctccgtgaccccaggcccacccttcccgacactcacggttccctcagaaatgctcctctcaaatctctcactctccctgcagcctttgttgtttcttttttctttctttctcttttgcaagatgggatcaaggaaaggtctcagacacaaaacgcaacatttttcttccatgacagatcagatattgaagggctcagtgaggagccctgctctgggacaactccatgattagcgctccaagaggcagtcacagggaagcaggtgctctgttcccctcctggctcagcaatcccgcagtcctcccgtcccgctccaggcccagccagcctggctgcttggatccgagacaatagcttggtctggaggcggctcagggtgggagggacccagggacccgggcaccagtacagcagctgggaattcaggcccagggatagggatggggcacaggacaccacccccatctcacacagggagatgaaggtgggatccagcatggggactggacatccctgagtccagctgccccgttacaatgggggaactgagatccggggatgggatagttctcga

SEQ ID NO: 2586 - DNA, 650 bp, Homo sapiens
  misc_feature (497)..(497): n equals a,t,g, or c
ggcacgaggtgtcctgcccaccccagtgcgggtcagtagaaggccagaagcaggggatgggagaaggcaggtgggagggcgtgacagcggcgaggatgaggaaggcagccaggcctgcaggcagccctgagagcatgaagcagaggggtgagcaggttcccctcctcctgccacccttgctcctctctaccaggctctggccttgctggggtgtacccacagaatctgtaggctctggcctagccagaaagagtgtgggtgcttctcagggtcataattaccccatgccccacagggtgtgagtcactggtagcagagtcctccccaatcccccccagaagagtgtggtgaaaggcccgggccactggggtgtcgagagtgccaggcctgacctactgggggtggtgtcagtaggggccatataccctgttctcamgacaaccccaggccaactcagatttgtggagcggccatcccacctccttccggctcttcancctcacaggagcctggtgggtcgggaaaactgaggcctagagaggcaaaatgatgatacaatgaagagtgagtacatgtggaacaccctctgtgcctcacactccactaagctcctcacaccattcacttactcaggcctcaccggccctcga

SEQ ID NO: 2587 - DNA, 748 bp, Homo sapiens
tcgagggctgggcctaactggaactctgattccatgtagaaaagacagggtcccacagcctgcttcctttctcctggcttggtgggcatgcagaatttcttgacccctgtgttccaacaagagagctgaaaggaactctcctaaagaactcacatatattttttaaattctaattctttttccaaatagaagtttgaaaaggcaccccctagaggaacatgcacttctggactggccccaggttccagcttgggttggcgggcgtgccagcagctcagtttgaaacctctcacattgaatcaagggccagaagcagggcctgtgggaagtttctaggcttctgctcatccagaactgtcccctcagcatggtgtgaggctcttatggagcctgcagtcataggatatgagacaaaaagccttcccatccatggatgtcctttcatacactggcacagaacaccgggaacaaatgaaggtgactgagaaaaaaaagaggcagacccatttcttctgcgggttgttttgtcatccagatacgcttactttgtgcttatagctgtatgatcttttttcctcatctctaatgcacaggatttctgcctcattacccatacagctaaagcttaatattaactaaatcagtggtgaattcctttcctttcccaccccgacactatcagcgacatttttcataatggccagcagaggtcagtgtgagaacatagagactacactcgtgccgaatc

SEQ ID NO: 2588 - DNA, 869 bp, Homo sapiens
  misc_feature (635)..(635): n equals a,t,g, or c
ggcacgagctgccaacactgaggtcttcgtggcttctcacatctagatgtatccctctcaaatctatcctctatccaggcaccagattgaggtatctaaaatgtcaactttccagttactccttcttatactagcccaatcaacttacaagataaagtccaagccccttcatatgacaaaccacaccctgcttaactctccaggtttgaatccttcatctcctactttaaactttaaaacccagcagcacgaaagtgtctcctatgcatgttgccatatgcgttctctccatcatgcatttgcctgagcaagatgtcttgagttaacatcttattctttaagactcattgtggtggtagacagcctttaataacggatccttggccaggcacagtgactcacacctgtaatcccagaactttgaaaggccaaagaaggaagaaagcttgaggccagtagtttgagaccagcctgggaaacagagagatatcccatctgtaccaaaaatttaaaaaaatattagcagggagtagtggcatgcacaagtggtcccagctccatgggagastgaggtaggaacatcacttgagcccaggaagtcaaggctgcagtgaaccatgatcagaacattgcantccagcttgggtaacagagtgagaccttaggtcagaaaaatgaataaataagcataaaattttaaaaacttagccaggcatggtggcacacatctgtggtccctgctacttaggaggctgaggtgagaggatccttgagcccaggaggtcaacactacagtgagctatgattgtgccactaaactccaacctgggtgaaaaagcaaaaccctgccaaaaaaaaaaaaaaaaact

SEQ ID NO: 2589 - DNA, 777 bp, Homo sapiens
gcacgagaatgaggcctttcttgaccatcccattaaatattgcactcttcttctgcacagacccaactcccgttgccctgttccatttctctccagagcgcttaccgccctttaccctactacagaattcacttgattttcacattaccagtttgccggtttgccatctgtctcccccactagagtgtcagctccaggagggcagagatttgggtctgtgtgttcactgctgtgtccccatgatgcaacaacgtgtgctcagtaagtgcctgctgagtgactgcatcaatgaatgggtgaaatgcatcgggattaagaatatgggtatgaagccaggcgtggtgggctcatgcctgtaatcccagcatttgggagctgaggcaggtggatcacctggttggagttcaagaccagcctgccaacatggagaaaccccatctctaataaaaatacaaaaaaaaaaaaaaattagctgggtgtggtggcacgtgcctataatcccagctactcaggaggctgaggtaggagaattgcttgtacccgggaggcagaggttgcggtgagccgagatcgcaccactgcactccagcctgggcaacaagagcgaaactctgtctcaaaaaaaaaaaaaattgaatatgggcatgggccgggcacagtgctcacgcctgtaatcctagcactttgggagaccgaggtaggctgatcacttgagccccggagtttgagaccaccctggcaacatggtaaaaccctgcctctactaaaaaaaaaaaa

SEQ ID NO: 2590 - DNA, 1139 bp, Homo sapiens
  misc_feature (915)..(915): n equals a,t,g, or c
  misc_feature (1123)..(1123): n equals a,t,g, or c
gcatccccgcgcctgcwtctckgacwggggtgaggccgcagcggactgccctttcccaagatggcgtcgaagataggttcgagacggtggatgttgcagctgatcatgcagttgggttcggtgctgctcacacgctgccccttttggggctgcttcagccagctcatgctgtacgctgagagggctgaggcacgccggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgttcctgggtatctacctcatctgtgtggcctactcactgcagcacagcaaggaggaccggctggcgtatctgaaccatctcccaggaggggagctgatgatccagctgttcttcgtgctgtatggcatcctggccctggcctttctgtcaggctactacgtgaccctcgctgcccagatcctggctgtactgctgccccctgtcatgctgctcattgatggcaatgttgcttactggcacaacacgcggcgtgttgagttctggaaccagatgaagctccttggagagagtgtgggcatcttcggaactgctgtcatcctggccactgatggctgagttttatggcaagaggctgagatgggcacagggagccactgagggtcaccctgccttcctccttgctggcccagctgctgnttatttatgctttttggtctgtttgtttgatcttttgcttttttaaaattgktttttgcagttaagaggcagctyatttgycaaawtttctgggctyarcgcttgggagggcargarccctggcactaatgctgtacaggttttttyctggtaggagarctkaaggcasttgccactgartctyctgkccctgaraarggaatatggnaaggcttgggatgccg

SEQ ID NO: 2591 - DNA, 411 bp, Homo sapiens
ggcacgagctgcaccactgcgctccaggacagggcaagactccgttcacaacaacctctacctcccgggttcaagtgattctcctgcctcagcctcttgartagcttggactacaggcatgtaccaccacgactggctaatttttgtatttttagtaaagacggggtttcaccatgttggccaggctggtcttgaattcctgacctcaagtgatccgcctgcctttggcctcccaaagtgctgggattacaagcgtgagccaccacgcccggccaggatgttggttttcttattgagttgtaggaattccttttatatcccagatgcgaattctttttccaatatatgttttgcaaatagttcctttcagtctatagctggtctttgtatggtcttttttttttttttttc

SEQ ID NO: 2592 - DNA, 378 bp, Homo sapiens
  misc_feature (350)..(350): n equals a,t,g, or c
  misc_feature (353)..(353): n equals a,t,g, or c
  misc_feature (359)..(359): n equals a,t,g, or c
gacatttttgactgcttatcaatatgtgtctttttttatggtttctttataaaagttccaacacctctatctttctcttattgcttatcttacaaaatgtggaacaatttgcagaatattaatatcatgtcttaagtattgccttaaatggtttgtgggatattacttgatattcaccttcttggatagataagattcatcattggcagcaaataattaaaggtaaaaaaaaaatgcctaagattaacaattttctaaatttaaagaatagaaaaaaggccaggtgtggtggttcacgcctataatcccagaactttggggaggccgaggagggtgggatccccggagcncangggttnccagaccacccagggcaac

SEQ ID NO: 2593 - DNA, 1175 bp, Homo sapiens
  misc_feature (24)..(24): n equals a,t,g, or c
gcatggaaatatatcctatacatnaagtgctgtcctgagctgtacatwtagccatatttagrattttattargcaggattcaaggcctcctaaaaatggatattcagatatttaaaaatacactattaaggaatgcaatgtaaaatcacactaacatttgcatagcactttatagtttacaaaatgccttcacatatacgagctcatttatttctccttctcttctttctattcatctatcaaggaatatcttctataagccaggcatcaggcttgacactgaagacacaaaatgaaaaagatatacaagtctctattcttaaagagttcgtagtttaatgaagtgacccaaaaagtaaacagttgcaatataacatgcaaaggagtgtgatgaaatacacctagagtactatgaaaatggcatagagggaccaagcctgtaatgaagtcagagaaagtaaaagaggtgaagcckgagctaagttttaaaggatgaacaaaaattgaccagacaaaggagttggagaagtgggatggtacaggataaaagcctttctaatttggggaagtgtgagtcgtcgatattagatgatattattaatagattgtgcacagagtgcacatggtagagaggtgagagatgaggtagcactgttagggcagataggtgaattctcacagtaaccctgtgwtgtacmttatcatcctcctctccattatgtaggggagaacaccaaagcccaaagagattaagtaactttccagaattttgatttcaaatcctaagcgtttggtagctgtgtttccctgcatatagtctgcctcaaaagaaaatttaaagttgtattttgtattaaatttaaacaaataraggccgggtgcagtggctcacgcctgtagtcccagcactttggtaggccaaggtgggcggatcacctgaggtcaggatttcgagaccagcctggccaatatggtgaaaccccatctctactaacatacaaaaattagctgggcatggtggcacatgcctgtaatcctggctacttgggaagctgaggcaggagaatctcttgaacccaggaggcggaggttgcagtgagccgagattgtgccactgcactacaacctggacaacagagcaagattccgtctcaaaaaaaaaaaaaaaaactcga

SEQ ID NO: 2594 - DNA, 959 bp, Homo sapiens
  misc_feature (930)..(930): n equals a,t,g, or c
ggcgagccgagatcgtgccattgcactccagcctgggcaacaagagtgaaactctgtctcaaaaaaaaaaaattataatactatatgccataaaatgacatttcatatttaaagagttttttaaaactcttgtattcacatgccataatttgaaaccctatttcactgaatgagaatggtatctgttgtcctcattttttcatttttatccttaacaatttccaccacagccagtgcatataatggcaatgacacccagggatggaatgataagttccatcrcmgctcagtcaagacgcagacttgatgtggccccaacaacagtcaataatggagtctccaaaataaagctctataggaaaggtaaatacccgctgcacaagaaaccacagcatctaggttctaaccccatctctatgaagagcttgctgggagagttttgacattwaacaatctgtctgatkgccaattttyttcttctataaaatgataatgttkgaytcaaagatccaaagtcaattcatggtctaaaacttaatgatttttttaggttttgkgacatttcactgtacactgtagtaatttatatcttattttcccactaatttagaaaaatatytaaatgatccttaattggcaatgggtcctaagaattttgttttaaatccctgttacccaaaagagcccttttttgtatctcgcagtagttacaaggatctttctaaatcttaaaaaaaaaaaaaaaagaaagaaagaaaagaaaagaaaaaaagtcagccgggcgtggtggctcatgcctgtaatcccagcactttgggaccaaggtggacagatcacgaggtcaggagatggagaccatcccggccaacatggagaaaccctgtctctactaaaaaaaaaaaaaactcgaggggggcccggtacccaatncgccggctagtggtcgtaaaacaatcaaa

SEQ ID NO: 2595 - DNA, 360 bp, Homo sapiens
ggcacagctgatgtttaaaatacacgaaaaatcttgtaaccctattttggcatatctttttcttcttctttttggtttttgtttaatatggaagtggacagtgcctctcttgacctctggaaggccctatgaaaacctgaaaccgaggcaaggtgacaaagtctggtcattcagcactaagggccgcctcagattacttctttacttagaaaaacaaaatgttgttgcaaaagattcagagtcacaaatattcttcccgggcctgtcagtttctgaattcttagatttttcatttaatttagccatcagggaatttctgagactagaaatacctaggcagaacccaaacaaaatctcgta

SEQ ID NO: 2596 - DNA, 321 bp, Homo sapiens
ggcacgaggtcctcaccagctgttccacgtgctgtgcgtgtgtggctctgtagctggccggcagtgccgtgtcgggtgaagctgggagagtccctcctttgcagacagaattcctgccattcctcacttttatgactgtccaggagcaagaacgtggccttctggagttgaggtagaatgggcaagaaatcctctacatcattctatttactgctcctttgtgttttaaaaacagctttattaaaatgcatacaccagcctgggcaaggtggcaagactccatctctacaaaatatttttaaaaattagcggggtgtggtg

SEQ ID NO: 2597 - DNA, 484 bp, Homo sapiens
ggcacgaggtccggggaccgagggatgtgagccctggctacaactccaggacaggagggagagaatgcaactcagcctgtccctctgtgcatttgtggtatgcactaacgctgtctgcacacatgcagctaccaaccaagccagactggtggggttcctaaaggtcctgaggcccgcccacagccccctttgcctctaggttgctttccctcccagttgcccgcctctggtatttgttgctacttacagaatctttaggaccaaagggctgagcgtggggccaagaatctggtgagcaacaagtcactggctctgccccttccacttttgacagggtgtacccggggtggggagacggtgatcctagacccgctgtcacctgtggggctgttcagtgccatgagggtaaagaacgagttggtcccactgctcatagtttatccctgccacttggcacagggcatagcacaaagcaagccctcga

SEQ ID NO: 2598 - DNA, 1866 bp, Homo sapiens
ggcacgagacaacatttattaccaatccgtgaactctggacatccccaaagagcatttctaggaaattggcttcctctttcccttgggacagttggacatcttagctgctccccagcccctgcaatgtccatgttccaggagccttgataggttaagatgaggcccaatgtcctgcaggtggcatttcccatcagtacccatcggtgtgtccgccctagttgttggctcctgttcattctgtttagactgctacccattatgatcagccaaccaggctgtaacagttgttaaatattttgaatgtcacccctggcatttgccaaagttttcttatggagtaccggattcacaagattgtcataaaacaaagaaaaataagcttgcaaacggatgaatcatctaggctctgagaagtcctgcaagaaagattttgtttacctgtgtttaactcaatatatgccaaaagtattgaatcacatatgaaaagtcctccctacccttctccctttttcagtttcaagaaatactgtacctactaccatgctgtggaactagtgtctgggaaacatcatcttcgaaaggaaatggacttctactaaccacattgttctgtgtctgaaagttccaatcttcctatagacaaagatgctgatgaagatggctttaaaaggaacatttggaaagtgcccatatttggtaaacagatggatttatattgaaactctggtttctccacttggccttccacaaattatttaaatggtcatatgctcagtttcttcatctggaagacaggtttagcgttacctcctttgcaggattgctgtgaggattctagaggtaaaagatgtaaaatgttttatcacagtgcctggcagatggcaaacactcaagaagagttagctgttagcatccagtattacaggaaccctgaggaccatacaaggtgaccttaaggctacctgttctcatggacatcacagtctggttagacagacaacatagacctgtggaactatagccaccatcgaagaaaagactaaactgaggctggaggaaaacaatggcattggaatggttggaagtcgcttcataaaattggtgtgattggttgagccctgacacaaagacatttacttccttctatccttttaaaaataatggcctcctgttgaatggtagttgccaagaactagggggaagtacagtagaaagttattgtttaatggctacggaattttagtttgggaagatgaaaaaaacttctggagatggatgatggtattgattacataacattgtgaatgcatgtaatgccactcaattgtattcttaaaaatggttaaaatgatcaattttctgaagtgtgctataccacagtttaaaaaaattaaataataattaccttgttatcaaaaggggctaattagctcactcccttcactccatacaaatttatatcattggtttaagactacatctcccagaacatgctggtcccttttcagcttaggtgttccatttcttcttccttctagggtttctcttctttaccagccaagcctccagatggtatttcagtcactcagccaaacaccttcattgcagtcttttcccccttctcccccagttcacttaaaaataaattgtcttttttcgtaactccagacagaacatgaagcactctctctctctctcttttacgctgccactgaattctaagtacacaattatgcagggaatgtctttagattcaccagcttgagaacttttaaacattaagctctgaatcagataacagctttcatctcaagaacagctttgcactgtacctaagtaaaagcttaacttatatataaaaaaaa

SEQ ID NO: 2599 - DNA, 1142 bp, Homo sapiens
ggcacgaggtggctgtcacagctcccgtcccttccaggagctgctcagggtgggagttgctggctgcctggcttggtccaggtctggagtggacgttgaggggtgtggcccagatggtgcgaaccctgagccttgctgtcctcagttggctgccggcggctgtctgctgagcccacagcttgcctttggtcagagggagcccacagctgttcctcccttctgttggccagcagctatgtggccatggggcagtgtgagtgccctctggctgcagttacatccaccacaaatggacaaacggggtggctgagagaacaggaatgcactgtcccagttctggaggcagatgtcttgggtcaaggtgacagcaaggctgtgctccctctgagggctcttggggagggtccttgcactcccctggtgggtggctgcaccattctggtctcagccttggccttcacacaacctctcccctgcatgtgtgtatctccctctccctccccttaaaagggcctagtcgtagaatttagggcccacctaccacactaagatgagcatgacctcatcctagctcattccatctgcaaagaccctgcttccaaacacggccacattctggagttccaggtgggtgtgcattttgggggatggcctcttctgcgtggcacatgacggaaaagggttctaaccgagggacttctgtgtggggcctcactctgattctcatccttagtgctgggtacacggcaatggcccctttgtgaaattcatcaaacggtggacacttagggcatgtacatcacacttaaaaagtctgcattaaaatagagggtcaggctgggcgtggtggctcacgcctgtaatcccagcactttgggaggctgaggcgggtggatcacctgaggtcaggagttcaagaccagcctggctaatgtggcaaaaccctgtctctactgaaaataaaaaaattagccaggcgcagtggcacatgcctgtaatcccagttactcaggagactgaggcaggagaattgcttgaactcaggaggcagatgttgcagtgagcggagatcacaccattgcactccagcctgggcgacaagagcgagactctgtctgaaaaaaaaaaaaaaaaaaaaaaaa

SEQ ID NO: 2600 - DNA, 432 bp, Homo sapiens
ggcacgaggtccaggtgtctttatttcagatgttctgtttttcctctattttctgctcacatgaacatacacacttgccaggcacattctggcttttcttatttctctttctgattttgcctccttcctgcccctgttttcttcccttttctctggctatagaaactgtcaggtggccttgctggcatcatcctacctcttttgaactgtgttacccaggaacttccatttattatgcctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgca

SEQ ID NO: 2601 - DNA, 847 bp, Homo sapiens
gctggagtccaggacctggaccccacctctctctagcttagtctcctcaccttcttcacccgtgcctccctccagcaatctctcttcatggcttcctgcagggtggcagctacctcgcccacccatgggagcgtcttctgtacaggttcgattggcttcagctgttcaaacatcttctcttctgtggtgtctctttctagctttatccactcctggcctggtgcccaggcctgactggattccttcctggggctatctacctcccagtaactgggcagatggagaggcccagcaaaggccccagggtttgatgtggcttcctgtgacaaatgtatctgctccaagaggctgtcttccttttttgttctgctgtccaaattctcctcttccacaattgagaacaattttgcttccctcaaagctgggccaccgagttcagggccctggtcacccttggctcaccagctgccattgtttagtaacaacaccagcctgggctaggtgtctgccgtctgttctaccctgcttctagaaacctgaggtcagagaaaaacaaaacatatcagcaagagggagggtaagaaacagcttccttatttggtcagggaatgccagcagttactaaamccctacagtgtgccactggatgctctcagcaatgaggtaacaattactggccctgtcttaaggacctaatgcagagatgctaaataattttccaaggacaagtggacattcttgatctacaaaagttaatgtttaaacctaatgttaatgttagactcagtaccattggaaatcatgtagctggggtaaccaggctaggatctgtcacagatcacctcga

SEQ ID NO: 2602 - DNA, 2806 bp, Homo sapiens
  misc_feature (2759)..(2759): n equals a,t,g, or c
agtgacctggagcccataagtaacagtaacacagagcagagagcgctagatgaggtggagctcagaggagcatgggaagttgaatgagacagtaaggagcattctggaagctataatgggtagttaggagaatgccagagtgattctgatgcagtccttccaaatgccggcagagccaagctgtgaccagtgacgcagactggaagtcccgtttactgggagagaagaggttaaggaacacccaggtgaacaattaggtcctccacaatgaagacaggtaatgtggaggaaagagagcttgtcatggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttcagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaatgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaatatattgcttccaaagacatcagattcagtggattcctgtaggttatagaatattggcttccaaacaggcttgcagggaccatatgctgttggatgacatataaccaggtccacttttatgaactgcatagctgacttggttgtccattgctccagaaggccacagagtggtanaaaatcacaggtaaaggctcagacagcccctgtgatattggtggtct

SEQ ID NO: 2603 - DNA, 676 bp, Homo sapiens
  misc_feature (665)..(665): n equals a,t,g, or c
ggctgaactcctgacctcaggtgatctacccgcctcggcctcccaaagtgctgggattataggcatgagccactgtgcctggcccagagtctcatttctttgggatccaggctgagtgtccgcctagacctgttccttcgcctgtctgctgttgaccttggagccatgtccctgtggcagagtttctttctgggccactggtggcctctggccttaactttaggtcagggaagggatggacaatggcccagcacctgtgggtctggggtgagctggtctggcagcggtggtgggaaatggaatttcctgcctatctgggtggcagctgtcgtccagccttcctggccagactggcagaggtcaggaatgggtgtgtactgtgcccgcttcctgctgttgagctgagagctggcttcctggtagtgtctggggcataggaagggaggcatcctactcctctgtgccaggagggcctgcacttgtggaccagcctgcgaggcactgatggattaccttccgagcctggcatctgccagtcaggagtcctargctccatgcccaggtccgctggtatttgcctgcattatttgcctctcggagcctcactttcctcgtctgtgaaacgaggarggtggtagcagarctgtgctcatarggccctcgangggggcccgta

SEQ ID NO: 2604 - DNA, 764 bp, Homo sapiens
  misc_feature (6)..(6): n equals a,t,g, or c
  misc_feature (652)..(652): n equals a,t,g, or c
  misc_feature (685)..(685): n equals a,t,g, or c
  misc_feature (688)..(688): n equals a,t,g, or c
  misc_feature (729)..(729): n equals a,t,g, or c
ttcggnacgagggaccccaggcttgtcttctcttctgagcatggccactctagtttggaggctctatcttctgcaacctgagttggtcctaccctcacccccacccccaccccgattcccaggcccagtccagacccccaaaatcccagggccagctaggggtcctagaactggctttcagcctccagcgttctctttcccctctccaacgcccttcttctcagcagggactcctgtcctctcatggaaatttgccgtcctgtgtcccattgcccaagaacttctcccagctgaaaaaggagcccgtaataagtgttcggggttgagcagatcatacatatttgcaatgctaccggagatggggggaraaaatkcgttarcccaatkgaatgaatggcatgggtgatgtggctgaaggcagagagactggggcagggagggcaagggccagctccttccttcaccgccctcacaccgcctgtgcccagggctggcagcaccctgaaggtgaggagaaaggcccagagctttgccccctgattcctccggctcctcctcaccccgcctgccatccgtgcatgcaaagccaggcctctggaattgtgccgccaggccccgggctggaagggaaagggctgscagggctcgaggnggggccccggtacccaattcgcctatagtgagncgnatacaatttactggccggtcgtttacaacgtcgtgactggngaaaaacctggcggtaccaacttaatccgcttgcc

SEQ ID NO: 2605 - DNA, 773 bp, Homo sapiens
  misc_feature (3)..(3): n equals a,t,g, or c
  misc_feature (11)..(11): n equals a,t,g, or c
  misc_feature (51)..(51): n equals a,t,g, or c
  misc_feature (53)..(53): n equals a,t,g, or c
  misc_feature (69)..(69): n equals a,t,g, or c
  misc_feature (112)..(112): n equals a,t,g, or c
aanccagcttntggcccatggtttacgccaaagcttcgaaatttacccctncncttaagggaaccaaangctggactccaaccgcggtggccggccgctctagaactagtgnatcccccggggctgcaggaattcggcacgagcaacatagtgagccttgtctctacaaaaaattttaaaggttagcgaggcatggtggcgcgcgcctgtgatctcagctgcttgggaggctgaagtgggaggatcccttgagcccaggagtttgaggctgcagtgatcatgccattctgggcaacagagtgaaaccgtctcagaaaagaaaatgaaaatacctctacatgtggtcttcctgctaatctctctgaccttcctattcaccaccctccccactgcccactctgctccatcctcaccagcctccttgcacattctcagattgagggggcatctcatgtgtgtcttccctttgaaaatgatgccaacactcatttgacgtacacgtgcaaatgtttttgttgtggaactatccttctattcttgttttatgaaacattgccatcggggatagatatattacttttaaaaattgtattttagagccctgtgtggggctcatgcctgtaatcccagcactttgggaagctgaggtgggtggatcacttgaggttaggagttcgagaacagctagaccaacatggtgaaaccccatctctactaaaaatacagaaattagccaggtgtggtggcacgtgcctgtaatcacagctactcga

SEQ ID NO: 2606 - DNA, 1208 bp, Homo sapiens
  misc_feature (640)..(640): n equals a,t,g, or c
ggtctcgtgttcttttttgccccagttatattgagaaatgattgacaaataaaaattgtatatatttaagttgtataacgtggttagcatatcctcacatagtcacctttcgtgtgtgtgtgtttgtgtgcacatgtgtgcctgcacgtgtgtgttcgtgtgcatgcatgcatttgtgtgtgaatgtatgtgcgtttttgtgtgtatgcatgcttgtgtgcgtgcatgtgtgtttgtgtgtagtgagaacactggagagctactccgttagcaacgcacaatacactgtgatcaacagtagtcactgtgctgtacgttaggtctccagaacttactcatcctctaactgcaagtttgcaccctttgaccaccatctcttcctttcccatgctccctagaccctgccaaccactcatctactcttactatgagtttgacttttatttttggattccacctgtaagtgagatcatgcaatgtttgtctgccttatttcatttagcataaggtcctccaggwttgtccacgttgttgcaaatggcagaatttcyttcttttttaaggctgaatcatattccattgtgtgtatagaccaaattgtctttatccattcatctgtcgctgttgtttttacatcttnggctactgtgactaattctgtgagaaattcccactgtcggtgggaatgtaaattagtacagacactgtggaaaacagtgtggagattcctcaaaaaattaaaaatagaacttccatatgattcagcaatcccacttctaggtatttatatatccaaaggagatgaaatcagtatctggaagggatacctgcatgcagggaggcagtgtcaacctgggaggatgcagccctcactctcccctccaggtgaggccaagagcaaagtgggaggaagctcagagtctgtgatgacatctggtgaatggaggaccaaggtgaggggccagaggacgaagaggaaggtgggaaggatgttccagaccaaccaagagcatcgtctccggaggaggaggagggagggagtgcatggcttcgttctagtgagctctggatacagtctttattcctctccttacctctgggtatttcccgagagaaccagatctggaagatggggaaggcccaggcactgcttctcatcccatcccctctgatctgaagctttgctttcttcagtttctgaccctcga

SEQ ID NO: 2607 - DNA, 1541 bp, Homo sapiens
aattcggcacgaggcaaaatgtcaagcacatattaagtacccagcatgttttatcttttcttagtacttgtggttctcccattattacacaaagagttatgtagcattgagcgacctgtctacccttgtttgtttgtcatcagtgggaagagcagcatgtcatcttttctatgccaattcaggtggaagttctggggtaggcgagaagatggagaaaaggtgcagaacaagtcaatgttaggggaaatttcccaatgcagcgcatgggattactatacttgtgttgcagcattaaaactggggctctgaagaggaagaggcatggctgtcatgagggagaatacttaccctagtccttagtaaggtcgggttgaattcctgattgaagccaagcacgcagttaaagggattattgaataccttcagagcattcagagttacgtgcaaagcaagtcttctgttccaagtttggatcgaaaccatcccagttcaaagaaaaagaaaagaaaacaggcatcaaacacataactttagattatccagtatccatccctctcttctggccacagtaattggtccaagggaaggacaaacacccaggccaggacaacaaggctctcccccttgcagctggtctagagaagcttccatcctcactggttatgaagctgaatgtctgcaatcccaaaaccactgtcagctgtgacctctgccaaatggagggaggtggtgtgaatgaacgaagttgacacagacagggatgatgagagttctggtaacggtagagtttctgtttccaatcatccctactcttgacccaagctaagattgttcaggttttgaatcttttagctaccccttcaaccttctaataaccttttgcagtcccctgatcttccctcccactatgtaggtaagttgataggtgccattagaaatgaaaagatgtgctgggcatggaggctcatgcctgtactcccagcactttaggagcctgaggccagaagatcacttgagaccaggagttcaagaccagcatgggcaacatagtgaattcctgtctttacaaacaaatacaaaaactagccaggtatggtggtttgcacctgtagtctcagctactggggaggctgaggtgggaggatcacttgactacaggaggtcaaggctgcagtgagctgtgatcatgttactgcactccagcttggttgacagagtaagatcctgtgtcaataaaaataaaaattaaaaaaagatatgaaaaccttaaaattgtctactatttattgaattgctaaggtctttaaataaatcatcttccttattcttcacaaaaattccagataatgttgtaaagagggaactgggacacaaagtgattaagtgactcatacacatagctactaagtggaagaataacaattcaaacccacatctgtgtaactctaaagtccatgttgttgagactacaagtaataatgaaatggagcatagccatctactgaactaactgaaagtccttaaaaaaaaaaaaaaaaaac

SEQ ID NO: 2608 - DNA, 1516 bp, Homo sapiens
ggcacgaggttggtgcctatgtccttttgacatgaccctgtcagttctgcagcacttctttatatgtgttcttttgattttgcttttagataccaacctttgcagacagattagctcacatagttttgaatttagtgggaaccaaccccttgtattttgctgtatttctagtatctctgctaaattggtactagatcaggcaggatgacttaatgcaacagttcttaaacattttggtcttaggacccctttatgcatttgaaaacatcattgaggatcccaaagagctttttctgtaatgtgaattatatctgttgatatttatcatatttgaaattaaaactgataaaatttaaatacaaaaatgtgtaaccatatatcctattagccatcagagtgatgccaacatcaaacatcatatagcttctggaagacttcagagcacatttattagagaatgagagtgaaaaagtcaaataatttattggtgttatcatgacaataattttttgattatgtggaccccctgagatggtcttagggacaatgctaaagactactgttttaaagtattggcaaagaagaaaaccaccttatgggaagatttcatgagtctttctcaaaggaactccttgctaaacatctatcttcatggtacctaagcatttcaccttttaaccaggactttaggccattgtattactgggagctcctcctcaaaatgcagagaaagctcaaagactaatttttatctattgttaataattcaatttaaattggcttattaaatggcttttcagttacttttcaggatgttgagatacttggacttaggataggtatgttttatggggaagacttgggaggttatagagaaataaaggggagaaggaaagggtaattgagagcatgcctctctgctgagaaggtggctccatgtggaacaccacagccttgctttctcctctatgtctcctgccctctcaccctggctggctgctcaccaacccttccatacttatcctaaactttcaactatgggtgcttttttgtatttgtgaattagaaagaggtagcttgggctttgcatatttaagcagattgggaaagttgtaaacttttgagtcccttagaataactcagtcatgtatttctcttcttagtaaaaattcagaaaaattccagagtagtgcaaacctgcttagagagaggtgaaaacagaagaagactgttgtgtttaactgaaactgaaactgcaaatgaaggggtttttttgtcattttatgttttctttttggtttgtattcctcaatccgtgccttgataacaattcataaatctaggttcaaagagtacaaaatccatattactactaggaatcataaggctttgattaaaataatttttttgaactttcttctatggctattctgagctcagaaagagtattttatttaattttttttgtagagacaaggtcttactatgttgcccagactggtcttgaacttctgac

SEQ ID NO: 2609 - DNA, 1058 bp, Homo sapiens
  misc_feature (1010)..(1010): n equals a,t,g, or c
gtttgagctgaatagagcacctgcataaatgcccatggggcattatttactcttgcttactcttcatccacctgccacacacccttctctctccagagttctctgtgttctgtggtgtctttctctttggacaggccaaaagatcacacaggacaacgcaatgccatttaccttggactctgtagtcttcatgttttcccaacttgaatgtttctccttgatggcagcaactggatcctacattgtcctataactctcagaacatataccacaaacctaagcataaaattcagtaagtgttcagtaaatatttactcactagagaacaaasgtttyttttctaaaaaaaaaaaaaaaaaaagaaaagaaaacaacccagggaacaaaatctctaatggtgaaatttcagttactttgacaggaatatgcaagatattttggaaaagagcaccttttttttttcacttccagtcgtatctgtggtgttcttatagagtgcagacctccagaagcttctgagaactacatccaaggatgtctgctggggctatgaaagctcaagccttcttattgcaatggtggtagctaatatgaggcctaaatattgggtgaaaaatatggaggggcttcaggccttctaaaggtatccgaatttcttctttcatctttaaaataaataccttcccaccattcaaaaataaataattctctcagaatcaggaagtttgtgcatatttatatccttatccatgtaggcttctgaaaaggagcagaaatgtgattcctgtttaatagacgtatacaccccattgtctaattatgtgcattaatacttcttggaaaaaatgtggtctttcataactagttttataccagattctaaatatttgttgaagtgtcatagtttcttaatcctaattagtataattgattattagcaaatttttccattgtcaagatattatttttattgccagctaaaattactattttcatttgcatcacaaaantcttaagtggtttggtaaaatataaaaacatcacaaaacttccctcga

SEQ ID NO: 2610 - DNA, 935 bp, Homo sapiens
  misc_feature (2)..(2): n equals a,t,g, or c
  misc_feature (8)..(8): n equals a,t,g, or c
  misc_feature (23)..(23): n equals a,t,g, or c
  misc_feature (28)..(28): n equals a,t,g, or c
  misc_feature (106)..(106): n equals a,t,g, or c
  misc_feature (918)..(918): n equals a,t,g, or c
  misc_feature (920)..(920): n equals a,t,g, or c
  misc_feature (930)..(930): n equals a,t,g, or c
  misc_feature (935)..(935): n equals a,t,g, or c
ancgcctntgagtgagctgatancgctngccgcagccgaacgaccgagcgcagcgagtcagtgagcgaggaagcggaagagcgcccaatacgcaaaccgcctctcnccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaacaaaagctggagctccaccgcggtggcggccgctctagaactagtggatcccccgggctgcaggaattcggcacgagcagcatcccaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcacraaaaaaaaaaaaaaaaaaaaaaaaaaaaaaaaaaaaaaaaaananaaaaaaaacnaaaan

SEQ ID NO: 2611 - DNA, 1104 bp, Homo sapiens
gctcgtgccgctcgtgccggtttcttcttaagtttatttgtcttacacagagctgatagaggcagactaggaatccttttgcagataaatgggcttgatcatcttccctctgggcttctctactgaatttactttaaawataatatggcttcttaaaaaatggcagtgtgtcaacctccgaaaaccaaaatcttacaaactcagcacccagaaggtgcattgctctggccttcctttcaccttcaaccatgatgaaaaatcccttatcaaaattcagtggttgcacctgggtttcatcattgcttttcttgcaggcattttctcttctcagtggtttggaggacagttatgactgtgtgaagtcatcttctcttcattgttgtgtggctgttcttcagtgtatgtctcctccagaagttcagaggacmcctgtcaaagccaagaacttcctgctttctgtcatcataagtggggctgggaaatccctgacaccttgaagaagtcctgggctgtcaggagtcctctgacccttattcatgagagagagattatataccatcttctctcagggcagtggttctcaaacttgagcatgtggcagaatcacctggaggcatattaaaatacaaattgctaggcctcacccccagagttatgattcaaaagatctagggagagattcaataatctgcattttctaagttcccaggtgatgcttattctgcaggtccagacatcacacttcgagaagccctgccccaatgcctcatgtaagaggatgctaatgaatcttggacactgtattacttgtttcaatcaagaaaggaaccagtgttttgggtaattatctggagaaattgaagaggacatagaaaacatctggtgaacagaaagaagttgctttataaagtttacactacaaaaaggccagtgtacacagctttcagtttatgctcttggtaaagattttgagtgccaaagttttttctcccattcattaaatgaagttaaatggacttattacccattgatcaatagcttgtggtctgcccactctttcagggaccactgtgcctgacataatcctaacattcacggcacgag

SEQ ID NO: 2612 - DNA, 1424 bp, Homo sapiens
gcgcatctcttctctctccccagctgcactctgcctgcatcctggctttttcatggcgtgaatctccttcccggtcaggaaccccggctgaccttctctgtcccatgcctggccctgcctcccccgcaggctggtttctgcttctcctctaccctctccctcctgcaccctgcctggtgccctggggcagcccacctggcacaccagccaggcccccggccgctggccatccccacagactccctgctgtgcacgcacctctggtaggggacctggcacctccctgtcccctcacggctcgcctggcaccggccccagccactgtctctgactttgcaccttgggccaggagccccgatagctgctctgctgccaactcctggggtctcctgtgccatccgggggggacctgccagcctctcgtgcctgggccagggtccgcctccctgggggacctgtgacatgcatgtttgggcacacagggtccgtcccctccgctctgatgctgctgtgggtgcttcccatgttctgctgtcatgaccgacacttccctgggtgccccatgtggcatctgtgggtgccccgtgtggcgtcagtgggtgccccatgtggcgtcagtgggtgccccgtgtggcgtctgtgggtgccgcgtgtgacgtcagtgggtgccccatgtggcatctgtgcagccatgtcaggtgtgcaaagcctcaattccaagaagggggatgctgggtcccaggtcacctccacttacaattctgacagctgcgacaaaccctcctgataaatgaccgtccggtttactcaccagycgcagccagtctctgcggctttgccaatctgttagagtaaactcactcgtcgagttaatttgcatttttgtaattatgaatgagaccaagcatctgttcgtatctactcgcagttttaatttttcctctaaatccccatgcaaggactatgctttctccgctgaggtaggactgccgagcgcccctgcgcatcagggctcgcctcagcctgggcgccgcacacacgcttgctgtgtgtgttgccagcttctaacgttgtgcgtgtgtcttctcacatccaagagctctaagtgcccatgtgtggaatctgacctgtttatcttcagcagctttgcaggaggatgttctccaccccgaggctacagggacagctttcctttgtttctgctaatatttttataattttaagatatccagacctaatctgtttgaagcctcactctctggggtgtgaacttggagggcaccctccggctggcaccataaggaagggctcctcctgcccctgagacgctatccttgcagccgcggagcctcacatctccaggtctctgcatggccgcgggcgaggggccccttggagcccagaggacgcagtcggccctcgag

SEQ ID NO: 2613 - DNA, 1158 bp, Homo sapiens
  misc_feature (1145)..(1145): n equals a,t,g, or c
ccactgattccggccctgggtgacagagctgaaaaaaaataagataaaacatagatacagaaaaccacaaaggaaaaacatagcatattgaatcatcacaaggcagccaccccttcatagccacacccagcccctggccaccgctgacctgtgctccatcaccagaattccgttgtctcaggaatgttcgataaatggaatcctgtgtggcctgagatgagtgtctttcatgccacatgacacccttgaggcccgtgcaagctgttggcatgtcaacagttagctgcttctcattgctgagtggcgattggtcctgtcatggtttattcagccatgtggtggatggctacttgtcttctaagccacttgccttctgattgctggactgactctctcgccctctcttggtgcagccctcgggaggctcagtcacactctccgagagcacagccatcatctcccacggcatcacaggcctggtcacatgagatgctgccctctacctggcagaatgggccatcgagaacccggcagccttctctcataggtgacctcggggcgcacggcaggacaccgaggcaggctcaccctggtgcagttacagacatggtcccctttcctcccgccaggactgtcctagagcttggcagtggcgccagcctcacaggcctggccatctgcaagatgtgccgcccccgggcatacatcttcagcgactgtcacagccgggtcctcgagcagctccgagggaatgtccttctcaatggcctctcattagaggcagacatcactgccaacttagacagccccagggtgacagtggcccagctggactgggacgtcgcgacggtccatcagctctctgccatccagccagatgttgtcattgcagcaggtaatgcccagccccaggaatcctgtgcaggcggtgtccttgcagctctacccagctctgggctctgggaaaagggaacaatggacgctgtcaggcatggacatgatggggcttccagaagagttactctgggcctccaggctgacatcaaaggacaggggtgcctcttaaggtgaccttcaagccacagccctcttgctggagacaggcatactcccgttccagttgtcaccacatggctctgtcccanaaccatgccctgt

SEQ ID NO: 2614 - DNA, 940 bp, Homo sapiens
gtgcgatggaaagtgccttcattctagcctgacaaaggtgggttcagtggatggcagcaaacacaattattgaacagatctgagaaaaatttcacaattttctcagtccttaattgctttaatatttaaatcctggccttctggaaagtctcaggtggtgaaatcaaaattcatattaaaatgcaaatgggcaattaaataattgargttatttaaataatgtatattctttattttcatacctgcttgaatatatattgtaaaggcgagttaatttatgctaaaaaattatgagacttctgaaaaatgttctcactcaaatgttaatcatttctttctccacctgttcttgtttgtttagtttgttttgtgctgtgataacagaatgcctgaaactaggtaatttatattgaaaagagatttatttctcatacttctggaggctaagaaatccaaagtcagggggcttatattgagccagggtcttcttgctgtgtcatctatggcacaaggcagaaggacaacagaacatgccagagacagagagagacagaggccaagcccatcttcttatcaggaacctattcccataacagcattcattcattcacaagggcagaactataatgtcctagtcatctgttagagatcccacctcccacactgttgcattggggactgtgtttccaacacatgaactttgggggacacgtccaaaccatagcagaccctaaatttaaacacaggataataataaacagtttctgtgacagttctcacactgagggaaacaaaaacaaacaaacaaaaaacaattaggactgattcactgctgtttttccctttcttatagtgaaaagaaattcagaagctaaagaagttcttagtaaattaattcttaaaatgcttacaatgtaagtgtattaaagaccattttaag

SEQ ID NO: 2615 - DNA, 1658 bp, Homo sapiens
ggcacgagttgtgacatggttctgtctcgtttcttgattagttttatggtttcctgttgggaccaaaatttgatcttatttctaacctgcttgttggcagtcctgatattttgcctggttctagctgtgtacattgttttttttaaattcttaaaggcaagcttgatttatgttccaagagaatgggtcaccttgaccaaggctaatgatgttcagaaaggccatgacttggggctatcttactgcaggacgcaatccactgcttggccaccaccctgccttggacatcatctccatcttgaatcaagcctaactttggaatcatttgggctactgaccattcccattagtgattctgtatcactaattacttgactaatcccagtcttgctagtctcaactttctgcctttcagcactggctccctgttggggttacagtgtgctatttggctgaactcatctgaattgcagcaagcatctaaattgcagctggcatctcaatagctccagttctatagaggttgtcaccacagactctctgtctcgtttctatcttaaaacatggatgatcaacttgaatacctctgataactgcagagtgatattgctaaataaaatttccctgaaacttttgccatttgacacatatgaaagtttgaaaaagagtatgtatggattctgttcctttatctctaggtattgatacactcaacctgtgtgttcaaacttcatagctctaaacctatcatgacctaaattcttgccccttattctcatggtatcagtgttcatccttggacactaatggtattatcatttttatataaagccagtcatcatttaggtattggagagtccagactccccagtgagattaatagtttgaacaaatgttgaagaaaagaaaaaatattgtcagggaaactggaagaaaaaccagcagtatcttcattttcctaagatattttgacaatgcaaaaataatagccaacatttattgagcatttattatgtgccaagtgctcttctaattgtcttacatgaatcaactcatgtaaacctcattacaacctgatgaagtagatactattattacccccattttatagaaaatgaagcaaaaatagagaacttaaataacttgccaaatgtcacgggtggtaactgaggtgtcaggattgatgcctcgggtagtctggcggctgttttacctcttaaccattatacaattacagagtttaattttttacagtttcagggaaatacagagctttcctctgacagtaaaattagaatatccaaccgggagtggattcacctaagaattggtgagactgatatacatgatctgaaacaaaagtctgaaacaaaattaattaactaactaatgaaagtcaataactaaggtcaaagaaggtcagaaaaaatgcaaaaatcagactcaccaacaaatattcatgttgcagtacatggcttgaagcctgttactgagaaatggtcttgtggtgcaacaatactaaagttcccatgaactttaagaagttgaccaacttatttcaaagtattggcatgctgagttgtcaaaatgacatccctgatttttttggtggagatggggtttcgccgtgttggctgggctggtctccagctcctgac

SEQ ID NO: 2616 - DNA, 1263 bp, Homo sapiens
  misc_feature (1256)..(1256): n equals a,t,g, or c
gaggagatcgccacctccatcgaacccatccgcgacttcctggccatcgttttcttcgcctccatagggctccacgtgttccccacgtttgtggcgtacgagctcacggtgctggtgttcctcaccttgtcagtggtggtgatgaagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataattaattgaaatttattaaaatctgtttttattaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgcctttgcagcacatcccctttgncagcttg

SEQ ID NO: 2617 - DNA, 695 bp, Homo sapiens
acgcgtccgaggcgagagccctgggatgcaccggccagaggccatgctgctgctgctcacgcttgccctcctggggggccccacctgggcagggaagatgtatggccctggaggaggcaagtatttcagcaccactgaagactacgaccatgaaatcacagggctgcgggtgtctgtaggtcttctcctggtgaaaagtgtccaggtgaaacttggagactcctgggacgtgaaactgggagccttaggtgggaatacccaggaagtcaccctgcagccaggcgaatacatcacaaaagtctttgtcgccttccaagctttcctccggggtatggtcatgtacaccagcaaggaccgctatttctattttgggaagcttgatggccagatctcctctgcctaccccagccaagaggggcaggtgctggtgggcatctatggccagtatcaactccttggcatcaagagcattggctttgaatggaattatccactagaggagccgaccactgagccaccagttaatctcacatactcagcaaactcacccgtgggtcgctagggtggggtatggggccatccgagctgaggccatctgtgtggtggtggctgatggtactggagtaactgagtcgggacgctgaatctgaatccaccaataaataaagcttctgcagaaaaaaaaaaaaaaaaaa

SEQ ID NO: 2618 - DNA, 752 bp, Homo sapiens
acgcgtccgattcctggcctgaacaacatcattgacataaaggtcactgacccccagctgctggaacttggccttgtgcagagccctgatggccaccgtctctatgtcaccatccctctcggcataaagctccaagtgaatacgcccctggtcggtgcaagtctgttgaggctggctgtgaagctggacatcactgcagaaatcttagctgtgagagataagcaggagaggatccacctggtccttggtgactgcacccattcccctggaagcctgcaaatttctctgcttgatggacttggccccctccccattcaaggtcttctggacagcctcacagggatcttgaataaagtcctgcctgagttggttcagggcaacgtgtgccctctggtcaatgaggttctcagaggcttggacatcaccctggtgcatgacattgttaacatgctgatccacggactacagtttgtcatcaaggtctaagccttccaggaaggggctggcctctgctgagctgggtcttcccccaacagaactatttcttgctgctcaatccatttcctctggcccagcttcccagtgctcacagatggctggcccatgtgctggaagatgacacagttgccttctctccgaggaacctgccccctctcctttcccaccaggcgtgtgtaacatcccatgtgcctcacctaataaaatggctcttcttctgcaaaaaaaaaaaaaaaaaaaaaaaaaaaaaaaaa

SEQ ID NO: 2619 - DNA, 424 bp, Homo sapiens
gcccttgagaaggtgccggggggacagggcttgcactgtttggttactctggtaaccaccaaagtgctgcattttctaaattgaaacaaagttgggtgtgcagagacagactagaagtggagcttcatctctgaagtaatgcatgttgttcattggagcaggctatttcttttgaagcctccttactctgtacatgcaacctttattcccaccgggttcttagcaagatttagaacacctggaattcttgactcttgcttcttccattcatggcctcttttgctttcatacttcctttccccccaatctcctcttctgaaataacctgaactgtctatggtcttcttatcccacttgtttggcaccaagagattattccttctcttggccctaatttgggcttcttggcatttttcctatatgc

SEQ ID NO: 2620 - DNA, 813 bp, Homo sapiens
cccacgcgtccgccagcaccttcctctcccaggcaaaatgaaaatacttgtggcatttctggtggtgctgaccatctttgggatacaatctcatggatacgaggtttttaacatcatcagcccaagcaacaatggtggcaatgttcaggagacagtgacaattgataatgaaaaaaataccgccatcattaacatccatgcaggatcatgctcttctaccacaatttttgactataaacatggctacattgcatccagggtgctctcccgaagagcctgctttatcctgaagatggaccatcagaacatccctcctctgaacaatctccaatggtacatctatgagaaacaggctctggacaacatgttctccagcaaatacacctgggtcaagtacaaccctctggagtctctgatcaaagacgtggattggttcctgcttgggtcacccattgagaaactctgcaaacatatccctttgtataagggggaagtggttgaaaacacacataatgtcggtgctggaggctgtgcaaaggctgggctcctgggcatcttgggaatttcaatctgtgcagacattcatgtttaggatgattagccctcttgttttatcttttcaaagaaatacatccttggtttacactcaaaagtcaaattaaattctttcccaatgccccaactaattttgagattcagtcagaaaatataaatgctgtatttataaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2621 - DNA, 762 bp, Homo sapiens
cccacgcgtccgtgctttcgtgaagacaagatgaagttcacaattgtctttgctggacttcttggagtctttctagctcctgccctagctaactataatatcaacgtcaatgatgacaacaacaatgctggaagtgggcagcagtcagtgagtgtcaacaatgaacacaatgtggccaatgttgacaataacaacggatgggactcctggaattccatctgggattatggaaatggctttgctgcaaccagactctttcaaaagaagacatgcattgtgcacaaaatgaacaaggaagtcatgccctccattcaatcccttgatgcactggtcaaggaaaagaagcttcagggtaagggaccaggaggaccacctcccaagggcctgatgtactcagtcaacccaaacaaagtcgatgacctgagcaagttcggaaaaaacattgcaaacatgtgtcgtgggattccaacatacatggctgaggagatgcaagaggcaagcctgtttttttactcaggaacgtgctacacgaccagtgtactatggattgtggacatttccttctgtggagacacggtggagaactaaacaattttttaaagccactatggatttagtcatctgaatatgctgtgcagaaaaaatatgggctccagtggtttttaccatgtcattctgaaatttttctctactagttatgtttgatttctttaagtttcaataaaatcatttagcattgaaaaaaaaaaaaaaaaaaaaaaa

SEQ ID NO: 2622 - DNA, 3339 bp, Homo sapiens
gctatttaggtgacactatagaaggtacgcctgcaggtaccggtccggaattcccgggtcgacccacgcgtccgcggacgcgtgggcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaaaaaaaaaaaaaaaaaaaaaaaaaaaaaaaaaaaaaaaaaggggggggag

SEQ ID NO: 2623 - DNA, 644 bp, Homo sapiens
gctgggatagagcatgaaaggagaactgctcccttttctgtttctcacagtttggttatggctttataaacttktatttggtgaaagccccagatacccaaatgtcattggcaaaacttatttttttttctggacagatcagatttctagagagagcagatttctagagagattagcattcatagtaagtgaaaattgtctaatttttttaatccatgctattactgggcagtaggtctaattttttttgacaaaaaatagatctattttccttatatattgatttagaatcttaagttagaattttatagaagaaatgtctgagcagttctatgtatggaggagcaattcagcttttcagcagcaactttatcttttgccactagagggagatctgtggttgctttctcctttggagaatagctgctttgcttttatttttaatttctaaggttggaatagaacttattctcaaaattcctttagtgttattaaatattttcatttattagtcaaaggtaagttaattaagcttgtttaatgatgccaatcttatgcttttctgtaatcttcaatttttaataaatgtgagttagatactaagtgaaaaaaaaaaaaaaaaaaaaaaaaaaaaaaaaaaaaaa

SEQ ID NO: 2624 - DNA, 1218 bp, Homo sapiens
tacgcctgcaggtaccggtccggaattcccgggtcgacccacgcgtccggctaggtggcagcggagccaagctgacccggcgagcggagccggggctggagagcggcgaccactgcggatctcggaaggaagaaatgatgtaaatcactcatccaaactttaaggtcaaaggtgagaaggaaggtcaggaagaacatggcctggccaaatgtttttcaaagagggtctctgctgtcccagttcagccatcatcatgttgtagtgttcctgctcactttcttcagttattcgttgctccatgcttcacgaaaaacatttagcaatgtcaaagtcagtatctctgagcagtggaccccaagtgcttttaacacgtcagttgagctgcctctggagatctggagcagcaaccatttgttccccagtgcagagaaagcgactcttttcctcggcacactggataccattttcctcttctcctatgctgtgggcctattcatcagtggcatcgttggggatcggttgaatttgcgatgggttctgtcttttggcatgtgctcttctgcattagtggtgtttgtctttggtgcgctcacagaatggctgcgtttctacaacaaatggctgtactgctgcctgtggattgtgaacggcctgctgcagtccactggttggccctgtgtggktgctgttatgggcaactggtttgggaaagccgggtatgccacttccttcctctctaatttctctgtttaagtggtttccatggtggatttttcagacttgtcaaagtcagttactttgctgccttagataccacccacatctttcgttagcaagtcagagttgttcagggagagagggtttcacgtcagtgtgcgttggaaatggtgtggaccttagaagtcatccagcctaggagacacactcctaccactctttgggctgtgggcagattctgagtgtgggccaaggcaggaggtctcaattttttgttttactcatcgtttctttatagaacataaaaatctcatttactatccatcatgtatcttcctttgggttttgccttccctgcccttttwkgagagtgatcttatttarcctttttacattaaagataaggaaattaaggtcaaaggttattcatgttgacctgcccaaggtcatgtaacaagggctctaattagactcagatgaagaacgccagactttggggct

SEQ ID NO: 2625 - DNA, 1692 bp, Homo sapiens
ccacgcgtccggccgcggggcgggcggcggcggcggcggcggcggccgggacccagcgggccaggtggggacggcgcggagcgggtgcgggagatgccgtgcgggactggggccacctgagccgcccgcctcgtccccgccttctgtgggaaggatgtgcgcgcggatggccggtcgcacaacagcggcccctcgggggccctacggcccctggctctgcctcctggtggccctcgccctggacgtcgtgagagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccagcagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctgga

SEQ ID NO: 2626 - DNA, 1365 bp, Homo sapiens
ggcagagctaacccgagtgaagccacttccgggcttcccgggcgccttccgcagtcctcttccgggtgatggcggccgggtgccccggatgtagccctggcgcaagatctcttcttttttccacctcgccttccgcggattcccagcttgagaaacacctctttgccccgtcatgccaaagaggaaagtgaccttccaaggcgtgggagatgaggaggatgaggatgaaatcattgtccccaagaagaagctggtggaccctgtggctgggtcagggggtcctgggagccgctttaaaggcaaacactctttggatagcgatgaggaggaggatgatgatgatggggggtccagcaaatatgacatcttggcctcagaggatgtagaaggtcaggaggcagccacactccccagcgaggggggtgttcggatcacaccctttaacctgcaggaggagatggaggaaggccactttgatgccgatggcaactacttcctgaaccgggatgctcagatccgagacagctggctggacaacattgactgggtgaagatccgggagcggccacctggccagcgccaggcctcagactcggaggaggaggacagcttgggccagacctcaatgagtgcccaagccctcttggagggacttttggagctcctattgcctagagagacagtggctggggcactgaggcgtctgggggcccgaggaggaggcaaagggagaaaggggcctgggcaacccagttcccctcagcgcctggaccggctctccgggttggccgaccagatggtggcccggggcaaccttggtgtgtaccaggaaacaagggaacggttggctatgcgtctgaagggtttggggtgtcagaccctaggaccccacaatcccacacccccaccctccctggacatgttcgctgaggagttggcggaggaggaactggagaccccaacccctacccagagaggagaagcagagtcgcggggagatggtctggtggatgtgatgtgggaatataagtgggagaacacgggggatgccgagctgtatgggcccttcaccagcgcccagatgcagacctgggtgagtgaaggctacttcccggacggtgtttattgccggaagctggacccccctggtggtcagttctacaactccaaacgcattgactttgacctctacacctgagcctgctgggggcccagtttggtgggcccttctttcctggactttgtggaggaggcaccaagtgtctcaggcagcgaggaaattggaggccatttttcagtcaatttccctttcccaataaaagcctttagttgtgtaaaaaaaaaaaaaaaaaaaagggcggccgc

SEQ ID NO: 2627 - DNA, 2339 bp, Homo sapiens
  misc_feature (12)..(12): n equals a,t,g, or c
  misc_feature (2238)..(2238): n equals a,t,g, or c
  misc_feature (2293)..(2293): n equals a,t,g, or c
  misc_feature (2316)..(2316): n equals a,t,g, or c
  misc_feature (2335)..(2335): n equals a,t,g, or c
  misc_feature (2338)..(2338): n equals a,t,g, or c
tttgggaaaaangctatttaggtgacactatagaaggtacgcctgcaggtaccggtccggaattcccgggtcgacccacgcgtccgagcagctgctggaggctagggattgtctcaggtgcctggagcccctcaccccttgggagaagtgggcgtctgtcttcagacatcagagctggccccaggccacgtctgacccagagctgcagccgtgaggttccctcacggtgctgtccctggcaaccagacccttgttgggcttatagatgagggtatcttgctcaaggtcatgctgcagcctgccccctataagcctctccctgaggttggtggcctcttgtcttccctgctgcctctgcctctctgcagcccccaggatgcaggaggagcctggacaccttcggcccagtcgggccaggcctctggaaggcccttcatgggactctccatccttggccccgccggcctccgcccaacgtcctcttcctcctccagtttcccgtatccttcccgccacttcgggcagggctgggaggtggtgcggatgggcgccatgccccaaaacagcagcctgagcaccgcagtgccttccgggatgggtgatgggtgccaagtgttctggccacccgccccctgccgctcacagctttcaccaccagcatccggctccttcccgctcttctccccgctccaggcacctccctccccctcatcggatccggcccaggctccaggatcctgtggaagcagctcccagcccaggcacgccccctgcagcccacccctccctctcgctgcccccagcagttaggaggcagccggtcccatggtgggccttgcagtccgaaatgtggtcccctggggggacagaggacatgggctcactgcgggagccggagttgggtcctcatctccctggcttggattcctgaccaggctgaaagctgggtccccagccacctttctcttcctccaccaggttccaggggggtccccctgtggggtgcctcctgggtggtcgcccgcaggccgccctccgcctgtgcctaggccagagccaggcactgacaccaagcagggacgggcctgggggggacacccagtgccacagctycacccgcgccccacaggtggcagccgggggtgtctgaggaaactccccaccccgcaccactggagaatgttcccaggacctcgcctgctgcctgaaaagcccactctcgttctggtgcttattttcccttcctttttaggccatgatttctggagagcttgacattctcaaagactggtgctatgaagctgtgagtacttcctttctttttctttttttttttttaaggcctaaaaaatcaccatggagaagttccacttcggtggctccgttggggtagctcccaacaggcaggacctgggctcccggtgggggaatcctcacgtctcaccctccgagagcctgacatccccccctgcccctttccattcctcagcatgtgacatctgggctctcaggctggacaccgggtcacccgccagtcctttgctcccagactgtaaactttgttagggagaatccttctctgggctggtgtctaagagatggctggttgggggtgtcccctgggcctgtgagagatcacaaagctgccaattttactgggccttttttttccctccaatcttaaaataattttggttaggtctgggcacggtggcctatgctttcaatcccagcagcccaaggcgggagattgcttgagcccaagcattcaagactagcctgggaaacatagcaagatcccgtctctacaaaaacatttaaaatgagccaagtggcagggtgcggtggctcatgcctgtaatcccagcactttgggatgccaaggcaggcgattgcctgagctcaagagttcgagaccagcctgggcaacatggtgaaaccccatctctactaaaataaaaagttagccaggcatgctggtgcatgtctgtaatcccagctactggggaggctgaggcagtagaattgcttaaatccgggaggtggaggttacagtgagctgaggtcgcgccactgcacttcagcctgggcaacagagcaagattctgtctccaaaaaaaaaaaaaaaaaaaaaaaaaaaaaaaaaaaaaaaaaaaaaaaaagggcggccgctctagaggatccctcgaggggcccaagttacgcgtgcatgcgacgtcatagctctctccctatagngagtcgtattataagctaggcactggccgtcgttttacaacgtcgtgactggganatctgctagcttgggatctttgngaaggaaccttacttctgnggng

SEQ ID NO: 2628 - DNA, 1493 bp, Homo sapiens
  misc_feature (1348)..(1348): n equals a,t,g, or c
gtatgattatgcatgagtcacgcaatgttctggtcctggattccaggagtagaggacctagctttaratcaattagtttcagctaaactgactrgaaccaggtcaaagtgtaattctccctccagctcccccaaaccccagagttttggggttgtggttgatgcagtgtgggatgtccctgagaggtagcaagtctagggtggtgagttcctgctaggcaaccaaatttaagctcctcactttttgtgacacatggtgtcagatatggggtcccgcacctatatctggatgaagaggtagaaactctggacctcattaatgagttatttcttggccttcttctaaggactaggagagctccttatctgtctgagaatggggaccagctctgagtggggttgctgcctgtattccctgtttctcaggaacttacatgggtctggggaggctaggtargtgattgtacgtggttgctcttctccttggctgggggaggtaatgagcagatctctgtgggtgtggagcttgttggggggatgtctaggaagcttcagcttagccacattcccaagtttaggtgcactgagccatatagcccagtgtatgcatgtgtgggtgtgttcatgcacacacacactctctctcttgtctctctgtctctctctcactctttcttactctcttctcaggtcacttgtacacttggtttcctagtagaagctcacttgccacctctcaggggggtcccggattgcatccatcacaatcccaaaactagagttggggggaactggagggagcaaaacactgatttgatactagtcagtttgcttgaaactagttcacctaaagctagatctcttaaaaccaatttactgaaaacttgtttgcttaaagttaatgacttaatgactaatttgccaaaagctcaattcctattttggtgtgtttatatccatttaggtgtcctattcttttttgtcatgctttggatatttcaaggatttatatctattcatccaagagtacttctgagytattatcagcaacataaatttatcaaatttgcagcactttgtaaatgatgagattgcttcctacctttatggatgtctttttctatgttatctaccattcaaaaacttttttaaaaagtttaaagtttctagcaataaatacaattggtacagacattttgtgtatcatttttttgtttcttaatccaatattcctttacaaattaaatgccttgaaaaatataatgggagttcaatgtgattttgatgctttgggtctaacttctacattcctactgttaaaaaggccagtatatcttaaacaaatggantgggcctgggggcatattcagttggacttacatggaaaggttattacaggcaacagtaattaactaaaggggtggattcggctaaatccctttggaatggcggcgggtttggataaattttatttttgggccattcgggtttggg

SEQ ID NO: 2629 - DNA, 1860 bp, Homo sapiens
ccgggtcgacccacgcgtccgctcaaatttgtgatattgcatgcagaagatgacacagatgaagccctcagagtccagaatctgctacaagatgactttggtatcaaacccggaataatctttgctgagatgccatgtggcagacagcatttacagaatttagatgatgctgtaaatgggtctgcatggacaatcttattactgactgaaaactttttaagagatacttggtgtaatttccagttctatacgtccctaatgaactccgttaacaggcagcataaatacaactctgttatacccatgcggcccctgaacaatccccttccccgagaaaggactccctttgccctccaaaccatcaatgccttagaggaagaaagtcgtggatttcctacacaagtagaaagaatttttcaggagtctgtgtataagacacaacaaactatatggaaagagacaagaaatatggtacaaagacaatttattgcctgagatgaaacatataacatgtggctggctcttgttttgtaaaccaaatgattaatcttcacttgagaaagcagtttctaggaaatgtttaaataaaagagagtcttcaccttaaagaaacctatggagcacaagaaagataaatttctgcaggacagtctataaaattgtggtactttttgatgtttcagtaaacttgacattgtcagagtttcaaggacttttctttcacaattttcctagttcatggatatgaaaaaggaattctcaatccatattccttgtattgaaccttgaacaaaaacttgtatgacagacatttttaaaaatgtgacaacacttttattctctgaattttgatctcaaaggacacagaaaaaaaatggccccaggagatctgatcacacttcctcctgaggcacctctcatggatgttgcaataagcattcgggtactatcacccagaaatatgaattgccagaatagaacatttagcatgttaagcgttgatgcatataaaatcagaaatagatgtgagaatggtggaactttttaaaagaacccagtcaaatgtattttctgctgaaatctgcatatttggaggcatttcccaccaccgattcacagcccatttgatagtgtggtagttagggacttcgtggagtggtgttcagacgtcccctggggcttaaatctcttcatattagtcatcatttgtaactatggctttatttgcagagcttctaaaaggcgtataactgtgtgagtggccagatattcactttttaaatcaaaaacctctcttatggaagctttaaaagtttccgtcacacacaattctcttctcaggaagtatttctcatttaggtcttcaaagtagcctgactgtgtgcatgtgtgtgtgtgataggttatttataaagactttggatagaaggagatgtattttattacctcctattctagagccccatgctcctaacaagccagagaggccccaaacaggattgtttctttcctccacagcccttctgcccatctgagattgagggagcatcgtccacttgagatcagggatggggtggagaatgggtcatgtcatgtaatgagaaaagccctcttcgggatcatgagacttggttctagtccaatttctgccactgaggatgaatgtaactgtgggcaaactatttaccctcctttatctgtgaaatgaaagggttgaattgatggatctctaaaggcttttgtcctctatgaggatgtgaaaaactagggaccacaaaagggaacaagcaaaaaagtttggattcgataaagtgatatgtaatagttgcagaaggctttatatatgcttataatgaaaag

SEQ ID NO: 2630 - DNA, 1624 bp, Homo sapiens
ccacgcgtccgcgtgctcggtattcagttttccggagcagcgctctttctctggcccgcggagcggtcccgcggccgagtaccggattcccgagtttgggaggctctgctttcctccttaggacccactttgccgtcctggggtggctgcagttatgtccgcgctgcgacctctcctgcttctgctgctgcctctgtgtcccggtcctggtcccggacccgggagcgaggcaaaggtcacccggagttgtgcagagacccggcaggtgctgggggcccggggatatagcttaaacctaatccctcccgccctgatctcaggtgagcacctccgggtctgtccccaggagtacacctgctgttccagtgagacagagcagaggctgatcagggagactgaggccaccttccgaggcctggtggaggacagcggctcctttctggttcacacactggctgccaggcacagaaaatttgatgataacccggaccctggtggctgcccgagcctttgtgcagggcctggagactggaagaaatgtggtcagcgatgcgcttaaggttggagggggcctgagtatgggcagggcccagggagggagaggtggaagtgaggagaccccacaaggaagaaacagccaccagccagcaggacagccttgggctctgtctgcctccaggccctggtgtcctaggatgaattaggaaggagggggctggagtgaaacctccaatggtccacgatccatgatctctgaccccctcctcccctctgtggacccataccctcctcagtccccaagggcctgctcatctccatagcagtaggagattggatactgcccccgcccaaccccccaggatccctcaatgactccacttccctgctgctgaaggccagatgcctggcttggcctctctcactgcccatcctctacctgacctcccagcctcaccttctgcctcctgaccgcctcctccctccccagctgtgatgggctcactcttgtccttgaatgttccctccacccctaactgcctctctatttccaccctcccacgaatcagagtcagcaacctggaacctccctcctcagatctgtgacaatctcacctgctgccacgtggggtcaccaaccctaggtgtagggtggggtatgtgatttctgtctgtgcccagcaccaagccaggctgagagcagccacagcgtttgtggaggacacagccccactctctgcccccaggtgccggtgtctgaaggctgcagccaggctctgatgcgtctcatcggctgtcccctgtgccggggggtcccctcacttatgccctgccagggcttctgcctcaacgtggttcgtggctgtctcagcagcaggggactggagcctgactggggcaactatctgggtgaggggattcaagaaagcctggagccaggcatggtggctcacacctgtaatcacagcactttgagaggctgaggcaggaggatcacttgaggccaggagttggagcccagctggggcaacatagctagacgtcatctcaagaaagaaagagagagagagaaagaaagagagagagagagacagagaaagaaagaaggaaagaaggaaggaaaaaa

SEQ ID NO: 2631 - DNA, 2329 bp, Homo sapiens
gcgtccgcaagatgtccctgtggactcccaaactctactccagatggggaggtgcccttaacaccaagattttaaaagctccaatttcagagcaagagtcgaaaactcacagataaagttatagttatttcagggttctgaaaagacgcagaacatgaagggactcagaagtctggcagcaacaaccttggctcttttcctggtgtttgttttcctgggaaactccagctgcgctccgcagagactgttggagagaaggaactggactcctcaagctatgctctacctgaaaggggcacagggtcgccgcttcatctccgaccagagccggagaaaggacctctccgaccggccactgccggaaagacgaagcccaaatccccaactactaactattccggaggcagcaaccatcttactggcgtcccttcagaaatcaccagaagatgaagaaaaaaactttgatcaaaccagattcctggaagacagtctgcttaactggtgaaaatatactggattatgtttaattatggttctattctctttgaaaacatgaaccatgtgaataaaacctttggacccttttattccatttgtaatcttaagaacacacacagatagttttattctttcagaaacaaaatatatataggatgcttagctgagaacatcatcttctttcattgcttcaggtcctgtttagatgaccaaaaatgttttcagatcaccttgtgtcttactcttgagtttcttagaatatttataattataaggctgaagactaaagtgttctttccttttaactatagccagtacctgtcttgatcttagttgtgtttttttttttcattttgttacccacttgcattttgttttcactcagcagaaattctccttctctgttttccttttatcccatccccaagaatgtggaaggaaggtgagaaacatggcaggatgggaaataggagagtatgactctctatagctcatccaggagtaatcaattaagaagataaattggatgactgtggagaagctctgtgataggaacacttcagtgtggttgctgagaggagacagtcattgaggtagaaggtttgccaaagatccagagctcagagctccctttgtgctctttgggaattaccttgcattcagtttagaaacatggatctaaaagttactgggaaataagcagatggagacacactctgttgtttacgtattggaagaagggaacaagccagttttgttagaggtaactcattttccatgaccaaacagactcaacagattcaagtactctgcttactctaattgactagactctaggttttatttgacatcatagcattacataaatcactctgataacataagtgcacagtaatatgcctgatctcttcctttttaaaagccaacttgagttcagtaccatctgaatacacacacatgcacatatacccacacacgcatacacacatactcctgtggcaaacataataatgtatttatttagaattataatatgaccatcatgttaattattttttacctaatcagagttgttattgacaaatgtcataagtggaaagtattaattcttattgtcatcagtatttagccattatttagtagctcaagaatatctttatgtgaatgtctctgtaacttggaattgcaatttcactgtgttaagtaatcagaactctgcttataagatttatctgtatcttgtttcataatttaataatgaaactaaattcaagttaatgtaatgttgatctccgtcgaaaaataacttgtgagcattaaaatatctgtatggcattataataggcacctgtcattaattatgatttgatttgaaagtagacttactaggtagtgcttacatctgatttattgaaaattttttccaaaagcattgtcttttatttatacagtcctaaccacttcaccattaggaggggtgggacattaaaaattatttacccatcagacataaaattgtacaaattgactattcaaaatagtatgtgtattcaaagaacacttttaacatctatcttatgaaataattcttcctacaactaaccagaacaatctcaaaaatgtcatactaaccattgttttaaaagctgtctcaatgatcaatagctgttaaaatatagctccaagtattctaagtactcaaattccttgaatgttcttatgtacaaatatgctgattaattaaaaggtccctcttcccaaaaaaaaaaaaaaaaaaaaaaaaaaaaaaaaaaaaaaaaaaaaaaaaaaaaaaaaaaaaaaaaaaaaaaaa

SEQ ID NO: 2632 - DNA, 1898 bp, Homo sapiens
tcgacccacgcgtccgcccacgcgtccggccgctcgtccgcccggcttgaggcccgcggggagcgcggcgcaattcgtcggcccgcgggggggcggcctcccggcatcttcgcggcgaccaaggactaccaggaaggggagcggctgggatggcgcgtccgcggccccgcgagtacaaagcgggcgacctggtcttcgccaagatgaagggctacccgcactggccggcccggattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaagggacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaccactaaggattatcaagatttttgcgcagacttatacatgtctaggatccttttatcaaggcagttatgatcatcggtttcctgccttgccccaccatcatcaaacactcagttaaatattaaattaaccattttttagattgacccactcaaccttaatggctttaagaaatgggaatttccttctyttgtggacmgaaaccccaggaatttaaattcccttaaaatacmcttaaccgttggkattatttggaaagaccgaaaattwtaaawwrtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaaataaaggcaatgatttatttttttcccagtgccaatacaattttgagctaagcactcaaggtggatactttacattttaaagctggaatcagcaacagccctatgggaaaccagacaaagcattgacttttaaatgtagacttttaaaataaactggttcttttggaactacaattagaatagttaatattcatccttaaaccattattatgtgtacattattgttgctattgtgataatagagaattttatttatttttatgccagcttatattgtgagaacacatttagtcagtttggggttttatcaatcctgttaatgcttgtccttggaacatcttcgcgtattcacggtttgtagttgaaaaagttactgtaaaaaaatcaaaaaccaaaaaatgtattggtttaccgaataaaattattggaatggaaaaaaaaaaaaaaaaataat

SEQ ID NO: 2633 - DNA, 2833 bp, Homo sapiens
aggtaggccaggcattcttccggaaaggcccactgaggcaggstcsggctcctctggttggggctgttgttttgatggatcgtgtgcttttcccttacctcttatcacttgctgtcatctgttgacttaggcccagtctgcagatgtgtgtagtgttcctttttgggttagctttggcagtattgagttttacttcctcctctttttagtggaagacagaccataatcccagtgtgagtgaaattgattgtttcatttattaccgttttggctgggggttagttccgacaccttcacagttgaagagcaggcagaaggagttgtgaagacaggacaatcttcttggggatgctggtcctggaagccagcgggcctcgctctgtctttggcctcattgaccccaggttctctggttaaaactgaaagcctactactggcctggtgcccatcaatccattgatccttgaggctgtgcccctggggcacccacctggcagggcctaccaccatgcgactgagctccctgttggctctgctgcggccagcgcttcccctcatcttagggctgtctctggggtgcagcctgagcctcctgcgggtttcctggatccagggggagggagaagatccctgtgtcgaggctgtaggggagcgaggagggccacagaatccagattccagagctcggctagaccaaagtgatgaagacttcaaaccccggattgtcccctactacagggaccccaacaagccctacaagaaggtgctcaggactcggtacatccagacagagctgggctcccgtgagcggttgctggtggctgtcctgacctcccgagctacactgtccactttggccgtggctgtgcaaccgtacggtggcccatcacttccctcggttactctacttcactgggcagcggggggcccgggctccagcagggatgcaggtggtgtctcatggggatgagcggcccgcctggctcatgtcagagaccytgcgccaccttcacacacactttggggccgactacgactggttcttcatcatgcaggatgacacatatgtgcaggccccccgcctggcagcccttgctggccacctcagcatcaaccaagacctgtacttaggccgggcagaggagttcattggcgcaggcgagcaggcccggtactgtcatgggggctttggctacctgttgtcacggagtctcctgcttcgtctgcggccacatctggatggctgccgaggagacattctcagtgcccgtcctgacgagtggcttggacgctgcctcattgactctctgggcgtcggctgtgtctcacagcaccaggctcagatccggaacctgaccgtgctgacccccgaaggggaggcagggctgagctggcccgttgggctccctgctcctttcacaccacactctcgctttgaggtgctgggctgggactacttcacagagcagcacaccttctcctgtgcagatggggctcccaagtgcccactacagggggctagcagggcggacgtgggtgatgcgttggagactgccctggagcagctcaatcggcgctatcagccccgcctgcgcttccagaagcagcgactgctcaacggctatcggcgcttcgacccagcacggggcatggagtacaccctggaccccgggtcgacccacgcgtccgagcgtgggcaccggcgggccctggctcgcagggtcagcctgctgcggccactgagccgggtggaaatcctacctatgccctatgtcactgaggccacccgagtgcagctggtgctgccactcctggtggctgaagctgctgcagccccggctttcctcgaggcctttgcagccaatgtcctggagccacgagaacatgcattgctcaccctgttgctggtctacgggccacgagaaggtggccgtggagctccagacccatttcttggggtgaaggctgcagcagcggagttagagcgacggtaccctgggacgaggctggcctggctcgctgtgcgagcagaggccccttcccaggtgcgactcatggacgtggtctcgaagaagcaccctgtggacactctcttcttccttaccaccgtgtggacaaggcctgggcccgaagtcctcaaccgctgtcgcatgaatgccatctctggctggcaggccttctttccagtccatttccaggagttcaatcctgccctgtcaccacagagatcacccccagggcccccgggggctggccctgaccccccctcccctcctggtgctgacccctcccggggggctcctatagcggggagatttgaccggcaggcttctgcggagggctgcttctacaacgctgactacctggcggcccgagcccggctggcaggtgaactggcaggccaggaagaggaggaagccctggaggggctggaggtgatggatgttttcctccggttctcagggctccacctctttcgggccgtagagccagggctggtgcagaagttctccctgcgagactgcagcccacggctcagtgaagaactctaccaccgctgccgcctcagcaacctggaggggctagggggccgtgcccagctggctatggctctctttgagcaggagcaggccaatagcacttagcccgcctgggggccctaacctcattacctttcctttgtctgcctcagccccaggaagggcaaggcaagatggtggacagatagagaattgttgctgtattttttaaatatgaaaatgttattaaacatgtcttctgccaaaaaaaaaaaaaaaaaaaaaaaaaaaaaaaaaaaaaaaaaaaaaaaagg

SEQ ID NO: 2634 - DNA, 2381 bp, Homo sapiens
cccacgcgtccgacgaagcgtgcgcgctttggtaaccggctagaaatcccgcacgcgcgcctgcctcctctccccaggcctgagctgcccctcccactgcctttccttcttcccgcgagtcagaagcttcgcgagggcccagagaggcggtggggtgggcgaccctacgccagctccgggcgggagaaagcccaccctctcccgcgccccaggaaaccgccggcgttcggcgctgcgcagagccatggaattctcctggctggagacgcgctgggcgcggcccttttacctggcgttcgtgttctgcctggccctggggctgctgcaggccattaagctgtacctgcggaggcagcggctgctgcgggacctgcgccccttcccagcgccccccacccactggttccttgggcaccagaagtttattcaggatgataacatggagaagcttgaggaaattattgaaaaataccctcgtgccttccctttctggattgggccctttcaggcatttttctgtatctatgacccagactatgcaaagacacttctgagcagaacagatcccaagtcccagtacctgcagaaattctcacctccacttcttggaaaaggactagcggctctagacggacccaagtggttccagcatcgtcgcctactaactcctggattccattttaacatcctgaaagcatacattgaggtgatggctcattctgtgaaaatgatgctggataagtgggagaagatttgcagcactcaggacacaagcgtggaggtctatgagcacatcaactcgatgtctctggatataatcatgaaatgcgctttcagcaaggagaccaactgccagacaaacagcacccatgatccttatgcaaaagccatatttgaactcagcaaaatcatatttcaccgcttgtacagtttgttgtatcacagtgacataattttcaaactcagccctcagggctaccgcttccagaagttaagccgagtgttgaatcagtacacagatacaataatccaggaaagaaagaaatccctccaggctggggtaaagcaggataacactccgaagaggaagtaccaggattttctggatattgtcctttctgccaaggatgaaagtggtagcagcttctcagatattgatgtacactctgaagtgagcacattcctgttggcaggacatgacaccttggcagcaagcatctcctggatcctttactgcctggctctgaaccctgagcatcaagagagatgccgggaggaggtcaggggcatcctgggggatgggtcttctatcacttgggaccagctgggtgagatgtcgtacaccacaatgtgcatcaaggagacgtgccgattgattcctgcagtcccgtccatttccagagatctcagcaagccacttaccttcccagatggatgcacattgcctgcagggatcaccgtggttcttagtatttggggtcttcaccacaaccctgctgtctggaaaaacccaaaggtctttgaccccttgaggttctctcaggagaattctgatcagagacacccctatgcctacttaccattctcagctggatcaaggaactgcattgggcaggagtttgccatgattgagttaaaggtaaccattgccttgattctgctccacttcagagtgactccagaccccaccaggcctcttactttccccaaccattttatcctcaagcccaagaatgggatgtatttgcacctgaagaaactctctgaatgttagatctcagggtacaatgattaaacgtactttgtttttcgaagttaaatttacagctaatgatccaagcagatagaaagggatcaatgtatggtgggaggattggaggttggtgggataggggtctctgtgaagagatccaaaatcatttctaggtacacagtgtgtcagctagatctgtttctatataactttgggagattttcagatcttttctgttaaactttcactactattaatgctgtatacaccaatagactttcatatattttctgttgtttttaaaatagttttcagaattatgcaagtaataagtgcatgtatgctcactgtcaaaaattcccaacactagaaaatcatgtagaataaaaattttaaatctcacttcacttagccgacattccatgccctgaccaatcctactgcttttcctaaaaacagaataatttggtgtgcattctttcagactttttcctatacattttatatgtagaaatgtagcaatgtatttgtatagatgtgatcattcctatattgttattgatttttttcacttaataaaaattcaccttattccttaaaaaaaaaaaaaaaaaaaaaaaaaaaaaaa

SEQ ID NO: 2635 - DNA, 734 bp, Homo sapiens
  misc_feature (4)..(4): n equals a,t,g, or c
attntagaagktaccctgcagktaccggtccggaattcccgggtcgacccacgcgtccgtgccgagcgcgccccgtccctcgcgcgcgatgctcccctggacggcgytcggcctggccctgagcttgcggctggcgctggcgcggagcggcgcggagcgcggtccaccagcatcagccccccgaggggacctgatgttcctgctggacagctcagccagcgtctctcactacgagttctcccgggttcgggagtttgtggggcagctggtggctccactgcccctgggcaccggggccctgcgtgccagtctggtgcacgtgggcagtcggccatacaccgagttccccttcggccagcacagctcgggtgaggctgcccaggatgcggtgcgtgcttctgcccagcgcatgggtgacacccacactggcctggcgctggtctatgccaaggaacagctgtttgctgaagcatcaggtgcccggccaggggtgcccaaagtgctggtgtgggtgacagatggcggctccagcgaccctgtgggcccccccatgcaggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgc

SEQ ID NO: 2636 - DNA, 3009 bp, Homo sapiens
tctgcagaccaagaagttaaaaaaaaaaaacagttggcaagtcactcctgaaagctaaagacttctttactctgctacagtatttctcacacaggtgaagcttagacataaaagacatgaaagtctcctaatatataatatattggctgaaaatgtgatgatgtggagattcttgtattcttgactgtgactctctatgtgttccatgttttgtgaaagattgttacttttgtgtcattgtcaactatcaatcgctgtgttcatgtattgggttcatgttacccacctatcttctgtgaggagaataaactatgkttttttaatttataaaaaaggaatgcagctgccctcttggtacccaagttcttgtccagcatctaggaagaatcaggtcacaggaatgaatggaagggtggtgaatgtggaggattttattgagcagtggaagtggctctcagtggggtggggagctagaaaggggctggagtgggaagatgatctttacctggagtttggccatccttagccaaactgttctccaaagtcctgctatcaagccgtccctctgaagtcaagctgcttctctctgatgtccagttgcttcttctcttctctccttctctgttgctctgctctgccactcagctgstctgcttctctgccacccctctgccaggggagactggggttcttatgggtacaggattgggggggcgggtgggccaaaaacaacatttgagcaggaaaatagtaatgcatgttctcactttgggccacagtcccaggcttcagggtgtggccctcactggggactgcccttttctagtcagtatttccatgcctcctgtccatatcactaatattttggggatttattcaaaatgcatggataggagaccctctttaactattacaggttaatacaaatgctctcttggcaggtttaggtgagagaaatgccttattttctactgtcttggagatctcaagatcatcatgcagacttcagagataaaaagaaaagaggctactctagtgtgaaatcttatatttacattcctcatcactcactgagaaccttagcaaatatgatttaacacgtaatatttatctgaatatttctccatctcaggagattagaagtagcaagctatgtgagaaaagggaaaggaagaagtgataagcagattagggaaagtttgagaaaacctattaaggaagatgaagagagtgagttaacgtgatatttgcaatatgtatcacttataaacaataactactgcttgattaattaaaaacatataaaccaaaaaaaggaatgctaatgaacattaaagatatatttacactgataagatctcgctattttctcttttctaaaacttccaaagactagccattgtttcataaacaaaaaatgtaagtaccttagagagacacagctcctcaggactagcccatataatagagataaagcagggcccagtacttaagagcaagctgtgaaaatagccccagtttgagcctaggcgctaccagtttcctactgagtaaacttggccaagtcacaggatctttctgcmtctcagttcctcatctgtataatgggaaaagtaatagtactatgacataaagttatgtgaagattaaatgatttattatacttaaggtcttagaccagtgttgggtgcatagttaatattcaaatgtcagctactactctttcctctcctgtaagaactcccagctgcctcatctactactctatgtgtgagcccgaactgcttttcatcagtgctagtctgtacttatcatttctttctgacacacatgtattattttaaaactcagtaaaaatatagacttttctaaaaaggctttatttgattaaatcttcatctctataatggaaactttatctgcattttttgaatcttatgtcttttctatatttttcacatttttttacagtataaagaaacccttctaatacatttcttgctcaactactattgtttctgctattactaactcctgctgctgcttgctgctggctaccatttcttgggagcttactctgtcaggcactgtgccaagtgcttcatatgcattatccactttaaatcttataaaaacttcaggaggttagtactattcattcatttaaatcatgtttattcagggcttactttgtgcatgtcaatgttctggacaccgaggatatattaatactagtgagcaaaacaaagttcctatctttgtagaaacttcattctgttgctcccattttaagaaggtatctgagtcttgcgcagttcacagagtgaaagaggtattagccaggcccaaggctattgattctaggtcccatacacagccaccctttcaaggtgtcattgtgaaattttagttttctttccgtttctattttctccttttccttcccaacatcttccatttcctgtttggagatccatagggttccaaggaaattgattctatcttagctccagggatggagaatgtgacctagtctaagggaaaataccccatgactttaactctgcagaccacagggactggttcaggggtacaaatgtgacccaagctggtcagtgaatccactttccttggattgagggacaaaagtactctttcttccggtggatagcgtaacgtttgtatatgaagcctgaaacttctatagtcaattttgcctctatgagagaagccagtgtgaaaatcaagtcaattcatggaggaaggcaaaaccaagagaatttcagagaaaagaaattagagctctaatgacattatgaacttctcgttcaaactatgcctaaagctcctgtatttctgtacttgtaagaatcacaaggcaataaactccttttatttttaaaaaaaaaaaaaaaaaaaaaaaaaaagggcggccgctctagaggatccctcgaggggccmcacattacgcgtgcatgcgacgtcatagctctctccctatagtgagtc

SEQ ID NO: 2637 - DNA, 1296 bp, Homo sapiens
cttcatcagctgcgacctcctcaccgctttcctcttataccgcctgctgctgctgaaggggctggggcgccgccaggttgtggctactgtgtcttttggcttcttaaccccctgcctatggcaktatccagccgcggtaatgcggactctattgtcgcctccctggtcctgatggtcctctacttgataaagaaaagactcgtcgcgtgtgcagctgtattctatggtttcgyggtgcatatgaagatatatccagtgacttacatccttcccataaccctccacctgcttccagatcgcgacaatgacaaaagcctccgtcaattccggtacactttccaggcttgtttgtacgagctcctgaaaaagctgtgtaatcgggctgtgctgctgtttgtagcagttgctggactcacgttttttgccctgagctttggtttttactatgagtacggctgggaatttttggaacacacctacttttatcacctgactaggcgggatatccgtcacaacttttctccgtacttctacatgctgtatttgactgcagagagcaagtggagtttttccctgggaattgctgcattcctgccacagctcatcttgctttcagctgtgtctttcgcctattacagagacctcgttttttgttgttttcttcatacgtccatttttgtgacttttaacaaagtctgcacctcccagtactttctttgggtacctctggcttactgcctcttgtgatgccactagtcagaatgccttggaaaagagctgtagttctcctaatgttatggtttatagggcaggccatgtggctggctcctgcctatgttctagagtttcaaggaaagaacacctttctgtttatttggttagctggtttgttctttcttcttatcaattgttccatcctgattcaaattatttcccattacaaagaagaacccctgacagagagaatcaaatatgactagtgtatgttccacaccctctgctactgtgttacattctgattgtcttgtatggaccagaagagagctttgggacattttttctgaacattctaagcattctagtgaaagttcccatgttccaacagaacttaaaagcaatgtttgccttatatataaaagggacacaataattgaggtccaccttctaggaaatcctaggactcgtttatttgggacatggtgggaataaaggtcacatattggaaaaaaaaaaaaaaaaaaaaaaaaaaaaaaaaaaaaaaaaaaaaaaaaaaaaaaaaaaaaaaaaaaaaaaaaa

SEQ ID NO: 2638 - DNA, 1196 bp, Homo sapiens
ccacgcgtccggtgaatctggatgatctatttatgtcatttatctatgtgtctcttcttatgccagtaccccactgtcttgattattgtggctttatggtgtcttgaaattaagtattgttaagctttgcaatcttttccaagattgttttggctataggtcctttctttataaagtttatattaagcttctccatttttctttaagaaaaaatctgctggaatggcactgaatttttaggtcgatttgggaagaattgacaatattgaacctttcaatcgatggacatggtatgtttctgcatttatttgggccttttaaaatttatctcagcaatattttgtagttttagtgaagaagtcttgtatatatcttttgttaaatgtattcctaaatattttgtggaaatgttactgtaaatagtactttaatttcatttttaagtttattgctggtatacagaaatatgttttatttttgtaatattgacttttatattctgtaatcttatttaaattcacttagttcagtagtagttcttatttttattttattgcaagtgccttagggataccttgtgtacacaatccatgtcatatatgaataaccaacaggtttaccttttgtttcttcttgctttgtcgtaatggctaggaccttccaacctaaatggttgaatagaagcggtgtgtgagtttattactcttgtcttattctcaacagcagaggatagcgtctagtttttcactattaaaatatgttagctataggttttttccgtttcatgtttttatcagattgaagatcccttttattcctattttgccaagagtgtcatgaatgcatgttgaatttcaccaagtactttttcctgcatctgttgagagaatcttgacttttctcttttattttgttaatgtagattctttaatgttaaactgatcttgcattcctgatataaaccatacttagtcatgatatgttatcccctttatataatgctggattcggtttgcaaatattttgtttgatttttgcatctatgctcatgagacagattggtctgtgattttcctttcttgtaagtcttgtcaggtgtcagggcttggttaattttgacacatttacaaacatatatttttaagataaaaataaacttcaaaaaaaaaaaaaaaaaaaaaaaaaaaaaaaaaaaa

SEQ ID NO: 2639 - DNA, 2065 bp, Homo sapiens
cgggtcgacccacgcgtccgtgctggagttaccatagtaacctgtctcgcctcactttttagtgggcggctggtacgttcagatgtagccatgactggagaaattacactgagaggtcttgttcttccagtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaaaggtactgacacagttgattttattcacaccattaggggtatgcaagatgtccctgttttataaacataatcacaacagtaataaacctcaagtagtggctagtgtttagtatagaaatataagatgttgatttagtaaactgataaaaatcgaattcttgtctttttagtgggatccttactgtccctggaaagatatagcatagtggttctcagcacagtctccagaacagaagcatctgtagtacctggtaacttgttagaaatgtacattctcaggctccacagcaggccgcctgaatcaaatcctgggaggtggggacagaaatctgtgttttaagaagccttccaggtaattctgctgcacactcaagttcaggaaccaccggtatagaccattaccttagtggatttacctgtagagtttattggatcctgaaaccaatcaattacttagaactaggcaaagatgaaagtatagccaactattcttggctatatatatatattcaagtgggccgggcgtgatggctcacacctgtaattccagcactttgggaggtcgaggtaggcagatcaccgagcccaagagttcaagacaatcctggccaacggcgaaactctgtctctacaaaaaatatacaggcgtgttagcatgtgcctgtaatcccagcttcttgggaagctgaggcacaagaattgcctgaacccaggaggtggaggttgcagtgagctgggatcgcgccattgcactccagcctggctgacagagcgagactgtctctaaaaaaaaaagactcaagtggaccctacaatgaagcctacacatcccaatagaagccccttcttatgctgagggaagcagccctcagaacatgatagcttgtatccagcagagtggcacgtgctggcacacctcacagaagcaccctggccctggatgcctgcaacctcagaagagtgcagctcccagagggaggcagccatccatctgggatggtcctaagcatggaatcctaactcctgattccgtctcctatttcttgcttggctacgccagttcccaaatctggtagatgtccatgcccatgtgctcctgctgggactcaattcaggctatgtatgactatgaagtcaggctcatctgcttactggctgtgtgaactttttgtatcttggttttcttcatccatgaaatccaagtaatactacctaattgttactgtggagattaagttcaaatgcaatgtatagtaatattaagcaatttctagttattattctagccagtaatggacttcagaatcttttattacacaatataagaatatgtatgtaaagacattttggaatttcctggatgagaaggaagtctgggctgggcatggtggctcacgcctgtaaccctagcactttgggaaatcgaggcgagtggatcacttgagctcgggagttcagggccagcctgggcaacatggcaaaaccccgtttctacagaaaatgcaaaaattggctgggcgtggtggcacccgcctgtggtccagctacttgaggctgagatgggaggatgagggaggtcggggctgcagtgagccgagatcacgccactgcactccagcaccctgggcgacagagtgagaccctgtctcaaaaaaaaaaaaaaaaaaaa

SEQ ID NO: 2640 - DNA, 2865 bp, Homo sapiens
  misc_feature (677)..(677): n equals a,t,g, or c
aattcccgggtcgacccacgcgtccgaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccatccttcccactatgtgccatgcanctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatcccaaaaaaaaaaaaaaaaaaaaaaaaaaaaaaa

SEQ ID NO: 2641 - DNA, 1082 bp, Homo sapiens
  misc_feature (1014)..(1014): n equals a,t,g, or c
  misc_feature (1082)..(1082): n equals a,t,g, or c
gcgcgggagaaggggagaccgcggcggcccccagtgagagcggctttccaggacggtgcgatgtgctgcgcagcgaagaggcaggaggccggcttcctggggtagcggtacaggcgggcgcttactctgtgcgcttgcttccccaaccctgcaccggccatgcgcccggccttggcggtgggcctggtgttcgcaggctgctgcagtaacgtgatcttcctagagctcctggcccggaagcatccaggatgtgggaacattgtgacatttgcacaatttttatttattgctgwggaaggcttcctctttgaagctgatttgggaaggaagccaccagctatcccaataaggtactatgccataatggkgaccatgttcttcaccgtgagcgtggtgaacaactatgccctgaatctcaacattgccatgcccctgcatatgatatttagatccggttctctaattgccaacatgwttctaggaattatcattttgaagaaaagatacagtatattcaaatatacctccattgccctggtgtctgtggggatatttatttgcacttttatgtcagcaaagcaggtgacttcccagtccagcttgagtgagaatgatggattccaggcatttgtgtggtggttactaggtattggggcattgacttttgctcttctgatgtcagcaaggatggggatattccaagagactctctacaaacgatttgggaaacactccaaggaggctttgttttataatcacgcccttccacttccgggtttcgtcttcttggcttctgatatttatgaccatgcagttctattcaataagtctgagttatatgaaattcccgtcatcggagtgaccctgcccatcatgtggttctacctcctcatgaacatcatcactcagtacgtgtgcatccggggtgtgtttatcctcaccacrggaatgcgcctccctcamcgtcacgctcgttcgtgaccttacgcaaatttgtggagcctccatcttttnccatcttggtgactttccagaacccctttcaccctgtggggcaatgggctggggcaacttggtttgtn

SEQ ID NO: 2642 - DNA, 2279 bp, Homo sapiens
ccacgcgtccggatttggacctttttcgagtttggatgggagtgtggacagggcggttagggggctgggcccaggtcatgtttcagtttctaagccaggggttttactgtggagtaggactgtttactcgttttcttaagctgctgggtgctttgctgctcctggctctggccctctttttgggctttctacagttgggatggcggtttctggtgggactaggtgaccggttaggctggagggataaggctacctggctcttctcttggctggattctccagccttgcagcgttgcttgactctgctgagagatagcaggccatggcagcggctggtaagaatagttcagtggggctggctggagttgccttgggtcaagcagaatattaataggcaggggaatgcacctgtagctagtgggcgctactgccagcctgaagaggaagtggctcgactcttgaccatggctggggttcctgaggatgagctaaaccctttccatgtactgggggttgaggccacagcatcagatgttgaactgaagaaggcctatagacagctggcagtgatggttcatcctgacaaaaatcatcatccccgggctgaggaggccttcaaggttttgcgagcagcttgggacattgtcagcaatgctgaaaagcgaaaggagtatgagatgaaacgaatggcagagaatgagctgagccggtcagtaaatgagtttctgtccaagctgcaagatgacctcaaggaggcaatgaatactatgatgtgtagccgatgccaaggaaagcataggaggtttgaaatggaccgggaacctaagagtgccagatactgtgctgagtgtaataggctgcatcctgctgaggaaggagacttttgggcagagtcaagcatgttgggcctcaagatcacctactttgcactgatggatggaaaggtgtatgacatcacacagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaagtacccccagggcagatgcccaatgggaacttctttgcagctcctcagcctgcccctggagccgctgcagcctctaagcccaacagcacagtacccaagggagaagccaaacctaagcggcggaagaaagtgaggaggcccttccaacgttgatgccccttctctttcctcaaatcaatgtcagggagtcaaaagggctgtagcacaggatggagtttgatttatccctcctcccccaacacctaggaactgaatctttttctttttattttttgagatggagtcttgctctgttgcccagctggagtgcagtggtgtgatctcagcttactgcaacctctgtctcccgggttcaagcaattctcccatctcagcctcctgagtagctgggattacaggcacacaccaccacacctggcccagctaattcttttttgtatttttagtagagacggggtttcaccatgttgcccaggctggtctcgaactcctgagctcaggtgatccacccgtcttggcctcccaaagtgctggattacaggcataagccactgtgcccggcctgaatcttgtcttttgacaataccaaagaaatagggggtagctagagtaaagaacctagggcctggacctgggctggacagtgtatccctttaggtgtgggaactgggtatttccctggggtctgtatgcctttgtcttgtcatttgcttttagggcagatgacactttttcccacccttttaaagctacaagtctatcttctttcttgacccatttcaggagggagccctctcctttatcctgatataatatttaaaagacagaacaagaaagcatgtagccctaatgataggagattatcgcatagagttcagagactggaaactgaattttccctcgactttcactttgtgggtaaatcacccaattttaggctcttttctgcaaggatggccaaaattaatcatttttaaaaagtagattcatgcccactgcccttgggtgagggggaagaatacgggggttcccagaagcccccatgtgatccaagggtttgtattttttttttaagtttgttcatatttgtatgtacatgactatttaaagccaggggattatctttctataaatgtataactggcaaaaaaaaaaaaa

SEQ ID NO: 2643 - DNA, 2220 bp, Homo sapiens
ccacgcgtccgcttgttatctgggtaattagtttcagaccctgcactgaggccggccaggtctcggggctgcctcccataggttgtgcaccctgaccccgagagggaggcgaggcgctgcttgtcgacagctagaggctggcctggggagcaggtttggggtgccctcccacactgccctccctgccccggcccatgccccccagggctgcctgggcctggttattgtgtggggcctcctgacccagccaagggcacgaagctctgggaaggggatgcccccgagggtgccagtccagctagctgccccacccctcaggcccagcctggcccccaagctccccactctggtgccccgagcagccctgtgggcaagcagccgccgccatggccgagcacctggagctgctggcagagatgcccatggtgggcaggatgagcacacaggagcggctgaagcatgcccagaagcggcgcgcccagcaggtgaagatgtgggcccaggctgagaaggaggcccagggcaagaagggtcctggggagcgtccccggaaggaggcagccagccaagggctcctgaagcaggtcctcttccctcccagtgttgtccttctggaggccgctgcccgaaatgacctggaagaagtccggcagttccttgggagtggggtcagccctgactgggccaacgaggacggcctgacggccctgcaccagtgctgcattgatgatttccgagagatggtgcagcagctcctggaggctggggccaacatcaatgcctgtgacagtgagtgctggacgcctctgcatgctgcggccacctgcggccacctgcacctggtggagctgctcatcgccagtggcgccaatctcctggcggtcaacaccgacgggaacatgccctatgacctgtgtgatgatgagcagacgctggactgcctggagactgccatggccgaccgtggcatcacccaggacagcatcgaggccgcccgggccgtgccagaactgcgcatgctggacgacatccggagccggctgcaggccggggcagacctccatgcccccctggaccacggggccacgctgctgcacgtcgcagccgccaacgggttcagcgaggcggctgccctgctgctggaacaccgagccagcctgagcgctaaggaccaagacggctgggagccgctgcacgccgcggcctactggggccaggtgcccctggtggagctgctcgtggcgcacggggccgacctgaacgcaaagtccctgatggacgagacgccccttgatgtgtgcggggacgaggaggtgcgggccaagctgctggagctgaagcacaagcacgacgccctcctgcgcgcccagagccgccagcgctccttgctgcgccgccgcacctccagcgccggcagccgcgggaaggtggtgaggcgggtgagcctaacccagcgcaccgacctgtaccgcaagcagcacgcccaggaggccatcgtgtggcaacagccgccgcccaccagcccggagccgcccgaggacaacgatgaccgccagacaggcgcagagctcaggccgccgcccccggaggaggacaaccccgaagtggtcaggccgcacaatggccgagtagggggctccccagtgcggcatctatactccaagcgactagaccggagtgtctcctaccagctgagccccctggacagcaccaccccccacaccctggtccacgacaaggcccaccacaccctggctgacctgaagcgccagcgagctgctgccaagctgcagcgacccccacctgaggggcccgagagccctgagacagctgagcctggcctgcctggtgacacggtgaccccccagcctgactgtggcttcagggcaggcggggacccacccctgctcaagctcacagccccggcggtggaggctcccgtggagaggaggccgtgctgcctgctcatgtgaggctgttgctcagcatgcaggggccctgtcgcgggcacagcccaaggctgcctccccacggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatggaaaaaaaaaaaaaaaaaaaaaaaaaaaaaa

SEQ ID NO: 2644 - DNA, 533 bp, Homo sapiens
ccacgcgtccgggtaatttctaagtatactacctataagtaactgataagaattaggcatcattcagtgatatagcagatgactaatgggtttttcaggccctgcacttctctttcccattttcctgttgcattcagcctcttcaatgcttagtcacacctccactatagtacaaacaaacaaacaaacagaagaaaggaaagatggtgaattttgcaacagagctgcaaaaagtcagtcaaagcaggaagaggttgaaggaactaaaacaaacaaacaaaggtgtctggactacagcacagtggacatgccatccatactggcctgtgccccgttatcaatcactgggcacaacagtgaagaagtgcaaatcaagtggtgtttgtttgtttgtttgtagtaaggaccgtaacccaccccttcctccccccaaaactatactgttatttttctatgtaagcaaattgtttgaaatgctttgaaaatgaaatcttaatattaaaaggcatatgcatgtaaaaaaaaaaaaaaaa

SEQ ID NO: 2645 - DNA, 1864 bp, Homo sapiens
  misc_feature (1844)..(1844): n equals a,t,g, or c
cccaagccagccatttattacaagaagcaacaggttattgacattacatgtttgaaaattccctttggtctttagggaaaataaacaggaagccaagatttggagcctttgtaataaggacttcctgcagaaagtcttttctttactataattgagtaattcatatttagagtcacatgtccagtagcatttctaattttgagcattcaccttgctacctttaaaaaacatctgagttttaagtggcctttttatcatcatacacatgtgcatacaaagaagggacttggcagtttaaaagccacatatattcacttttattgccctaaatttacatgaaacagacatactggcaaactcacatattgctggtgctaaccttatatttcatagtgttggcatattccccttttcttagattcttactccgaaatataggtacacatcctttgctctgtgcagagggaattacatcctttttcctctcctacaaaaacatgctttattaagtatccatcattactttcctttatgctcgctcaatatgcaatgtgctgttattctaccatgtaccttaaataaaggatgatggcaaagttatttaccatgtagaaaccattttctttctagaaacaatagctcagcctcactgtagcagctggcatgtgtggtcaagtggatagttgtactcttgcaagttggatttaatatcatatatactggaccttcagactgttaaaaatcaatgtaacctttttttattgctatggcaagcaattagtatttcactgcacgtcttccatactaatgttcatttctaaatcttatatgtaggcatttgttagttccaatgatttcctcactaatataacactttttaatgggaatctttccacctacagccctggaatgataatgctacagtaattcttctgaattgactttttctttcatcctgtcagctttggacaatatcccaattatggcagggaacaggtggggaactaagatcagttacaaaaagttgtagatgtgtcaactttgtatggctgggatcactgtgcccaaacaaaacaggcgaaatacctcagttaaaatttttccatcaaagtctttaaaagaagagtatactgaagaaagggcagtcataatacttacttctaacagcttctaaagggtacatgtttaacatttcatttcaaaatcaccccaaatttgcactaaataccaatgaagtgttattttgctttagtagtcttctgagcaacaaactatggggaattctgkaaaamcatataaaaagtycaagmctttttttttaaatgaatgattactatgttaaatgcaaacttttttttttttttatttaaacaaacatacacttctcctggcaaggttatagatgattaacctctgttcatagacttatatataaaactagagggttttttgtttacttttttaatttttcaagtgcaattgtttcttacacagacattattactattaaattatcatttagccagttatctgcaaatatatagtatgtattgtctcttcttgtgacgtttagtttaattgcttattttaaagcagaaamattagttacaagtgtcttacaatatttttaccaacagtaaagtagagacttaatgaaaataccttagtgtgattttaatataatttgcatattttagttgtataaagttttaatgtaaaatgtccattattgaagggaaaagatctttcaataaaaaatacccacgaaaaaaaaaaaaaaaaaaagggcggccgctctagaggatccaagcttacgtacgcgtgcatgcgacgtcatagctctnaaaaggggactccagagctt

SEQ ID NO: 2646 - DNA, 2864 bp, Homo sapiens
  misc_feature (517)..(517): n equals a,t,g, or c
  misc_feature (1687)..(1687): n equals a,t,g, or c
  misc_feature (2717)..(2717): n equals a,t,g, or c
  misc_feature (2811)..(2811): n equals a,t,g, or c
gtgcgaggaaacagctatgaccatgattaccgcyaagctctaatacgactcactatagggaaagctgktacgcctgcaggtaccggtccggaattcccgggtcgacccacgcgtccggttcatacaagtcaatttaaaaatctattaagttctaataaataagtgaacagaagttcacgtcacaaaatatagtaaacaaatagatggaaaaactttagttttgctaacaataaagaaatgtgaagttaagataagggcatcttcctttttcctcatttatgtttgccaaaaaatttaaaagcatgatacttattatgagtatggattcagtgaaattggtactgggatggccactctgggtcctatgcttttggcaggcagcctggtgttttaaaaaggcttttgaatggcaacagactttaccattatattctacagaaatggtaaataagccatgatttttattttatatattcagatatacgtgtgaatgttaattgctttgtgccttcgctgnttttagaacagccttctttcataccttactggtgatgtattaatagcaccattttggaatgcagtttggtatagtatgkttcaagaatcataggattcttgtctttttttgaattccgagtcccatttctgagawtctctactaaggaagtaataaaaagtatagtaacaactatatccttaaaaatggcctatataacaaataaatagactctaaatgccctattaaaggaaagtggagccaggtatgattacttgcatgcctgtaatctcggcctcccaaagtgctgggattacaggcatgagccaccgcccctggcctccatctagactttgaaatgattgccttctaattacagtagcattctcttatttaaaatatttgytttatttaagtcagtgtttaagcaatagctcagcatatcccagtggtccagtgaccacacagctgagaacccttgttaagtggtacagtaaagcattctgtcaaaactttgacatttatgacatgttacctaggaaataggacttagaaaatgagtttgacctgggctttaaaaaagtatactgatgaaggtgccagaattgatgtccattagactgtaagctccatgggggcaggaactttgctaccgaatctatacaaccttaacattgactagtgcttgtaggtgtgctcaatacttgtttgttaactgaatcaaaaggagtaaatgcacaatatttgaacattgtatccaaaggaagaaacctgcgaaataaaattatttgcagaaatgaacatttgttgaaatgcagaaaaccactggatactgcagcctacaatattaatatgatattactcttttacagttgacacctgtcctctctgtagtctcttctctcaaatttggttcttattgagagcctgtctagtttcccaaaggttttataaaacataagttgaagtacctttatttttaattttatttttgagacgggacctcgctctgtcaccgaggctggagtgcagtggcataatcatggctcactgcagcctcgtcctcccgggctccatccatctgcccatctctccctctgagtggctgggaccacgggcgcgtgccaccacacccagctaatttttgtatgtttggtagagagggggtttcaccacattgcccaggctggncttgaacacctgagctcaagcaatccaacctccttggcctcccagtgttaaattacaggcgtaagccaccacacccggccaagttgaagtatattttgtgatttttctgacagtgcagactgaaaaaaatttaattaacctgacaagagtttactgaatatcacacaattgagtttttaatccattaatgttaaggcaggggtttactctaacacttttaaagtgtcagaagtagttgccaatgccaaatttttatcagcccccttgaatttatttgatttctgactttccacatttccatccagactttgacatgattgccgtctaataactgtagcattctcttattaaaacttctggctgggtgtggtggctcatgcctgtaaccccagcactttaggaggccaaggcaggtgaatcacctgaggtcaggacttagagaccagcctgaccaacatggtgaaaccccatctctactaaatgcaaaaattggmtgggcatggtggcgggcgcctgtaatcccagctactcaggaggctgaggcaggaggattgcttragcccggraggcggaagttgcagtgagccgagactgcgccattgcactccagcttgggtgacagagcgagactccgtctcaaaaaaaaaaaaaaaaacttctgaggtaggggctgtaccatatttttgccccacacccattaagcgaataccaaaaacaacttgtggaaatttgataattttatcaaatttattatttgggcaggattggcatttaccatgcttttccctattgctggcagtaaaacatgggtttaaggaagagtgtttttcagaatttacactgtatatctctgatttggaagttatataattggaatttatgattatgagattaaaataccaaaaagactaagtaaaaaaaaaaaaaaaaaaaagggcggccgctctagaggatccaagcttacgtacgcgtgcatgcgacgtcatagctcttctatagtggcacctaaattcaattcactggccgtcgntttacaacgtcgtgactgggaaaaccctggcagttacccaacttaatcgccttgcagcacatccccctttcgccagctggccgtaatagcgaanaggcccgcaccgatcgcccttcccaacagttgcgcagcctgaatggcgaatgg

SEQ ID NO: 2647 - DNA, 2667 bp, Homo sapiens
cccgggtcgacccacgcgtccgcccacgcgtccgaccgagccctttgtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacattgcggccggcgtgtggatgatgatggcggtcgttcccatcgtcatcagcctgaccctgaccacgctgctgggcaacgccatcgcctttgctacgggggtgctgtacggactctctgctctgggcaaaaagggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctggagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggcccctaggttctgcccatcaccccccgcccctgctggccttggtgctaaggaagtggggagagcaggctctccctggcaccgagggtgcccaccctctccctggtgtggccccgtcaacatcagccacagcccagccccattagtgggttagtgggtctgacctcagccccactcaggtgctcctgctggcctgcccaagccctgccctcagggagcttctgccttttaagaactgggcagaggccacagtcacctccccacacagagctgtccccactgccctgggtgccaggctgtccggagccaggcctacccagggaggatgcagagagctggtgcccaggatgtgcacccccatattccctctgccctgtggcctcagcccgctggcctctctgaccgtgaggctggctctcagccatcgggcaggtgcctggtcgggcctggcttagcccaggtggggtttggcagaagcgggcgggtgtggaagatattccatctggggccaaccccaggctgggcctgcgctgagcttctggagcgcaggtactgggtcttgctaagtgaactgtttcccaggaacacctctcgggcccatctgcgtctgaggctgggagtggcatctgaggccgggagtggcatctgaggccaggagtggcaggctggtgggctgggcgtggggttttctgggccctgcccagtactgccctggggacttggtgggctcctgggtcagcagcatcccacccctgggagtctggccagctgagccccagggtggcaggggcattatagcctggtggacatgtgccttcagggttcctccggggccaccttcctcaggccagtgctgggttcaaagggctgtgtgtgtgtgtgtgtgtgtgtgtgtgtgtgtatgtatatgtgtgtgggtgcacacatctgtcccatgtatgcagtgagacctgtctacctcccacaaggagcaagggctctgcccgccctctgctcattcctacccaggtagtgggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcagaggtggaaggccctgggccacaggcgagagtgggcgtgtcacctgtcccaggttcccagcaagtctgcagctgtgcagtcctggggtccctgaccctgtcgcccagggggcgtgctgtccagcaggggccctgccttgcaaggaacgtctcttccggcggctgggccgctcctgcctggtctgggctgtgtgtggcgccctttcctccttgtttgttcctctgtgttctgtgtgcgtcttaagcaataaagcgtggccgtggctcgcgaaaaaaaaaaagaaaaaaaaaaaaaaaaaaaaaaaaaaaaaaaaaaaaaaaaaaaaaaaaaaaaaaaaaaaaaaaaaaaaaaaaaaaa

SEQ ID NO: 2648 - DNA, 1260 bp, Homo sapiens
  misc_feature (510)..(510): n equals a,t,g, or c
  misc_feature (542)..(542): n equals a,t,g, or c
agaaggccatggtctccccacggatgtccgggctcctctcccagactgtgatcctagcgctcattttcctcccccagacacggcccgctggcgtcttcgagctgcagatccactctttcgggccgggtccaggccctggggccccgcggtccccctgccgcctcttcttcagagtctgcctgaagcctgggctctcagaggaggccgccgagtccccgtgcgccctgggcgcggcgctgagtgcgcgcggaccggtctacaccgagcagcccggagcgcccgcgcctgatctcccactgcccgacggcctcttgcaggtgcccttccgggacgcctggcctggcaccttctctttcatcatcgaaacctggagagaggaattaggagaccagattggagggcccgcctggagcctgctggcgcgcgtggctggcaggcggcgcttggcagccggaggccgtgggcccggaacattcagcgcgcaggcgcctgggagctgcgcttctcgtnccgcgcgcgctgcgagccgcctgccgtcgggnccgcgtgcacgcgcctctgccgtccgcgcagcgccccctcgcggtgcggtccgggactgcgcccctgcgcaccgctcgaggccgaatgtgaggcgccgccggtgtgccgagcaggctgcagccctgagcatggcttctgtgaacagcccggtgaatgccgatgcctagagggctggactggacccctctgcacggtccctgtctccaccagcagctgcctcagccccaggggcccgtcctctgctaccaccggatgccttgtccctgggcctgggccctgtgacgggaacccgtgtgccaatggaggcagctgtagtgagacacccaggtcctttgaatgcacctgcccgcgtgggttctacgggctgcggtgtgaggtgagcggggtgacatgtgcagatggaccctgcttcaacggcggcttgtgtgtcgggggtgcagaccctgactctgcctacatctgccactgcccacccggtttccaaggctccaactgtgagaagagggtggaccggtgcagcctgcagccatgccgcaatggcggactctgcctggacctgggccacgccctgcgctgccgctgccgcgccgcttcgcgggtcctcgctgcgagcacgacctggacgactgcgcgggccgcgcctgcgctaacggcggcacgtgtgtggagggcggcggcgcgcaccgctgctcctgcgcgctgggcttcggcggccgc

SEQ ID NO: 2649 - DNA, 2272 bp, Homo sapiens
  misc_feature (548)..(548): n equals a,t,g, or c
ggtcagaggctggaaagtggggactgtwttggggtgctggattgtgaatggtgcatggtggacagtgatggaaagactcacctggacaaaccctactgtgccccccagaaagaatgcttcggggggattgtgggagccaaaagtccctacgttgatgacatgggagcaataggtgatgaggtgatcacattaaacatgattaaaagcgcccctgtgggtcctgtggctggagggatcatgggatgcatcatggtcttggtcctggcggtgtatgcctaccgccaccagattcatcgccggagccatcagcatatgtctcctcttgctgcccaagaaatgtcagtgcgtatgtccaacctggagaatgacagagatgaaagggacgacgacagccacgaagacagaggcatcatcagcaacactcggtttatagctgcggtcatcgaacgacatgcacacagtccagaaagaaggcgccgctactggggtcgatcaggaacagaaagtgatcatggttacagcaccatgagcccacaggaggacagtgnaaaatcctccatgcaacaatgaccccttgtcagccggggtcgatgtggggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacacatctttgtttgtaatgcagtattctttctctgtgtttgacagagatggggaggggcagaggaatttaagaggttttaaaagaaatgttatgtttcttatgacttgtttccactcctcgtacaatgctattcttaggtttctacgaaacctaatgttagaaccgcatcctttcagctaagggagggttggatttattttccttgttttagagactacaaatttttaaatatcccattttgactgagaatattgacatataagggaagaagttttctaaattgtgaaagtctggttcttaattaaagaattttttttttaatatcacggttaaaagctgctgccagttagccaagacattatccaccaaattgctttgtgatttatacagggattaatcaaatctggctactataacatggggcattgtaactttaaagtagtgttttaattacagtgatgtattttagactcacattttgtgattcaaatatgttataaaggcattcttgcaccatggtaaagaatgtgtgtggtaaatctccgtttatatgtagttggaaaaaattcactgaataatgttttaatgatagggtattatgatacaatgtaaaaaacaattggttcttcagcagtacagaaagtaaactatatatgtgctatcaggaaaccccttcatactgtgtataaaattgcaatctagtgaaataaactgtatgcaatggaaaaaaaaaaaaaaaaaaaaactcga

SEQ ID NO: 2650 - DNA, 1723 bp, Homo sapiens
gaattcggcacgagcgacatgggctccgctccctgggccccggtcctgctgctggcgctcgggctgcgcggcctccaggcggggggtgagtggcggcgccccccggcccattccccggtcccggccccgcctctgaggttcgcgtccccccacagcccgcaggccccggaccccggcttccaggagcgcttcttccagcagcgtctggaccacttcaacttcgagcgcttcggcaacaagaccttcccycagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctyagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcmaaaaaaaaaaaaaaaaaaaaaaaaaaaaaaaaaaaaaaaaaaaagggcggccgc

SEQ ID NO: 2651 - DNA, 1387 bp, Homo sapiens
  misc_feature (34)..(34): n equals a,t,g, or c
tcccgctgcgccgcgcctgaagccgcgcagtagncctgctctcggagttttgacagtaccggagctgaaattgtcagcggcggcaagcgcaggaaagttgagaggagctcgtggccccagaacaaagcttgagaaaagtaaacaggcggctgctgccggcgagcctcccttcttccctctccccctcagcctccttcccgcccttgccctgctgtttccttccagcagctccgcgggggaggaggggaatgggcttgctctctctccggcgattactaacttttgcatcgcccctgttttgtctttctctccctgtccccttcccgccctctgcagaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttwttggtgtattaaaatgactratkaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaaraaaaaaaaaaaaaaaaaaaaaaaaaaactcgagggggggcccgtacccaatcgccct

SEQ ID NO: 2652 - DNA, 960 bp, Homo sapiens
  misc_feature (460)..(460): n equals a,t,g, or c
ttttgtctagtacatatatgtaaatatattaatgttgtttttgtgtttgtgatgtagtaaggagatgtacatagaaattcattgaggtatatagatactcatctgtctaggcagttcccaattttctgaagaatgttttacagcaaaattttctattttcttttattaaatagtgacacgtcaaacaatgtcacatccaaaacactagtttcatcaatttctagcagtaataatagacttgctgtaagtattgttttctgatgccatacccttgtcatacatattattaaatgaccaatattatgtatgaagtagacaaaaaaatttactcaaacttcattcaaatcctaattgtgataatttttgttttatatttaattataaaccaaaatacatttgcatttttaagctaatttgtctcaaaattttgctttatatttttggatcaggttaaagtccngtggatcccctgaatgttattgtccctcttgatggtttttacttctgagctatacgtcaaaagacacataagcttcaaaagtcmagacaaacctcattgccataaaaatcaagatatagatgttctgttccgtaaactccttgaaaaacattttaaagtcatcaatatgatctgtttcccatgaaacttaagttagctttcttattggagtwattycttttctgtaagtctgaaaagtagagattttgttttacgcattttagtaacctgcaacaaccaactctaaaaaagatttggcttgtaatgacggtctctgcttttttgggtttggagtacacaattgtaatatttacttagttatttgtgtttttctttgttcaaggtattgactagtttcataaattttttgmaagtttttctttcattggttggaaagcagattacattttgcactattaaaataagtttattactttaaaaaaaaaaaaaaaaaaactcga

SEQ ID NO: 2653 - DNA, 534 bp, Homo sapiens
  misc_feature (470)..(470): n equals a,t,g, or c
  misc_feature (477)..(477): n equals a,t,g, or c
gaagcagtgtgtatctatgattatatctctgttcatctatatatttttgacatgtagcaacacctctccatcttatcaaggaactcaactcggtctgggtctccccagtgcccagtggtggcctttgacaggtaggaggatgcagtgctgcaggctattttgttttttgttacaaaactgtcttttcccttttcccctccacctgattcagcatgatccctgtgagctggttctcacaatctcctgggactgggctgaggcaggggcttcgctctattctccctaaccatactgtcttcctttccccttgccacttagcagttatccccccagctatgccttctccctccctcccttgccctggcatatattgtgccttatttatgctgcaaatataacattaaactatcaagtgaaaaaaaaaaaaaaaaaaactccaagggggggccggtacccaattccccctatantgagtcntattacaattcactgggccgtcgttttacaacgtcgtgaatgggaaaacctgggcgt

SEQ ID NO: 2654 - DNA, 1720 bp, Homo sapiens
gtctgataagcgactgtggttattcccctaaagtttacttcagcactaacactagtgcttccgctggagtttgcagttttccagctttatacaggattttcctttgactggaagagtcaaggatatagagactcaacagtgacatttattgtacaacatcaaggggaataggatactcatcaaactgggattattcttatcaaaacatggtcttctttgaataagaaaaatacatagttggttattatggacttaaaactgtgttaaatggatattctgataaaatatttgctgctctgtagagtgtggaaaatctgagaatattagctttactcatcttgagctttgaggatgttctctgtacgccgatggtttcatattaactaaaaaagctgggtattgtaaaatctcatttataaaaactcagatgagaagaaaattttctttgatggtgagactgttgtcttagttcaggaaattatttaataatcctttgttacctgtgaatgaaggaactttgtaattctgatttatcgtaaaacatgagcctttccagagtcagcttagacactgttgtcgcaaatagccatgctttgccttatgccaaggaggcccagagggagggcctagtcttcctctgttgctgtacatatattgaaatgctttttttttttattttgcatttgttatctataatgagctttctgagccctgatattatgtgagacaaacaggagttattgatgttatacactcccttccattcaggattttctgcttggagggaaatatgttgaccttagagaattgtgaatattgttgcaattcttgaatatattaccatgtgaataatagagactgtgttgctctctagtataagctatatttatttttgattcatttgaattactagttataactggagaaattttgttacctctatcctggcttgcctgactggctgtataatagcagcagcctcttttagagcatcttaatgaaaacatggatgaaaggaattaatgatgatatctgcagactgcgtagaaaatggcttttgttcccagcgttaacattttcttctcaatcacatttcaatgtttgtggagagtggcagattcacaccagaaacactaggtgttcatatccatagcatggatgcagaataagcagttgggagagaagcttcttcctacctggtactcctcccattcacctcagcccagccccagacaggcgttagcattcagtgtgggccctcaggcagccctgaagcctggctgggtcatcagatgggggcagcctgtgacgggcaccagcggcctgattccagggaagagttcctggagggtgttggctgtttttgttagctcagtttttttctgggctccaccattcctaactccaggtagacaagatagatgtcacacacaacaattttaaagtattttgcttagtgcattttgtttatgattgcagtgtttgtttcttatttaataggctttttacttcattctattaaattttagtgtttagaagaggcgggtactgtcactgtgtaaaatatgtaatattttatatgttataccatgtcatatatacttgcaatatcagaccttgcattcaatatacaatgcaattgactctttgcagacctgcatttttcagtgaacaataaaaagattgtctggcactccaaaaaaaaaaaaaaaaaaaaaaa

SEQ ID NO: 2655 - DNA, 1544 bp, Homo sapiens
  misc_feature (1)..(1): n equals a,t,g, or c
  misc_feature (8)..(8): n equals a,t,g, or c
natgcttncaactatttataatgcatcaatttgaacttagarggtrggagatcrgatcatatgtgggaaaatgtaaaagcagggatatcagtgggcattagaataaaaactagggatacaataacttctttgcatatgacaatacttatttgtatataagagaaagaacgaaataacctttattgaaataaagatactatgcaagaaaatgtacagttgtcgaagtggagaaaatgaggatatattcttgcagacgagctataggtcatacatgaatgtctagtgagacattcaaaattcgtatagggtgcagagtaatttcttattgtgaggaactgtccaatgtattgcaagatgttctgcatacttggctctcacatactaaatgctagtagcgcccccacccccacgcccagtcacggtgacaaccacaaaccctatcagatctattcacctttttcagagcagatattttgtaacattctctttgctgacctgaaatgactcatagataatacaatctacttacacacatgaatttcttaaaaaaatcaatttaatgccctaactctcttattaaggagaaatagaaaagaagaaatttataatgaaaagaagatgaatttcattatgtaaacgctcaggcatgactacgctgtttgaaacagacagatgtttactcttccttgtaatgagtaggtttggatttaagagccgattagaggctacttcctgtaaacaagtacaggaaaatgaaactagacgggtgggggacactagaatgaaaaccagtgttagggtaaagacaaaacagactatgtacataatctgtatatgggaaaagaaagagcgaaattaccttacttaaggataataggacaagacaaattacagattgtctcagagaaaacaaatgagttactctctcggacaagctgtaggtcctacctaaatgtccagcaggacattagacagtcgtacagggtacagaataattcttcgttgtgtggcactaacccacacactgcaggacatcgttctccctggctgcatccactcagtgctgggagtagtccccagttattatgaaaccaccaataacccactgaccacagtgagaaccactgattttttccactgacctactgaatatctagcatccttagattggctcaactgttactttcctaaggagtccttctacagaataggtcagatcttggcctcccaaaccccttatttttaaaatactttgcgccttgctttgataatttgtattatgtatccaaactgaaattatctgctttctgcattagaatgtaagccccctgagggttgagtcagtctgtcttgtttgctgtgccacgcctgatgcccagcccagcagcatgctttgtacactgatatattgggtaaattttgttgaataaattaagctcaactatttgtatttcaatagttgagttgtattgcttcctgttcttcaagcttaatttgaactgtctaataaaaagaagtaattaaaaaaaaaaaaaaaaactcga

SEQ ID NO: 2656 - DNA, 1896 bp, Homo sapiens
  misc_feature (444)..(444): n equals a,t,g, or c
ctgcaggaattcggcacgagcggaaccggggccggctgctgtgcatgctggcgctgaccttcatgttcatggtgctggaggtggtggtgagccgggtgacctcgtcgctggcgatgctctccgactccttccacatgctgtcggacgtgctggcgctggtggtggcgctggtggccgagcgcttcgcccggcggacccacgccacccagaagaacacgttcggctggatccgagccgaggtaatgggggctctggtgaacgccatcttcctgactggcctctgtttcgccatcctgctggaggccatcgagcgcttcatcgagccgcacgagatgcagcagccgctggtggtccttggggtcggcgtggccgggctgctggtcaacgtgctggggctctgcctcttccaccatcacagcggcttcagccaggactccggccacngccactcgcacgggggtcacggccacggccacggcctccccaaggggcctcgcgttaagagcacccgccccgggagcagcgacatcaacgtggccccgggcgagcagggtcccgaccaggaggagaccaacaccctggtggccaataccagcaactccaacgggctgaaattggaccccgcagacccagaaaaccccagaagtggtgatacagtggaagtacaagtgaatggaaatcttgtcagagaacctgaccatatggaactggaagaagatagggctggacaacttaacatgcgtggagtttttctgcatgtccttggagatgccttgggttcagtgattgtagtagtaaatgccttagtcttttacttttcttggaaaggttgttctgaaggggatttttgtgtgaatccatgtttccctgacccctgcaagccatttgtagaaataattaatagtactcatgcatcagtttatgaggctggtccttgctgggtgctatatttagatccaactctttgtgttgtaatggtttgtatacttctttacacaacctayccattacttaaggaatctgctcttattcttctacaaactgttcctaaacaaattgatatcagaaatttgataaaagaacttcgaaatgttgaaggagttgaggaagttcatgaattacatgtttggcaacttgctggaagcagaatcattgccactgctcacataaaatgtgaagatccaacatcatacatggaggtggctaaamccattaaagacgtttttcataatcacggaattcacgctactaccattcagcctgaatttgctagtgtaggctctaaatcaagtgtagttccgtgtgaacttgcctgcagaacccagtgtgctttgaagcaatgttgtgggacactaccacaagccccttctggaaaggatgcagaaaagaccccagcagttagcatttcttgtttagaacttagtaacaatctagagaagaagcccaggaggactaaagctgaaaacatccctgctgttgtgatagagattaaaaacatgcccaaacaaacaacctgaatcatctttgtgagtcttgaaaaagatgtgatatttgacttttgctttaaactgcaagaggaaaaagactccactgaaattctaagtttgccaagtagtgtaattgaagtccttgtctggtcacacagtttaattctatttttgtaagaacataatgggactgcataacagagttctatattacaattttgtgattattagtacagagtacagctatgctgtgactgttttggaaagccagttttaacactatgttacatttttgtttaaagtaagttaaaccttatataacataatgacatttgatttctggatttttcccatgataaaaattagggggataaataaaattgttactggaatttctctgcaaaaaaaa

SEQ ID NO: 2657 - DNA, 657 bp, Homo sapiens
  misc_feature (634)..(634): n equals a,t,g, or c
  misc_feature (650)..(650): n equals a,t,g, or c
  misc_feature (655)..(655): n equals a,t,g, or c
gagtttgtraacctatattcacagcattaactaatcatgattcgccccatatttcactggttatgctttggttatcttagaaaagaacccagggcatttatgaggtaaaacttgcagggcagattacaggcatgagccaccgcgcctagacttattagtcttttttaatgggatgacagcagctgggrtgtatatattcctgcaggaaagaaaaggaaatggcttcacattgctggatgggagcagtatgtgtgttgtttctgggtataatcttcctagctgcacttttcccatacatttctttctactaaaaatcatgaaagtttgaattatagttcctctcacaggattgaaagcaagtatcagaggagtcatccattcaaaacacagttcttccactgcagtatccgatatgttttgtatgtgcgctaggctgtcttttcattcagtctacaatacagttcaccagtgtggagaccttttgccctgcctgatttgttttgttttgttttactcactcttttcaatgacttttggttttggccagtatgaagagtaatggatgttggaataccttctgccagttaaaaaaaaaaaaaaaaaaaaaagggcggccgctctagaaggatccaanttaagtaagcgtgtcnctccnct

SEQ ID NO: 2658 - DNA, 619 bp, Homo sapiens
  misc_feature (526)..(526): n equals a,t,g, or c
  misc_feature (619)..(619): n equals a,t,g, or c
tcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttngtgcctggcacctagaaagcactcaataaatgtttgtttaatgaaaaaaaaaaaaaaaaaaaaaaaaaaaaaaaaaaaaaaaaaaaaaaaaan

SEQ ID NO: 2659 - DNA, 2185 bp, Homo sapiens
gggcatttccgtcattattattattgctgaatagtattttattatataccatattttatccatttacgtgttgatggacctttggactacttcctttttcttttttgcagtgatgcataatgctgctatgaacataaacgtgcaagtctctgaaagtggcttttcattttggggtagatacctaggagtggagttgctgggttgtgtggtaaatttatatttatttaagaaatggccaaactgttttctaaatggctgtatcattttacatccccatcaacaatatattagggtttcctgtttctccacatcctatttgttaatggcttttaaaaattatagacattcttgtaaatgtgaagtagtgtctcattgtagttttagtttgcattttcctaataacaatgatgtttaacttttttgtgtgtgcttattagctgtttcacatgcccttatacatattccattttttacttactgtttccataaatcactgcatgtaaattcagagctctctctctgtctcactttctcttttgttgtattccatggcatgtaggtgccatagttttttctgatcaatctgctatctatgggcatttaagtagtttttaatattttaccaaaatacaaaatgctacaatgaatcgtcttacatatgtatttatgtttaaggtatttcttcagactacagtccttgaatactaagtcaaagtatatatgcatgtgtagtttgttggatattgcctttccataaaggttgtggcatttcagattctaccagcaatgcgtgagactgttttcccacaacttcactaacagtgacatactgtaaagcttttgaagttctgccaatctgataggtgggaagtaatatctcattattgctttaatttgcatattatgaatgaagttaaacatcttcaaggactatttttctattttttgtgattgtgcctttgtttatggtgttactttgccatgcaaagtttttatttattttttggtagtcaaattgattaactctcctgtgaaaccatctgagtttggtggtttttgggaattaatttcttgataacattatttcttatatttaaattgatttcttttaagttttttggcttaaaggggtcagtttgctaaactgtatatttttaagaaattatccatttccttttagttttcaaatgtatttccactgaagtaatcttttaaaaaaattccctatatcaatagttatttctcccttgttattttttattctatctgcactttctcccttttttcaaaaaattaaactagcaagtcatttgttttattgttttggtttttttcaggacttttctcattaatttgatgtactgtttttctattttctatctcaatttctgttctaatattttcttctttggacttttttgtattttactttgttgttctggttctttcaagctaagaatttagttcttatttatacaggtatttaggctatgatttttttctgattactgcttagaatgtatctcgtagatatatttattaccattatttttcagaaattatgtaatttttgtttgtatttcctgttttgtccaagagctaagtttaacagaatatctttaatttacaagtagaagggcctttttggtttcatttttaatttctatttttattgcactgcgatcaccggtattgtttgtaataatttagccttatagttcctgctggtattttctttgtgccctaatatatgttcaaaacttttaaatatacatgtgaatgtatgtatatttaagattgtatatctctattattaggatatagtattcggtatgtattcaaacatctaccttattgattgttatttagttcttatatatctttactttgttttttgtttgcttgaccagtcttcttgtactgtatgttaaagtctccttttagtagtatgtttgtctttgttctttttgcatctgttgtagtttctgttttatgtaagtgttgccgtattgtggtagagatacctgttacatcctaaatgtgaaatgtggattttaataccataaaagtgtccttctttgttttatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2660 - DNA, 1327 bp, Homo sapiens
ccacgcgtccggcacataatgcagggcctgacacatccgtagagtccttggaaaatgtcactgctattgctgctgtctgtactaatgtcacctggggctaggccctcagaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaaggtgatgtaaaaagtatggcccagttctacgggctgctggcccatgtggctagaacccgcctcaccccatccatggctggggcttctgtggaggaagatgcacagctccatgagctggcagctgagcttcagatcccagacctgcagctggaggaggctctggagaccatggcatggggaaggggcccagtctgcctgctggctggtggcgagcccacagtacagctgcagggctcgggcaggggtggccggaaccaggaactggccctgcgtgttggagcagagttgagaaggtggccgctggggccgatagatgtgctgtttttgagcggtggcaccgatgggcaggatgggcccacagaggctgctggggcctgggtcacacctgagcttgccagccaggctgcagctgagggcctggacatagccaccttcctagcccacaatgactcacataccttcttctgctgcctccagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaaggttggtcctcagggcctctctaagccttaggcccctcctctccttggccttggctgtttggttaactgtcaccttccactcagggcctctgctctatatctattcccttccagccagactggcagatgggggcttccccctacccctgaggatgaggacaagcccctcggccagttcagcgttcccgtgcttcccccttgggcagcctctctcttgagcccctcaccctgtttctttctgtgaagcgagaatgtctgaaaataaataggaccatgccatgggaaaaaaaaaaaaaaaaaaaaaaaaaaaaaaaaaaaaa

SEQ ID NO: 2661 - DNA, 1276 bp, Homo sapiens
tcccgggtcgacccacgcgaaccgcggacgcgtggggccgkctgtgcacatcccaggacaggagcccctgaccgcgtccatgctggctgcggcgcccctgcatgagcaaaagcagatgattggcacctgttatcttgtcttaaaacgctggtcagactggatggtcctgagctttcttccactgctgctgtcctgtgactttgaggggagcgtctctacccccttatccatgatgtccacacccagctggctggcaagatcacgggcatgctgctggagattgacaactcrgagctgttgctcatgctggagtctccagaatccctccatgccaagatagacgaggcagtggccgtgctgcaggcacaccaggctatggagcagccgaaggcgtacatgcactgaaaccagatttcagcttaaaatgccacccagagaccaagttcattctgtcaactgatctccagcacctggcccagagacggaaagtacaaagactagtaaaatacatccttgcccttaaggagctaagtacccaaaacctgtaatccatcttgagtcaccagagtacggttgctcagaaacagcagtggtgcggtggaaagggcatcaaccctgcgatccggacaagtcactccatccctctgatcatgcgtgcccacctaccacatgaggatatcacttcatagacttgctggaagggttcattgtgttagcctgttccctgagctctcttcgtgatcaagaagactgatcagataaatcaagagacttgcccaaaattacctaggaaatctgtagcagcagcagaaccaaactccggtccttgctaaatctagataccaggctagcttttctatggacccagaattaacccatacaaatgtacaagcttttccagaccagctggggtgagatgaatgaaaatggcagcaacatcaatacctcagcttcttcagcaacttcatcaagtaaggctgccatgaggaagtgggcctaaaggagagttttctagaacaaagaagggggcaaaggagtggcttgaaactgcaaaaagtgcagacaaaaaaaaaaaaaaaaagaatgaaatctggagaggatgtgaggagaggtctagcaaaatgattaaaaatttggacttagcatcaaagtcaaacagatccatattcaaatcgtggctcttccatgtcttcactatgtaaccccgagggagccaatttaactctcttggactcctcctttctaagcattttatccacagggccataataaagat

SEQ ID NO: 2662 - DNA, 840 bp, Homo sapiens
  misc_feature (326)..(326): n equals a,t,g, or c
gaattcggcacgagctttttcattatctttaccttaatctcttagcatatgatttatggactggaatggtgagtgatatcagtgggcaaaaacaatcattagaggctgttaaggaacatttattgtttatttggctacctgtctataaaagtacacatgaaggccctaatagcaaaatatcaaattatcaagtgctttaaagcagaaaatgtcatttgtttctcaaaactgcaccaactttatataattgcccttttaattatccctagtggcccgtgaaatttgcaaaatagagcatcaaagcttgatttacttacagttgcacnttggcgggatcttaatgaatattgtttagtactaatgctgagatggaatcgtaaatgtttatagtgagggacttacttagaagagtggggaggccagtaatgaaactgaatcaactgggttcttcaagatggaacaatatggccatattcttgggcctaacattttgaaaaattctttttatagtggaattttatttttaattcaggtctagatgaatacacattaagtttagttttgcagaatctttttttttctgcctagctatcttattactttccaagggcttttgaggagtaatttgtttcctggcaatttcggattaaaatcacctgtttcttcataaattgtcatcttcaaggtaacactgagaactggatctctgaaatctcatgttttcgagatgatttttatagctgcagacctgtgggctgattccagactgagagttgaagttttgtgtgcatcatcatgtgccattaaatgaaaaaaaaaaaaaaaaaacycggggggggg

SEQ ID NO: 2663 - DNA, 1021 bp, Homo sapiens
ggcacgagaataaaatagatttagggtattcgacacatttaatacataatgaatagtgaatttcttgaataatataatgcctaaatgtgactgatatgcaaaatatttaaatcccttacaggatgtgcatttaccaatcagaacagatgttggctttactgcttgtattagttttctgtattagtttgcttgtattagtttgctggggcagccataacaaagtaccacagaaatttatattctcacaattctgggggctagaagactgagataaagatgtctgcagggttggtttcttctaaggactctcttgttggcttgtagatggttgttgtctccctgtgtcttcacctgcacttccctctgtacctgcccgtatcttaatctcttcttataaggacagagtcatattggattagggcctcaccctaatgacctccttttaacttaattacctctttagagactctgtcttcaaatacaggcacattctgaggtactttaaggttagaacttcaacatatgcatttggaactggggcataactgagtccatgacactattggagagggttctggagccataacagatggaatgaatgggccttgtttggattctaatttaaataaaccaactatagaaaaacatgttttaggcaatcagattttttgttatgggctaaatatttagaagatgttaagaaatgtttattaatttcattaggtaaaataatgttggtgtggttatgtagagtatgacttacgtgcacagaacagaatgataaggtgtccaggatttgctttaaaatattctagatttttttaaaaggtgagaggaaatgacacatgtatatctaaattttgatggttgttgaagctggctggtaggtacctagtatttcattatactttttcctttgtgtgtttggaaatttttataataagcaggaaaaataaaagtaagaatatatgtattatagataatttgaaatatgtagaatcatgaaaaaaaaaaaaaaaaa

SEQ ID NO: 2664 - DNA, 1202 bp, Homo sapiens
gcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttataggggagagaagctccgagtacctgcgtgccctctttgtctacgagaagggggctcgggtgctgtcatggttccagaacaataaccttccccttgggctatgaacctcatccctttc

SEQ ID NO: 2665 - DNA, 778 bp, Homo sapiens
ggaactaaaaagctttgtgttcttcagggtgggtggcagggggatatagtgagggtggaccagggagaatgaccatagggcactaagtaaggctgggattggatcagcagaaatccaaccctctaaccttagggtagggagtgctaaggatctggggaaaccatgggctgggaagctgctcttgctctcctcgtgtctgctgtttttttcccttggtgtactatacagaggccagatgttggcaccacctctccaggaggattggaaaggaggagtaaaggattctgatttgattgatgattccagtgcatccccaatcccaccatcttacctggaatataaggctgccttgtaccccttttctgagcacaagtctgtgcgtaatgcaactgactctcttacttttttcttagtaactgatcatttcctagacaaccaagattctcaataagtcccagtctcatcacaaatattaatatttccttttcctcataccaacttgactatgtttcactgaaacccacaggtcttgggacagaatgaggcattacctcattgaactttagctgcctgcatgagtcctctgtcctcaagtctttctcagatcatttctcaagctggctcccagcttagggcaaagagaatctccatgatgtgctgacttctagcttgccacagacacaattctactccaaagtcagcctggcatagtaacattgatgtcaggggagacatatcagtttgaggccatacaaaaaaaaaaaaaaaaaaactcgag

SEQ ID NO: 2666 - DNA, 524 bp, Homo sapiens
ggcacgagcggcacgagcggcacgagacggcctcccctccgccctgcggtcccgcgcggatgcagatctgtggatccagcgtagcatctgtagcagctgggacatcattccaggttttgggcccggtgtgttggcaacaactggatctgaagatggcagtcagggtgctttggggtggtctcagcctgctccgagtgctgtggtgtctccttccgcagacgggctatgtgcacccagatgagttcttccagtcccctgaggtgatggcaggtaaaactccgcatgtgtggctgagacaagctgcagcagagtctgcttgagaagctgacgggagactttgtggggagggagtagcatgtctgggtagatgagtagtaaatccacaagcagagcagcagcctctctctctggggtaagaacttggaagtggggacttcatatctccttcccgagtggtgacactgaccttctgggtaatgctaataaaccaccagtctctttgatgtaaaaaaaaaaaaaaaaaa

SEQ ID NO: 2667 - DNA, 1129 bp, Homo sapiens
  misc_feature (1053)..(1053): n equals a,t,g, or c
ggcacgagcttatttatttctgctgtcctttttcttattattctgcctatattatcctgaaaatatttagtcagttctgttttgcccacaattagcatggctaggtcattgatttcagcactcaggtcaggtatgtccccaggaagggtctcagtggtttctttgcagggatcacagctatgtcttttggtatctattgcaatcatgggtttgcttctattttgaatttgtctgtcttatctcttggacatcaaaagtgcccttcagggtaggcatgctacttgttttatatctgccacccaatttcaactgtaaaatcctaatcacaagtggcaactagataggttaaaatgatttctggaactttccttctggacatgtaagatcctaaaatcttacgagaatttcagtgagttgattttgtctttaatattttttcttaggaaaaagaagacccattttgaatctgttcaactgaaaacctcaagatccccaaatatatgaagagacagtgctgtagcccttgagactaatgaacaaagaaacctgctctagttttacaggaccatattttagggtctgtcctcatacctgtcacattggtgatctcacagaggagggccatgccgctgaaaagggaaggagattgaaacatttgattgccttatcacatggtcaagtaccttgccaaataaaggaaagcaaatgatttgggtctcaactgaagatgaagctcaactcaggaagagatttatctgtatatacacataactgaaaaccaagtttaagcccaccaatgcactgctgatgcatgccatataattaatgggtaactttgattctttatgacgtctacataacaagtgtgatttggaaggcacatgtgagcatatgcattatgatccaatttatgttttttctttgtttatattttggggaaaattaaaatttttttaaggtatatttttcccattatttattttcctgaccttaaaacagcttttctactaaaaaatggtgagcaatgaagacaataaatttttcatttttccnaaaaaaaaaaaaaaaaaaaaaaaaaaaaaaaaaaaaaaaaaaaaaaaaaaaaaaaaaaaaaaaaaaaaaaaaaccc

SEQ ID NO: 2668 - DNA, 814 bp, Homo sapiens
  misc_feature (421)..(421): n equals a,t,g, or c
tacgagtttttttttttttttttagccataattaccaaaaacattagtgcaggacaccattttaaaaaactatttaaaatagtcttcagagaaaaaatattaagtattacagtttaggagtatattgactttgggccaacggattccaatattttacaaaaaggcaatatccacgcaacatattccagattcgggttgtggagaagctgcagggcttgaggtgactctatcacaactgctttccgtacggaggagccactgccaactgtgtggacgagaatacttaagcacgtgcttcattgctccactgccacaggtggatatttcaggggaattattattaatttcaaagtttttttaaaargytatgataagtaaataaaagtaatggtaggaktcacggtcggagagcttatcgccnaagtctttctatagccttcccccggaagccccagttcaggcatcggtcacccgaagtgtcaccctctgatctttcccccatcccatctgaggaagttaaagagatccctcacaggtaccgtggctctcggtgccctcgcacttccaacagccggttcgggcccaggagactcgctccgacctccaccacaatggcggccagtgtgggccgcgcaaccagaagtgcggccgcgcacctgacccagcttccgcctgcacctagagctcagcgcaccagcccggctcagccagacgaaggcaaacgaagagatgcggatccctggaggactggccccaccgtgaacaaaacaggaagcattccaggaagactgcgggggtgggctcgtgccgaatc

SEQ ID NO: 2669 - DNA, 986 bp, Homo sapiens
ggcacgagcttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactaggggataatacaacatttttaactctcatttgacaacctactactaatcacagaccacaagggtaatgaccaaatttatgtgggttttgcacccatagttgtcctagcccaacttcaaactcttacgattacttgggtaacgctctggaggaccttccttgagatccctaatatttaagatatttgatatcttgaagatagtataggatatagagatttaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2670 - DNA, 1442 bp, Homo sapiens
  misc_feature (1377)..(1377): n equals a,t,g, or c
  misc_feature (1419)..(1419): n equals a,t,g, or c
cttctatattagatggacagatttatatacttttccatggaggattaagtaaactgaaacctaagacacacgaagaaattctaagtggaaaggccacttattagttagtttacagcagtatcgtaagtgacaggatgataggagtgtggtaagtgatcaggataataatctgcttagtaagagaaacaatttgaattttagaaggaaattgccttaccatttgcaaattaaggtaattaaaatacagtgaatttcaaaatgcctttttaatgacaatgtgtgaacttaatttgttttaataaaccaaaattrttgttattgtgttaaggctattttacattgaatgtgtatcttgccactgatgttaacttatcccatcttacccaaggttgtaggtaacaatatactattgggtgacagtggactaacatctctagtgatccctttgtcagtggtctttaacttaaaataatttagagaatatggtttctacaacttacatttttgtttwcttgtaactacagattattatgatggttgtaatgaagattatgagtataattggagctatatgtttctgaattctgaacaactatttataaaattttatcctacttttttctgttgaacatatgacttctctggtctgctaaacacatacagacctttagttttggtttacatggatttaaatatatagatatatcactgtaaaataaacttcaggtgtaacagatttatagagaaagtaatcatatttgtttatggttgtgtacctactttgagaagaaaagaaaaatattagaatgaacagataattttacaagtgttgatcacttaccagcaaaccagaaacttcagagattttgaaagcaaatctattttctctgctgtgtattaaattcatttatctaaaatgttattgctcctggcttagaatcatcttgtgcaaattctctttttttgttgtttgtctgtttgcctgttgctcaccatagacataattttcttttcataaaacattctttgtataatcacctcagagattatgaaagtgactttgataaaatttaatggtgttcacaaaataattttcacgtgagtaatttcacagtgcgtgtattgtatgttatttagtgtattttatattttgtttcaattagagaatgctattgaatccagtttttgtttagttactgttcattttactttataaaattgacataattgagtttattaaatttattgggccaatttaagtaaacagttgaacgtttcataagtcatgaggtctttttgggcatatacatgaagtaaacaaagacaatactaggctatgtaataggraggctaccttaattaggaggtaaatattcnttttggaaattgggcccgtgggcctcgggtggaaaatggggnaatatccctaggtaaaaaaatgg

SEQ ID NO: 2671 - DNA, 1374 bp, Homo sapiens
ggcacgagtccgggatgagctcagccgcggccgaccactgggcgtggttgctggtgctcagcttcgtgtttggatgcaatgttcttaggatcctcctcccgtccttctcatccttcatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagatttttttttttgttgaatatgtttgttcttggactttatgagagagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccactactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaatctgaaccaataacctgtgtggcctacaaagtataattctattaaatgttccttaaaacaaaaaaaaaaaaaaaaaaaaaaaa

SEQ ID NO: 2672 - DNA, 596 bp, Homo sapiens
  misc_feature (8)..(8): n equals a,t,g, or c
gaattcgncacgagattacttggacatgaaagaactcaggttcaagtttattcatttactaagttagttaaatcatgtgccttccatgagccttcatttggtaacttggaaaatggaaataataacactagtcatatatattctacactgctaccatatggaccaaagggattatagattacaatcaccatcattcctgctgacaggtatatagaaaacaatttcattgaagaaaagtccttacatttatccttttcctaatatctgcatgggtaaactaataaatatagtcattagaaaacccttattattattattagttcaatgtgagaactgctgcagaaaaaatatgctttataatattttcttgaatatacataatattcataaattttcaaatcattgaaaattaccttaaaattggaaaaaatgtgcatttctactcatataacagtataaaattcctatgtcaatctcttttttttttttttgttttgagttggagtctcgctctgtcgcccaggctgggcaacagagcaggaccctgtcttaattaaaaaaaaaaaaaaaaaactcgaggggggcccggtacccta

SEQ ID NO: 2673 - DNA, 1324 bp, Homo sapiens
acgagctaatgattcttgctgaagatggccagagtaatcagagtaattaatttggggaatggtgaaggataaggaacctgatcagatatcaagggtgggggtactcttgctaaactgactcagtagggtccttgctaaaactggtttttacaagagagagcacaggtaggtctacaagaagattcgggagactgactaaagtttcatcaagaatctttgtcaggagacatgacctttatgatacttaagtttttctttttatgcggttttgttttaaacaggctaatagctcgtcagcttgctaaaatccatgctattcatgcacacaatggctggatccccaaatctaatctttggctaaagatgggaaagtatttctctctcattcccacaggatttgcagatgaagacattaataaaaggtaaaattatttttacatttgaaattatgttttacattgctttgctctatgatagggtttcaaaggtaattgtaaagtttcattgtataaaatctggttttctttctttgcattgaagtaaagtaagcattgattctttggctgtcagatagcactacagaaataactgcctctccatccccctcagtgtcccctcccaaaaaatatgccctacaacagcaaggggcagaagtggaagtaggggaacaccacttaaaaataaagaggtaggtggtaatggtgaagcaaggatttttcttgactttttaagatactgcagggttgagaggcaagtctagtattatatagaataagagcacaagagcctggagccaaactgagattaaatcttagtcctgctagttaacatttctgttgtgtaactcattcaactagggaacttaacctaactgtttccttatctataaaatggaaattacagtagtagtatattaaccatatagagtttttgtgaggattgagatagtatatgtaaagttctttaaaacagtgcctggtcatcacttaagtgttgaggtagctgctgttttaaaaattactattgttattcaaagaaggttatttgagttatattttttccctaggctctccaaggtatactttaaatccttgaggttaatgattctttggaaaagctggaggtgtgctgtggtaaataataggaagaaaacccttgccccaatagaaaataatacaactagaacataaaacacaattaaaatattaaatacattttgtatttcttttattccattttgtttgttcatgatttaagttttataatccttcgaatcccacaattttcattcgacactacctttaaaaaaaaaaaaaaaaaaaaa

SEQ ID NO: 2674 - DNA, 851 bp, Homo sapiens
cacatgaagacacacagtggtgagaagcccttccgctgcgcccgctgtccttatgcctctcctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaagccatgtctatgctgaattggcaatggcaggcaatttggccttaccc

SEQ ID NO: 2675 - DNA, 739 bp, Homo sapiens
  misc_feature (732)..(732): n equals a,t,g, or c
ggcacgaggacaggatcctggtttgggtaccttagtttaatagaaacccaggtggaaacctagattgcagggcatttgtttgagactatttagccacagcagggcaagcaggaagatgcagcctgtcactgctaactccttagtattaaaactgtcaaacatgggaggtaactgctgatgcatttttcagttgatagtttatatactttctctgaaggatcctaatgatagttaaccatttctcatttttattttgctggattgttttctgttttttgcttcagcattcttgcttttgctgtgcttacttttggagttttgattccctgtgtcactgttttctttcgcatacacctctcaggtttacacagtaaacaatgtgaatgtgatcaccaaaatacgcacagaacatctgaccgaggaggaaaaaaagagatataaaggtaatcaccaccaccctcccacctcctgttttgttgttattttttaagcctagagggaactctttgttggctctgttaagtttagggttaatgtgattgggttgtgttaagcctaaccctaacttctwctctctctctctctttttttttttttttgaggcaaagtctcgccctgtcacccaggctggagtgcagtggcacgaccttggctcactgcaacctctgcctcctgaggcaggagaatcacttgaacctggcaggcggaggttttggtgagctgaggtcgtgncattgca

SEQ ID NO: 2676 - DNA, 2020 bp, Homo sapiens
  misc_feature (1239)..(1239): n equals a,t,g, or c
  misc_feature (1587)..(1587): n equals a,t,g, or c
gtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggwtccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacgtgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagmggcacttgtgactttgtttgactctgtgactcacttcctcgctcacaccttgtttgaactactggactttcaactggctttccttaggtcaggcaagcagacagctccccactgaagaggtctgtacagtgacaacccgggccggcagcaaggacacagatgcagccacagtaaggctccatcaggactgggtcagtgatggcaacaggatggccaaggatggctctagaacaytctgtccatgcgtcactccccccagttttrtttttagctttggcttcagggagtgacagccatcacaaatagccacattctgctctactctccaacataccagattstacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttanccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaaggcnccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagyacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctgaamaaaaaaaaaaaaaaaactcga

SEQ ID NO: 2677 - DNA, 1158 bp, Homo sapiens
ttaacccaaatgggttgggatggcacgaggggaaatgggaggggaagagaacagctgacatcttgaggaaagctttggggtagtggagaggtaagggggtcatggtcagtctgaactcaacaatagggctgaatgaatttaccaaaggaagctgccttatattatatgccaggctgctggggaaagcctcaggtcctggccagcccctgttctcacaagaacatgcaggttaccacataaataatggcatatgccttccataggacgtcaacctgacttaaatctacctataccctactctctattctttggtttttggttctcatccctgtggaaggaaatgggcctcttctggcatctcatgctactctgtgcttttccttgggctccaaattctagctcataaagatgcaagttttgcaatttcctataaatggttaagaaaagagcaagctgtccagagagtgagaagtttgaaaagagaggtgcataagagagaaatgatgtccatttgagccccaccacggaggttatgtggtcccaaaaggaatgatggccaagcaattaatttttcctcctagttcttagcttgcttctgcattgattggctttacacaactggcatttagtctgcattacacaaatagacactaatttatttggaacaagcagcaaaatgagaactttatttggtgcagtcagggctccatttagttccctcactctgcttctaatcaccccttctcccagccctcttctatttgatagaggtctgtccctcagatcagcaatgtcttagcccctctcctctcttccattccttcctgttggtactcatttcttctaacttttaataaacatttaggtataatacattacagtaagtgctatttagatacaaacttaaaacatactatatattttaaggatctaagaatcctttagagaaggcacatgactgaagtacctcagctgcgcagcctgtagccagtttttttaatgtaaaagtaagaatgccagccttaacctagccctgcagataaaagctaacttttattaataccagccctgaataatggcactaatccacactcttccttagagtgatgctggaaaaataaaatcaggggcttcaggattaaaaaaaaaaaaaaaaaa

SEQ ID NO: 2678 - DNA, 1211 bp, Homo sapiens
ggcacgaggtgcactgttactccatacggatggtatctgctttatgtgtttgacaacggcaggtttttgtctgcttgccatacattcatttgcacttggagtgcaatccagacagcagcattctgtccccattgtctttgaggtcctgccactcagagtccccgagccaagcagggtgacagggtgctcttcattttttcaaaccaaagttctttgcaagcagcatctccttgggccgagggcttcagtgaatattgtcctggcctgcctggcctgctgccaccgtaaaggcctttgtgtccacataccagccaacctgatgtccccatcctcagcaaagctttatcacagcctccactgacaaccgaagcctaagccactgaagaaatcatagatgccatgagagaatcatagataccaccattgatgacagtaaaagaaatcatacagagacaacacatctgaacccacctagaatcaaatccagagcaccctacccagctaacactacagctacatctacagtaaaagtctttctctacaaaagccagtccataaaattggataaagcagcagttgcacagatatcaagataaggacacaagaaacataaaatactgaggaaacacgatacctccaaaggaacacaataattttccactaacagatctcaaagaaccaggtaatcaataaaatgcctgaaaaggaattgaaaataatgatcttaagaaaactcagcaagaaacaacagaacacagatagacaatacaaataaatcaggaaaacaattcatgatctgaatgagaaattaaagaggtaaatagttaaagaaacaaattctggaactgaagaatttaataaataaaaaacagtcgagcagaaagaatttctgaactttaagagagaggtcttttaaaataacccagtcaaacacacactaaaaaggatgaagaaagcctacataggacatcataaagcaaacaaatatttcaattttgggagtgccacaaggagaaaatataggaaaaggcatagaaaacctatttaacaaaataatcactgaagacctcccatgtcttgagagagagatatatatccagatacaggaaggtcatatgtactaaaacagtttatccaaaaaggcctttctaagacacattattttcaaactcaaaagtcaaaaaaaaaaaaaaaaaaaaaaaaaaaaaaaa

SEQ ID NO: 2679 - DNA, 788 bp, Homo sapiens
  misc_feature (370)..(370): n equals a,t,g, or c
gaattcggcacgaggcaattttcaatgaaccttgaatggtaggaagaattgaagaagaaatcagagcatttttgccttgcagaaggcagctgctgtgatggcaggaggctgaaatggacatggcctggcagaagagtattatggggtggttgtgttgtgagccatctggcctgtacaatttggagaaacaatacttttttttttcttctctgcaagctgggcttcctgtgattgtgtcctcaggctgcacaaaaatagcgtatggctttgctgtgtattcaccttcatcttaaaatagctagaacattttccctcttcttttaaaaagtttttaaaatgagggttagactcttgtaggaaaaggtagaantcttaataacagtactcatgttgacaaacctttctcgtcaaaattcctatgtaatcaagactcttattaaatatgaacaaatgtaatgtatggaaattaatgtttaccctcaaggtaaaagctgaaatggatttataaagaattattttaaacagcaataatgtttgaggggtgggggaagtgagaaaaatgaaattttaaatcacatgtttatgactatgaagctagactttaaaaataggtcagttagggtatgactcttataatacaaaagtttatttggtatacaaaggatttatagctaatgtattttttaattatattcactaatacttgtaaaagatcattcaatttataaagtttccaaaataaacctgtttaaagtgtcaaaaaaaaaaaaaaaaaaaaaaaaactcga

SEQ ID NO: 2680 - DNA, 991 bp, Homo sapiens
gaaactttgtattttggtagcactacatagaaaatgtgttttagatttatgatgatcatatttctcaccaatgtaatttcagtctcagcagtgattttcaaacttagggaaagggacagcattagattttttttttttttcatttttttaaaatgatatcttacctgaaactacaaacgacaaaagagaattagaaatgtttgaattaaagtgaagaagggttgggggagatgggcctgaacccacttcctgtctcaatccatgctaccccaaacactccagggaacctctgaggttttattgggtgcactttgaaaatttctcttctatagtgtgtttgtttgattttaaatcacagagaaaactgggttttactcttagagaaacattttcatccagttttttagtttgcttcatttgacttcctaaatcatttttgagttcacaaggatttggtacttttctgtttagctttctctctctaagctttatctaccttaaaaacaaagtcctttttttaatggccagtccaaccaattgatttctcaaactgaagtgcccaggtgtggactcatcaatttccgttagaatagggacatcctacttaagagttggtgcagctccaaggagctgacttgtccttgcttggggtttttttttttttttctttcaccttctcaagtttccatggcctttgtgtgttctttttatgttgatttaaattcatatggttttccacaaatcccttctttggctacattgtctccttattcaatggattatccctttgtgggggctgcttattttaaagatgttgggggggaaacaaacccaaatctacgagcagtagttgcacatagttgccagttttaccttcttagtcattagatttccaaaccatgttgcagttttttggtccagatatagtatttctttctaataaagttttatgttgctgctctaaaaaaaaaaaaaaaaaaaaaactcgtag

SEQ ID NO: 2681 - DNA, 1531 bp, Homo sapiens
ggcacgaggtttttgtgtagatcttggatggaaacgcaagggtgatggggttggtgtagcagcagctaggcttaagaaacgtttggagggcacccccccccctttttttcctcttgagttttaagctttactccagccttgggagttgatttaacctttatccctggcacttggaggagaaaacagtgtaagcttttaacattttttgcccactcagtgctcacttttagtaatatttggactctttctcctcctatctcaggaaagaacaaaaacaaaagacatcaccttggatgtatcccccaacccccaactttagccaaaattgccaaagcagccaagggatcagcaggtgaactctcccagcattggatctatcattctcaaatctcgctgacaacttttatctctcataacaaaaagcagcttacctactgtttcatattatgaataattccatagctgcccaggcatcaaagtttgtgatactctacctattcatcctttcttttcccaaacagtgcatttgccatattttagtgagatggtctggtaaatcccacttctgacaccacttttttcaggtgtcctcaagaccctgccaggttcagtgattcccttagagaactcacaggactcagcgtgtagtttaaagctagacttacaggaaaaggattcgaagcaaaatcagcaaagggaaagggttcatggagtgaagcccagaggaagccaagcacaagcttccaagagtcttcttcccatggaatcatacaatacttatgtaatttacataatttatccagtgttgaattatgacaatgtgtatgaaatgtaatctgccaaagaagttccttagagactcggtgtccaaggttttgattgacagctggtcacataggtaccttctaactagcatgtaccaatattccagactttctgaagaaaagcaggtgattagcatatactgcattatttatacaaacaatttgggcactttgaaggactcctatcagttagggtggtgggaaccctcctgaaatccaagttcccagacaccagccatggatcaaccttgcaagaggcttttctaaggatagccatctgaagcctgctatgttaactcttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttaaaaaaaaaaaaaaaaaaa

SEQ ID NO: 2682 - DNA, 2881 bp, Homo sapiens
ggcacgaggaaaattccgtattgcgaatcattcgcaatacgcatacgatggcgcccgccgggatcgcccggtcccggccgcgagagtccgtcatgtcgttccgcccgatcgctgcgttgttgctggccgcgctctacgcgagcctggaccggaccgccaccccgatgtacgacggcgccgacacattgagcgtccgcgttttcgaaccgtaaccgtcctttctccaggggaaccaccatgaagatcgtcccgctcaccgcggccgtgctggcgctggtgctggcgccggccgcccatgcgcagccggccaacaaggccaccactgtttcgccgaccgccgccgccttcctggcgcagttcgccaccgagggcaacgacagcgtcagctgggcccagttcgaggccttccgcaagcagcgctacgccgacaccgaccgcaaccaggacggccacgtcgacgaacaggaatacgtcgacgaatacctgcagcgcttcgacgtgcggctggccgatgcacgcgccggccacctgcgccagaccgacacccgtttcaaggcactggaccgcgacggcaatggggcgatcagccgcgccgaatacgatgccgctggcgaacgcacctgggccggctacgagcggtcgcagaacgccacgcaggagactgctgcggcgtcctcgcgcgatccgctgaagatgccgacctcgcataccgccaacggcatgttggacctgtacgaccgcaacaaggatggcgcggtggatcgcgaggagttcgacgcggtgcgcgcagcgagcttcgccgccaccgacaccgacggcaacggcacgctgtcgttggccgagtacaccgccgaattcgaaggccgcctggaccagcagcgccagcgcgtgcgcgccgatgccgagcgccaggcacgcgtgcgcttcgcctcgctggacaaggacaccgatggccgcatgacgttcgccgagtaccagctctcgggcaagcgcatgttcgaccgtgccgacagcaatggcgatggcgtcgtcgacgcacgcgatcccgagccggtcgccggcgcgcactcggccaacggcaaccgctagcgccccggacgtgccgcgcacgtcccacgtatcagccaacgatgaatccggcgcgtggtttcccgcgcgcccttgcgcctcccagccccgctcgatccaccgatcgccgcagccaggaacggcccgccgccaccgcggcgttcacgccattcccttttcctcctgcggagtctgatcatgaagtcgtccctcaccctgctggccatggcggtcgccgccagcctgtccttcaccgtgcacgctgaaaccgctgccgacgccagcacgctcgataccgtgcgcgtgcaggccgagcgcgccaagaaaacacgctcggccaaccagaacgtcaccgtgctgaccgcggccgatctcgacaacgagatggccaacacgatggaagaagccatccgctacatccccggcgtcagcatcgtggacatgggccgcttcggcgacaacggcttcaacatccgcggcctggaaagcgaccgcgtggcgatcaccgtcgatggcctgagcctgggcgaatcggtggaaaccgcgcgttcctatgagttcttccgcggtggccgcggcgatgtggacatcgatacgctcaagagcctggccgtgatcaagggtgccgactcgatcagcgccggcagcggcgcgctcggtggcgcggtggtgttcaccaccaaggacccggccgattacctcaagcccgccggcaatgacacccacctgggcttcaaggcgggctactcgggtgccaacgacgaaaccatgggcacgctcaccttcgccaaccgcaccggcatcgtcgaatcgatgctggtctacacccgccgcgaaggccatgaatccgagtcgtggtatgacaccacgaacgaccgcatcggggtcggccgccgcacgccggacccggtcgacagcacgcgcgacaacctgctcggcaagctcgacctgcagctggacgaggccaacacgctgggcttcctttacgagcgcggccgcgccaccaacgacgtggacaacctgtcgcgtgtctatgcgccgggttatctgtcgcgcaaaggccatgacaccaacgaccgtgaccgctacggggtgaactaccagtggcgcgccgacaccgcgctgttcgatacgctggatgcgcaggtggaccgccaggtcactgacagccgtggcatcaccaccatcgtggccggcagcggctgtcccggcggcgccacgccgtgcctgcgcagcgagaaccgctcgaccaagcagaccctggaccgtgccgcggccgacttcagcaaggtgttcgccaccgcaggcgcgcgccatgatgtggtctacggcctggcctggcagcagcgcgacatcgatttcaccgccgtcgatacgcgctggaatgccgccggtgccatcgcgtcggtggaaatcgatccgcgccaggtacccaagaccgatgtgaccgcctggaacctgtacctgcgcgacagcgtgcagctgctggacgaacggctgaccctcagtgccggcgcacgctatgaccgctacgactattcgccgcaggtggatgccaccttcgtggatcgcaccggcaccgtgcgcgatgtgagcttcgcttcgccgagctggcaggccggcgccgaataccgcttcctgcccgaccatgcgctgtgggcccaagtgggccgcggcttccgtgcgccgaccgtggcggacatgtattcgccgaccagcgcgacgcaggtgatcaacgcgcagaacggccagccgctgctgctcaacgacaccgtgtccaatccggacctggactcggaaaagagcctgaatc

SEQ ID NO: 2683 - DNA, 1040 bp, Homo sapiens
gtaagtgcaattattgctaatacataaagatttagaataatcttatttaggaacactaaatgtattactagtttaattttaaaagttttgttacagtaatttaaaagtatattttagatagacaaaatgattaattgacctaattttaaaatgtttcaaattttgcagtgtagtgttattttttaactgagggcttctctctgagactagtcagtactattaaaaatttaagcagcacaaatccaactcaagcagtcaagcaaaaaattaaaagacagtggatatgttagattaagtaaatgggagtccaagatggactgatctcaggcatgcgtggatctagaaccctgatgatgatgtcaagggtcttcttctgctgtgtgggctggctctgtttccacctgccatggcttcattctcaagcaggcttctgttgtgtgcttatagcctcagggcaacgtcatcacggctcactgtctgaaaggaagatagactccttctcaccagttatatggtaaatttcagaggtgactctgtgttcctccttatgtcagtttttcatcccttaatgtatcacggtagccaggagtcagggggatggcaaacttgattgtctggatcctgggttatgtgctcatttcttgaaggaggtcactgtggttatgagttgtcggggagtagtggcttttaacatttttggcacatttcctttcagtcttatgtgtgtgtgtgtgtgtgtgtgtgtgtgtgtgtgtgtgtgtacatgtacgtctttgttctgtaacaaaccaagttgtcaaatgaaagccttgtgttgaaatcacattccttaggaaggaattagtctttgattgcttatataagtgagtcttcacaacttttttagtttatgttttcataaagatgcagtggaagccttttcttttttataagtaaaagtgtttttcatgtacataacctaatatttttaagtccttcacaaaaatgaagtaactctatgtggataacttcagtagtaaaaaaaaaaaaaaaaaactcga

SEQ ID NO: 2684 - DNA, 1018 bp, Homo sapiens
gcattgctggtaaggccttctaaggttctggtctcctgacaggtctctatctaatttctcctcaaagtcttctttactgtcttcaaaacttcctccacccccacccctcagcatccagacaaagggcaccacgttcctcttttattttgcagaacaatttagctttctttatctcactctttttgtttcaaatcctgcccattaggcctcatgttttacaaacaaaaagcaaaataaaataaaaggaaaatgcattaagacgtttttctgaaccaaagagcagctcactctccaagaataattctgcaactctcctggttgcagttagactccagctgcagccagctttgaaaacaagaatttctttcttcacttttcctttcctgtctctcccttccctccttctttcctaaaatatcttttgagtatcttctgtgtaccatggtctgagttatatgtatttgtggtttttttgttgtttgttcttttttttttcttcacatgcagcgtgtgccccagctatgcttgattcagttttgctgtgtgcagtagaaaactcattggctcagactccacacatttggaattcttaatattgcagactaagtttatccctcagactatattctgagaaagagcttacaaagcaatatttctgaagtcgtatgaggkcatgaaattgtgctaaactgggggtgcagacagctggattccaatgtagtaagctgtttgattttagaattttgctatctgagttttaaaattctttattagtcgaatgaagaatttggataaggtgatctctcaggacctatctggtcctaaaactttatgagagtgtaaaacatggtgacaaggggcatgtttgacatatttataagaacaaaaatgtttatgtcaatggatgtaagtaattacaagcttgggagagctagcacttaagactagctttctgaaataagacaggcaaatgagaataaataaaaaaagaacaaaaaaaaaaaaaaaaaaactcgag

SEQ ID NO: 2685 - DNA, 2763 bp, Homo sapiens
ggcacgaggaggaaggtaactctatggaagttcatagaagtcctcctcattcttttttacagctgcatgaaacttgtcatgtggttgtactgtaatttacttaatcactttgttatataatgacaagtacgcagtttccattattttgaaattacagccagtagagagtgactaatttgtgcctatgtattttcatattattggaggtgtactttcagtgtaaatacctagaagtgggattgctgggtcaaaggtatgaatggatagtaccaaataaaccaccctccaaaagcagtttgtgtcttcaccaacaacatgtaaatatgtctgttttccccacagcacctctaacagaatgactttgaaaagtttcatagtttttaatttttgccaatatattaggtgagaaatatatctcagaatagttttgtgtttctttaattataaatgagattgactatgttttcatatgtttactggtttactaatatacttattagtgagtagtatactcatatctttagctgacagacccttttcttctattaggtgcttgactttttgggttcaatttataagactttgttatattaggaatactagtctgttacctatgacctgtgttgcctatattttcttcctattttatttttttaccattcaaaagtttttagttaaaattatcaatttttaaaaattacatctagatctttgaatcacagttaaaagcttctccctacaaccaggatgtagagaaaccccttgtttcttaaaatacttgtctcatctttatttttttacatttaaattctcaatctatttggagtttattttagtgtatgttttgaaatgtggatttaatttcatccatccaaatgactagctatgtgcccccagccctattttaaaaagtttatccatctgctggtctgtttctgtttctgtattgctatcattcctttattgtagacgctttatgatatgttttaatgtctgatacttctcttcttcccctatcttagcttctctttttcattgttttagagaatatttcttcctgtttgttttttcataggaactttagtatcagtttatctagctccctaaaaaagcttcttggtattttttattggaactgcctttatcttaccaattatctcagggagaattgacatctttatgatactgattttaactctaggttttgcctatatttttcataagtttatttctaagcattttttaaagctgaaaatttgtttttaaaaatttgaaattaaacttttaattttgagatattaataattatagatttacatgcagttataagaaatacagatttagcatctgaaatctaaaaatccagaatttgtaatgttccaagatttgaaactttttgagctgtgatatgatgctcaaaagaaatgctaattggagcattttggactttggattttcagattaggggtgctcagttggtaagtacaatgcaaatattccaaggtagggaagaggatggtttgcagagcttccatgccctctctgggcatgcatgctctcctgatgatcctagacctcagtgtgttcaccaacctggaaactcattcaatcttattgtttaggagctttatagagttttatagagcttaatctccaggcctcacccgcttcctggaggttggtgtgtgtgcaaaagttccaactaattacttggtgatcttttgaccagccttatcctaaggctttgtgggtgtctcaccctaagtcacttcactaaattcaggtatgatcaaaaggaacttgctgtgaataacaaaagatgctgatatcactcaggaaactccaaggattttaggaactgtgtgtgaggaactgtaacaccctaatgggttccccttcccccactgcctagacagagctgatttatcaagacactggaattgcaatagagaaagagtaattcatgcagagccagctatgcttgagcccagagttttattactcaaatcagtctccccaagcatttggggatcagagatttttaggataatttggtgggtgggggaagtcagtgagtcaagagtgctgattagttgggtcagagatgaaatcatggggaattgaagctgtcctcttgcactgagtcagttcctgggccagggccacaagatcagatgacccagttaatctatctgggtggtgtcagctgatccatcaagtgcagggtctgcaaaatatctcaagcactgatcttaggaacagtttaaggagggtcagaatcttgtggcctccagctgcatgcctcctaaaccttaatttctaatcttgtggctaatttgttagtcttacaaagacagtctagtccccaggcaagaaggaggtttgttttgggaaaggaaagggctgttttcatgttttttaagctgtaaagtaagttcttctcaaagtcagttcagtctatgcccaggaatgaaaaaggacagcttggaggttagaagcaagatggtttgtttaggtcagatctctttcactgtcttagctgtaattttgcagtggcagtttcagaactttggacagagaccaagtatatttcttagaccacatttccttttcatgtgtgtagtgatattgttgcaaaactttctccttagttcagctaaaactgggctcttgtcacacgaatgggaaagattaggcttgcaggcacgtacaagggtgaggaaaacgtaatttattgggcgaaaaaaaaaaaaaaaaaaaaaa

SEQ ID NO: 2686 - DNA, 827 bp, Homo sapiens
ggcacgagcagattctcttgtttttagtaatctagtcccttcatctggtaacttacagggattttccattgagtttatatgttttcccaggatatttttggtatgtctctttttaaaaattatttgcatcttggactttggagaaccatttcaatgtaaagattcaaacctttcttttgcttagtaaagagttctatttctttaatcatcacttttctatgtgttactttttatattttgaagcccctgtccttggttggttttatctcacggatctgccatctaatttctttttaaatctcttcactttaatctatttctttgatatttgctctgtattactttccttccatttttctttcagaccgctgatttgatgctttgcagtaactctttttcaccttcattgagtgtttacctttgctcactttgtttttctttggtttctagtaaatccagcaagtaagggctctaattgtacttccttgggcatttatttaaaaaaaaaaaaaatgaaagtactttatgtctttcagtagtgttgcctcaggaaagaaaccatacttgttctgattattcacaagggctttcttttagcttcctcacctcttttaaatcagttctaagtttttttagggggacgagcagagctattggagttgcttggaaaatggcaatcatttagatggtaacagataccatagttgacagtgtactatgtcattagcaagcaaactggtaaaatctgggggaacattctggtgaggaatagaaggaagacctctagactcaggattgtactggcacaaaaaaaaaaaaaaaaaaaa

SEQ ID NO: 2687 - DNA, 1163 bp, Homo sapiens
ccgcaacgggcggggcggggccgggcaagtttgttccccgagttcggagcctaggagccccccgcggctgcggcgcaggtgccctcggcctgagtcgggatggagctgcctgctgtgaacctgaaggtgattctcctaggtcactggctgctgacaacctggggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtgagctcctggtccacactggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgcctgaaccaagaggccaggagcccccatgggccgcccagtaccatgcacactcctgtcccgaactccctgaggcctcccctcccttcagggcacccactggttcccaggctggaaccagggtctctctttacctcctaccccatggtggcaccacagaggccctcagccgagtcctgcctgagtgttgcaagctcaggcctttaaggactgctgatgccccctcaggcctcccccaagtttgctgggctttggtggaagccctgagagcttcaggtcctgctcagcccgaggagcagtctggcatgggagtgaggccccgtccttctcactgcctggtcacatggtgcctagggatgcagggctggaggccagaggtgtcagcaacactgtgacccaccacaacctccagcctcccttttcagagcacagcattaaagtttggggaattctgtagaaaaaa

SEQ ID NO: 2688 - DNA, 668 bp, Homo sapiens
ggcacgagccactgtatacccttgctctagctaaactagcagctccagctgtttcatatacatgcttctgcttttgcacatccatgtctttggtcatagtgtacctgcagcatggagtgcttcctgtgtccagatcttacctgtccttctgaggattagatcacagatacttatacatacaattttgtttgcagcctatacactagctttcctaaacttcttcctgtcacctaattatgctgtgttctgtcttgccattgtgcttttgcacacaagttcctttggtttagaatatccctccctctgtcttttctttcttaaagagacagggtctcagtgtgggctggtctcgaactcctgagctcaaatgatcctcccatctcggtctcccaaagagctgtgattacaggcgtaagctgctgcacctggtccttccttcctactttctgtaaaacttttacagcttcctcaggtcaattacatgctccttttcattatgctcccattgtccctttgcgtatttccacggaggcactcatcacattttattgttattgtttacatatctgtctgtcaaaaggctttgttttccaacagcagaagttactatactgcactccagcctgggcaacagagtgagactccgtcttaaaaaaaaaaaaaaaaaa

SEQ ID NO: 2689 - DNA, 2123 bp, Homo sapiens
ggcacgagtggaaactgatttgcctaggaatatacatgtgtgttttatagaaaataatgcacaaatacattcttattgtcaaagatttaaaccctacagaacccccacagtgtgttggtatcttccctccactttccccgattcatgcctctcttctttacccgcttccaccctgctctgggcccccttgccctctctcttcttgctgggtttgctgctgggagtctgcaggcgataggaaggacagaggagaaaggggtcagggtactaacttcccaagcccccccttacagagtcatgggccagctgcattcctctaccaaaggtttcagcttctgccagggggtgtgcccaagagctctttctctctgggtcaccacgcctctcttcctccctcccagcccaaggctagccatggtgcccaccgtttcttgtccagggtactgtccatcatgtttctctgtatcctgtctatgctttacaactggtccttcatcaaattctgcttaaatggcccaatttgatgtcttatctgtttactctccaccctgactgatctgtacctaattcggaccagaaaaagaaagtccgctgctcactcctgttctcattccctcacaagtaaacacggcgaacagcttagctcacccttctcaccctcctttccatgcctgtcatcaggtttcactgaggaacctggaactggatgcgactctgttctgggccatgcagcagggcatgagagtgtcataagttccctgttttcttgccttggccaaaacccagcttatcatgataagatagggaaggattgtcttgacagggctgtgaagaaagtaccgccatttgtggtgtccccaagtggctgattgtttccatttccacagactgtccgtcattttctgcctgtttcctcactctgacctgcaggagtggcccagctcgagctgctgtgtccaaactcacagggcccagggtgccacctgtcggatgcttcctgggcctcagccacgcctcactattcttggtcactttgccaaaacattgtcattcagtttatctgccttcttgactgttttccccaagatatcattaagagctctgagaatatttgcttgataacaaaaagagagtgaaaactagaagagaagaaaacccttctgatttatgccccataaagtagaagtacttcaagggtagaaacttttctattaagaaaaagagaagccttaaaatcatttttagtagatttatatttcatgctcattgcaaaatcctcagtatacctccatgtacaataaatatggcagaaagcaaaagttcccctaaaatcctatttcctaggataaaattccctattaagtatcaagtttgtcatttgagaacctttctaggtatatgtaaaatatgtctatgaaactttttacatacataggattgtactgtagtttctgttctataatctgctttcattagagagtggacaactttttgtgccaattcataaggatttacttgatccttttatcagccacataatattccataatacaaatgtatcatgctatcctatggaaagccatctgcttttttcctataacaacactgcagtgagtattcttgtacataggtttttcaatatttgcatcagtaaatttctaaaggtaatttcctgggataggaataggaatggaataggaatctccaagtcatagttgttacaaatgttttatggttatgaatttagacatttgagactttattttggaaaaaaaacatgaagaataacaaatttatatttccatcttcttttctcctgagtttctaactcatacctgtctgttcacattacgtcttaacttggttgcctactaaattctagtcgcatagatgaaactcatttatgccaaggcaccatggcacacacctgtaattccagcaccttggcctctcaaactgctgggattacaggcatgagccaccgcaccaggctcaaatgaacttctaaaatcactttgcctgggatatgagccggtggccgtgttagtgtttcaatgaagtgattttattttaggtcaatcttttgtacacactttatagtccataaaaaaaaaaaaaaaaaa

SEQ ID NO: 2690 - DNA, 2361 bp, Homo sapiens
  misc_feature (2361)..(2361): n equals a,t,g, or c
ggcacgaggctccctaagcggttgtcaccgctggagacggttgggagaaccgttgtggcgagcgctacacgaggcaaacgacttctcccttctttgaactggaccccgcgagcaccagagtcggcgtaactatcgcctgacaggcatttaaatcaaacggtattgagatggattgggttatgaaacataatggtccaaatgacgctatgatgggacagtacgacttcgtggactaccatttggttgcagcaaagaggaaatagttcagttctttcaagggttggaaatcgtgccaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagcacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataataaaaaaaaaaaaaaaaan

SEQ ID NO: 2691 - DNA, 1259 bp, Homo sapiens
aattcggcacgagctcgtggagagattgaagatggcggcttctcaggcggtggaggaaatgcggaccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaaggagatgaagaaggcacagagatagatactctacagtttcgtctccaggtcagatgcactcggaacccccatgctgctaaagattcctctgaccccaacgaactgtacgtgaaccacaaaggctgatctmtttccagagggcactatccgaccagtgcatgatgatatcctcatcgctcagctgcggcctggccaagaaattgacctgctcatgcactgtgtcaagggcattggcaaagatcatgccaagttttcaccagtggcaacagccagttacaggytcctgccagacatcaccctgcttgagcccgtggaaggggaggcagctgaggagttgagcaggtgyttctcamctggtgttattgaggtgcaggaagtccaaggtaaaaaggtggccagagttgccaacccccggctggataccttcagcagagaaatcttccggaatgagaagctaaagaaggttgtgaggcttgcccgggttcgagatcattatatcttctctgttgagtcaacgggggtgttgccaccagatgtgctggtgagtgaagccatcaaagtactgatggggaagtgccggcgcttcttggatgaactagatgcggttcagatggactgagcttggatgcttctgaggcaagctgaagctttgggttctgactgacccaccctacaggactgctgaacagagagcccagtgtgactagggatcctgagttttctgggacaattccagctttaatcaatacattttgttaaatgtgccataaaatgagactttttacgcctttataaggccttagatgtaaataaactcacccaaacaaaaaaaaaaaaaaaaaactcga

SEQ ID NO: 2692 - DNA, 845 bp, Homo sapiens
gattttacacagaacatattctctgcatgatttcagaaaagaaaatctaaaaaggtaatacgggtatttcaaataaaatcctttctggtatgaaaggctccattgattttattaagccttcctttaccttgtagtacaaggtgctttaatgggatagaactaagcatatcaatatctataactgcattttgtgctagacaattactgttcttttctctaaaatgtatatgtcaatttacaaggccagggatagaaaacactccataattgctttccttgattttgctgaggatttggtatgattttagtaagcaaactgttttttggtttttccttaatgtttttaattttttttcctcttgcaacaatgacggtgcatgttcttataaatataggaaggtccagatataaatagtaacctaaagttcttgctgtgcttaaaaaaaaaaatcatgtggccctttcaatatttgaactgctaagcaatgacatctgtagttttatctccttttttatgtcatagaaattaatatgatactttaaatatgtaaatataatacattaggtaatgctattatttatatctgtcttaacataatttaagttgtagctgtgtcttggaaatatttttaaggtaatctatattcacattgcctgtgttaatgctttttaaagtttgtatacatcagatgtatatttttggtttggcataagctacgattgtaatttttcttggctttttgttcataaagaattttttgaaggaatggtaacaaatggtaatttacaaatggttgtgaataaacacatttttacacttaaaggwaaaaaaaaaaaaaactcga

SEQ ID NO: 2693 - DNA, 1893 bp, Homo sapiens
tcgagtttttttttttttttttttttttktaatttaaacaaataccaaaagctttatttaagcaaaaacacattcaaccacagaacattcagaaagctaacaggatcatttctacattcattctgcaaacagtgtagtaagaaaggtaatttgagaatttccaaagatgttctcgctagccattatttatggtaattacataacattttgatgtcaagttattacagacttaaaagttaatatagcataattttacaatcgtactttcactatgatttttattttaaccctggatattattggtttgaagctaatattatcagtcctattggctgtcactgtcacagatctgaagatatgtttaaattcatcaagctaggaagatatcaaaatattaacaatcttcaagtatagtgagaaaaaaactgatttaagtgttagcatttctaaacttgagactctaacagtaaaaacaaagtaatctgaaacctgtttccatgggtaaaacactctgcctggtattcttgtacacaaaatttactaaatatgtgaatatcataaaatgaaaatatcactcccttcaatttctttggccttcacaaattcaatgtgactatgatccttttcaataatacttycaatgacattgtgcttctttagaaaaatcacttaagttgtagcatacaatagttaacattagttcttttattgctatggtatatgctaatttttttaaaaggggaaaaaaaaacccagagaacttattaaaatgtttgttaaagcaaacatttcagttggtttcctttctttgaagaataatagaaataaatgtcagaggagtattactaaggagccaaaacaaacaaacaaacaaaaaaacaaaaaactcctttattactcccatcctcagaactaactcaagacaagagatctgtattcaaaaagataaaacaatctcatctcagtaactacctcctatgaaacctaagagagaaaacctgtaatagctctcttaaccaacagccccatctgcacatcaccaagcaccagttccctttgggtagcagtaatgcttgtttttcatctttgcatattaaggactgttgttaacagatttatgggtcatttgtagcttactttgcaaatacctttcacttcttatgaaacacaatatgcccccaaacatggaccattattcaagtagacaaaatcactcactgacagcactttaacaacccgcctccactycatcttcccattctctcaccctatgccttccaatgaacctagtctttgctagtgatgagtccatctggggacaaatactgctttaaagatgatgtaattttcaatgccaaccacagtgactttcccataataggtattaataaacacttgttgacatagttataataagctaaaaatagttaacattaattttgctctttatcttttattcttatggcatagaatttattttaaaagactgaaaaactgattccaatgtaataatcacttactgggccacacgctagatgacagacatgcctccctgcctaaaaagggctcaaaggaactctcagttatacatgagtgaattaaaactttaaatgtactacaagaaagaactttttatatgaaggattctttatgtagagtatcttttttgaaaaatcagattttcttatcctatattacactggttttaattgggcatgctcactttagtggtgtgcctcattacaatgtctcttttgtgttaagaattaacttacaaaagcatttaaaaatcactacatcaaatgggatagagagtaagaagacaggagagagaggagaaaccatgttttttcggacgcgtgggtcgacccacgcgtccgcggacgcgtgggc

SEQ ID NO: 2694 - DNA, 1100 bp, Homo sapiens
ggcacgagcgcgcggcggggcggcgagaggaaacgcggcgccgggccgggcccggccctggagatggtccccggcgccgcgggctggtgttgtctcgtgctctggctccccgcgtgcgtcgcggcccacggcttccgtatccatgattatttgtactttcaagtgctgagtcctggggacattcgatacatcttcacagccacacctgccaaggactttggtggtatctttcacacaaggtatgagcagattcaccttgtccccgctgaacctccagaggcctgcggggaactcagcaacggtttcttcatccaggaccagattgctctggtggagagggggggctgctccttcctctccaagactcgggtggtccaggagcacggcgggcgggcggtgatcatctctgacaacgcagttgacaatgacagcttctacgtggagatgatccaggacagtacccagcgcacagctgacatccccgccctcttcctgctcggccgagacggctacatgatccgccgctctctggaacagcatgggctgccatgggccatcatttccatcccagtcaatgtcaccagcatccccacctttgagctgctgcaaccgccctggaccttctggtagaagagtttgtcccacattccagccataagtgactctgagctgggaaggggaaacccaggaattttgctacttggaatttggagatagcatctggggacaagtggagccaggtagaggaaaagggtttgggcgttgctaggctgaaagggaagccacaccactggccttcccttccccagggcccccaagggtgtctcatgctacaagaagaggcaagagacaggccccagggcttctggctagaacccgaaacaaaaggagctgaaggcaggtggcctgagagccatctgtgacctgtcacactcacctggctccagcctcccctacccagggtctctgcacagtgaccttcacagcagttgttggagtggtttaaagagctggtgtttggggactcaataaaccctcactgactttttagcaataaagcttctcatcagggttgaaaaaaaaaaaaaaaaaaaaaaaaa

SEQ ID NO: 2695 - DNA, 1762 bp, Homo sapiens
  misc_feature (447)..(447): n equals a,t,g, or c
ggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtgggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaakttcattgaaaacctcttgccatctgatggtgacttctggattgggctcaggaggcgtgaggagaaacaaagcaatagcacagnctgccaggacctttatgcttggactgatggcagcatatcacaatttaggaactggtatgtggatgagccgtcctgcggcagcgaggtctgcgtggtcatgtaccatcagccatcggcacccgctggcatcggaggcccctacatgttccagtggaatgatgaccggtgcaacatgaagaacaatttcatttgcaaatattctgatgagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaaagaaaacgggagcagccagaccctagcacaaagaagcaacacaccatctggccctctcctcaccagggaaacagcccggacctagaggtctacaatgtcataagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggagagtggatttgtgaccaatgacatttatgagttctccccagaccaaatggggaggagtaaggagtctggatgggtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatccagctcgaccttatgagaaggtaccttgcccaggtctggcacatagtagagtctcaataaatgtcacttggttggttgtatctaacttttaagggacagagctttacctggcagtgataaagatgggctgtggagcttggaaaaccacctctgttttccttgctctatacagcagcacatattatcatacagacagaaaatccagaatcttttcaaagcccacatatggtagcacaggytggcctgtgcatcggcaattctcatatctgtttttttcaaagaataaaatcaaataaagagcaggaaaaaaaaaaaaaaaaaaaaaaactcgag

SEQ ID NO: 2696 - DNA, 510 bp, Homo sapiens
gaactastggatcccccgggctgcaggaattcggcackaggctgcgctcggccaggccggcaccatgcggcccctgctctgcgcgctgaccggactggccctgctccgcgccgcgggctctttggccgctgccgaacccttcagccctccgcgaggagactcagctcagagcacagcgtgtgacagacacatggctgtgcaacgccgtctagatgtcatggaggagatggtagagaagaccgtggatcacctggggacagaggtgaaaggcctgctgggcctgctggaggagctggcctggaacctgcccccgggacccttcagccccgctcccgaccttctcggagatggcttctgagccctggagctggagcccagcagttggaggtggtgcacctgccagcagcgcccacagaaccagccctgtcctctcgacttccttccttagcttcatgtgaaataaaagctattctggtcaaaaaaaaaaaaaaaaaaaaaaaaaaaactcga

SEQ ID NO: 2697 - DNA, 2657 bp, Homo sapiens
ggcacgaggaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcagcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgaggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcatgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaagtggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatatccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcactcattatggaactctgggagaagggcagcaaaaagggactcctgccactcagcagctgaagtatcaacactagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagcacaagcctagagcctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaattaaaaaaatacaaaaaagaaaaaatgaaaataaaggaataagaagttacctactccaaaaaaaaaaaaaaaaaa

SEQ ID NO: 2698 - DNA, 928 bp, Homo sapiens
  misc_feature (916)..(917): n equals a,t,g, or c
aaaacaaaaggagacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgattttccaaaaaaaaaaaaaaaaaaaaaaaaaactcggggggggcccggaannaatttccccca

SEQ ID NO: 2699 - DNA, 1767 bp, Homo sapiens
  misc_feature (765)..(765): n equals a,t,g, or c
  misc_feature (1130)..(1130): n equals a,t,g, or c
  misc_feature (1545)..(1545): n equals a,t,g, or c
  misc_feature (1658)..(1658): n equals a,t,g, or c
  misc_feature (1744)..(1744): n equals a,t,g, or c
  misc_feature (1748)..(1748): n equals a,t,g, or c
ccgggtcgacccacgcgtccgattgaacggtttggggcatccttcctaggaaaagaatgtcagttaaggtggggtctcttctggttttggtgtattttaccctgggcccagttgttgcagaactggaggtgaccctgccttctcattcctaacatttttctctactaccacccggattttgaggcagacccccaactcgtcatggctccagctgaagtttgaaatataacgtcccggacttctagcctgtaggagctgcagatgtagtggggcagacatggggagggtcagtggtgagcctatagaaacatctctttccgcaggaaaagataaaggatgtgatgtgtgtagctcacctccaggctgaaatgcagactttcctcatcttccacagtaagcaggattcccttctgataaccttgtcagaaatgttgtttttcaaagggcatgtatggtatctgtcactttcagtgatgattgtgtcgtcagttgatgtctcttgacctgaactgagtatgcctgtggaaggtcctcttagccccctcacagaaataggagggggtgtcctcgggctgtagctgtgcttcctctgaaggtcactggggaaaagggataccaagggccgttgtccagcttattatcccagctgctgcacaaagtgtccaggaactggtccttagagcttttgagttttatcagatcagtttgttccttgggttggccatcaagatgggtctcaatataaatgaaggaatctgaatagantccagttttatgtgtttctagagaaaatgctcaagtgttcttatgcaagtcatgttagatttatatgatgtgtgaaatctgcttacaaggaaattttcatgatttgtgttagattagcatttaattgtctgctttaacagatacttaatttatttcaaaaataaggaaaaatagaggaatcggtgtgaatgttttaagactgagagatgatgatcctttacttttcctgtaaagaagataatttttaaatctttcatatcctgtagagaaaaccaacttttcctctgtgatatagtacattatgtttgcactactataatgtcaagactgaaagtataaaaaatgtacatataagattaattttnatatctttttttttaaaggggtttgaggtgcctgcctggctcattcagtaaaacatacaactctcgatcttgggatcatgagttcaagccccacgttaggggtagagtttactttaaaaataaataaaaggggttgagtctattgcactaagctctacatgactaatttaaagtggagagatgttgtgctagatttaaaaaaaataactagttttcttaatgtgtctttgtatgatcaacagcatgccataagcaatacaaaacaccaagccttatacttacaagaaaaaaggttaacatactggtaaagttctaaacatatcaaatgtacataagtgacaaaggtaggattttaaggaaatgtcagtatatagagaagctcagtactgcattaaggaacttcttcagaactagngaagtattcctgtgtttgaggagaaaacttaggggtttgagaagttatatttttctatttaaaagggttaaattattgcataatttggaaaaggttgctttgaatgtaggacnaaactgtttcaaagatttttgtttgaaaagtttatgtatttttgtgccttaatatttgttctgacttttaataaaatgctttctgnaaanaaaaaaaaaaaaaaaaaaa

SEQ ID NO: 2700 - DNA, 595 bp, Homo sapiens
ccacgcgtccggaatgtgtgtgtgcggtgttatgccggacaagagggaggcgaccgcggcggcggtggctctgtttattgtccctctcggtgtgtggatgcgaggaagtcgggggtatagcgctgctcacgaaggcagcctttgaggcagcggcccggcgttagctgcgactccggcaaccccagcggccggccttcgcggagtgtgaggaaggacaaggcgcctttgcgtccccgccacgtctggacgccccgagctttccggctgcgctcgccgcgcgcacctccgggccccggcccggcttgccgtgccgccggcgggcgggcgagaaggaagcaccgcgcctcaccgctgccggcctcctgcttccttctccacctcttcctcagcgacgggcctaggcccgggcgactcggccgccgcgcctcgagtttgagggcgccgagcggcgcggcctcctcggcgggctcggccgtccgtccgtcccgggtctcagcgatggggcgcggggggcgacgccgctaggagcacggcgagcggagcggtcggtgcggagcagaggggcccggcggccggcaggaaggcgggagcggcc

SEQ ID NO: 2701 - DNA, 1593 bp, Homo sapiens
ccacgcgtccgctcgcgagtggcgggcatgagagtaaactgcggaaggtcgccagcgggttctagtcattgttggagttgttctcttgtgccgcagggcttcgacgagattggcgcccggtcgcttacttggcgggtgcaatggcgcttttccgatgcgtgtggagcgtgctgagtgccctgggaaagtccggatcggacctctgcgcgggctgtggaagtcgactgcgctctcctttcagttttgcgtatgtaccgagatgtttttcatccaccgcgaatagttacccaaagaagcctctgacttcatatgttcggttttctaaagaacagctacccatatttaaagctcagaacccagatgcaaaaaattcagaactaattagaaaaatcgcccaactatggagggaacttcctgattcagagaaaaaaatatatgaagatgcttacagggcagactggcaggcatacaaagaagagataaacagaattcaagaacagttaactccaagtcagattgtatctttggaaaaagaaatccagcaaaaacgtttaaaaaagaaagcattaataaaaaaaagagagttaacaatgcttggaaaaccgaaaagacctcgctcagcttataacatttttatagctgaaaggttccaggaaactaaggatggtacatcacaggtaaagctgaagactataaatgaaaactggaaaaatctgtctagttctcaaaagcaagtatatattcagcttgctaatgatgataaaattcgttattataatgaaatgaaatcttgggaagaacagatgatggaagttggacgaaaggatcttctacgtcgcacagtaaagcaccaacgaaaagtcgaccctgaggagtattgaaatagaagattgagttatgttcataatggatagacacaagaaaccaattaggtctcaatacctgaagctattgaaaattagaaaggataaagttggtgaacattttatatttaattccttttttctttagcccatggacttttctgccagttcaatacattttgtattagtatcttgctttggaaaacccaaagagataaaaagttcatgcgaaatttattttgtgttaaggaactactgaggatccaaataatccatgaaatgcagcagtgaatcattttacctttgataaaggtaaatcagactgtgaagtttttttatacttgatgactggaaggagtatttttgtttccttatatatatatggagtcaggagtttcatatgcaaaagtgtcccaaattgtagaagtcatagtgtcctctgatataattgtacattttagaaaagcgcccataattcatctaagtaaattccacttcctaggtgtaattcacatattcagagttgatggttgtacatacaaggaattgctgatttcaattgcagttttttataaaaaggatggagagatttataaaccttttcctcattgcctttttcccagagtaaaaacagagaaattatgtaccaaatctatgcatattgttttatactgcatagaataaagattttaaatgtttcctaaaaaaaaaaaaaaaaaaaaaaaaaaaa

SEQ ID NO: 2702 - DNA, 1200 bp, Homo sapiens
acgcgtccggtgcagtcttctgcttcggctcccactggcgctcctcccagctgctgttgtagcgccccgtcttcagtcctgtggctctgccctgcgttcttctgctccctgatcctgcatgcaaaatgggacctttcgccccaacgctgctgatgctgctgcccccactgctgatgctggtcctgtacggctgctggcaagcaagaggctgggccggacatcagtatgagcatcaccgcggacctggggaacagagtgcagcatatttccaggctatgagattcaatgccaacatgtctttccacgcccaaatggttatcaatgaaggtgaggctttccgtgaagggcaaaggaccatcccggctgtggagaggccggggaatgctctgaggcagagatcatgaaggtgacatttccccgtatggataccaacaccgtgggcacctctcgcctttcttgagatcgacggcttaaattggttttgaataccacggtgatactataaattaccctttgtcctgctcagttattgatttagcccttttctgtgctctcgtcacctcagagaataggactaccttgtcccagcactgtggaagccgtgaagcccactccttctcagctctgggttttgacttctccacagcttcacctgccagaccaaggctttctgcttcccatcgcccttggtgctattttcctccaattcctgtgtcctcctttctctttttgtgcctccatcactcccttaacccttctccatcttggaattgctttccttccctttggagtcccagatccctaccccttctccttagttcaggataacataaatacatccttttgccttgtcggggaccgcctctggcctggaaaatccccgccattacaagatggcgcttggctcactgccagcaaaataccctgcaagtaaacaacgaatgttctggtgaagcctgcctaaaggaggacatagtcattggctgtttcaaatttaatcagcatagtaacaggactctcattggctctccccattgtttggccccttattggtcaccctgctcgctgattggtcatgtaaacgtatataagtgtgtagacttgcggaaataaagagagagaagatacatctgaaaaaaaaaaaaaaaaaaaaaaaaaaaaaaaaaaaaaaaaaaaaaaaaaaaaaaaaaaaaaaaaaaa

SEQ ID NO: 2703 - DNA, 3665 bp, Homo sapiens
ccacgcgtccggaaggaggagctgcagggactggagtatctcaggccctctcagtgggtggggcccggagcaggggtacctgggaaacaggcctccctctggaattcggagcagagctgctgtctaagtcacggacctctggaatctataagacagaggactgcaaaggggtgcaacactccaaaaggacagcttaggacacgcaccatgtggtgggccctgctggccctgccgtttctgctgcccacggcgctgcgcctctgcttggcagggcctcccccggagaggggccctcttttctggctgactcggcaggactctcgggaaagcggggccgccaacgccacggtctcgccctgcgaggggctgccctctgcgggagcgtcgaccttgaccctggcgaaccgcagcctggagcgcctgcccaactgcctgccgcccgcgctgcgtagcctagacgccagccacaacctgctgcgcgccctgagcgctccagagctcggcgccctgccgcggctgcaggcgctgacgctgcgccacaaccgcatcgccgagctgcgctggggccccggagggccggcggcgctgcacacgctggacctcagctacaaccagctggccacgctgccgccatgcgccgggcccgcgctgcccggcctccgctcgctggcgctcgccgggaacccgctgcaggcgctgcagcccggggccttcgcctgcctcccggcgctgcgcctcctcaacctctccggcaccgcgctgggccgcgacctgggagcgggcatcgccgacggggccttcgcgggagcgggcggcgcgctcgaggtcctggacctcagcggcacgttcctggagcgcgttcggtcagggtggatcagagacctgccgaaactcacctctctccacctgaggaagatgcccaggctgcggatcctggaggcggccgttttcaagatgacccccaacctgcagcagctggattgtcaggactcgtccgccctgacttctgtccacacacagctcttccaagacactcctcgcctacaggtccttctattccagaactgcaacttgagttctttccctccgtggagcctgcattcctcccaagtcctgtccatcagcctctttggcaaccccctcatttgcagctgtgaattgtcctggctcctcagggatgcaaagaggactgtcctaagcagggcagcagacactgtgtgtgtaccggcttcaggatcccgagacaccttctcagcccctctttcgctgtcccagctgcccactgtgtgtcatctggaccaaagcaccaccctccattccagctcgccccaggctgttcccttcacccaccaaccatcaacacagggtctcaccaccccatggagcacagccccttccactcgacctgtggaagctgaacagagtgtcaccaagcccctctccttccccacggattccgccacacaaaccgcatggtcccacagtggcatcaaagtggggaccgcccgctccacagccatccccacagcagattctagcacctccagcgctccgcgcagggctgcaaacacagctggggcagagcaccaagagcacgctcccatgctggtccatgcgcctcacgtgtcagctgcttccaccccctcggccagcaaacaccctgggctcttccctaccccgtggagccaggtgcggacgccccagcccgactacagggcacaggccaccctgcaggcgcctcacccaagtccttctgagggcgcaattccagtcttgctgttggacgaatctagtgaggaggaggaggaggggcagaaggaggaggtgggagcacctccccaggatgttccctgtgattaccacccctgcaagcacctgcagacgccgtgcgcggagctgcaaaggcgctcccggtgtcgatgccccgggctcagcggggaggacagcctcccggacccccccaggctgcaggcagtgacggagaccaccgacacgtcggccctcgtgcgctggtgcgcccccaactcggtggtgcatggctaccagatccactactctcctgagggctgggcggaaaaccagtcggtgacggtggtggcggacatctatgccaccgcccggcagcaccccctgtatgggctctcaccgggcaccatgtaccgcgtgtgcgtcctggccgccaaccgcgcgggcctgagccagcctgtccaggcctcgggctggacgcgggcgtgcgccgccttcaccaccaagcccagctttgtgctggtcttcgcggggttgtgcgctgcctgcggcctcctgctcgtcaccaccctgctgctggcagcatgtctgtgtcgccgcagcagaacggtgcgcctgcagcgctacaacacgcacctggtggcctacaaaaacccagccttcgactacccgctgaagctccagacgctcagttagctctgcgccccctcctccactggagcttaagaactagccgcccatgtttagaaaagaagagacagagggtcaaagaggaccctgtcagctcagaatgcctctgtgaatttctgggaagccagcactctcgcagcacaaagggaacttgccatgcagtttctctgtccggggaaccactgctttccctgccaccttctctgtgcccagaaacgttacaattcacaccagaccactcccgttgtcacagcgcagccttgtgtgttgtgtttttcagcagtcagtgctccttggtgtccagttgaatagattgggtgtgtaagtaggaagagataaaacagttcacacaagtcagtctcttttgccattctggaagtgacatcctcaagtcatttcagggacgttccctctggtcaagcttctggctaaagcaggtggtattcaaggaatcaactcctgtggattcttaatctgagaactggggtaagggagaactactggttatgtttcctgaggctgcctggggtttattgcgtctcttggcaaaaaaaatgtgcttttagctttgtagttaaaactgcagtcttctgggaacctctgtgaaacacaaggacaagctgtcctttttaaagtcattgtctactggacttctccatagtgtaagtggtcaaagaaactacgaactccttttcttaaaaaagcgcaataggatcacttccgggatttggtcttttaagagaagagatgaacaaaaaagaacgtcaaggctctagctagaagccaaagccatttgctctccattgcatcaaacagtgccttcatgatttgtatctgagtgtgggcaaggcctttcaacatcccttttcacttgtataccaatgtcaaaaaagcattttttataaaattacatgtgtgtcattacttctagattttaattttctaaatagtatttcacttttctgtgactactggaacaattaccacaaaccaggtgggttaaaacaacagaaatcttttcttacagttcaggccagaaaaccacaaccaaggtatcagcaggagtggtttcttctggagactcagaactgttccctgcctgttctggttgctggctgtcctgggtgctccttggtttgcaaataaatccgatcgatgccttcattttcttaaaaaaaaaaaaaaaaaaaaaaaaaaaaaaaaaaaaaaaaaaaaaaaaaaaaaaaaaa

SEQ ID NO: 2704 - DNA, 984 bp, Homo sapiens
  misc_feature (232)..(232): n equals a,t,g, or c
  misc_feature (332)..(333): n equals a,t,g, or c
  misc_feature (929)..(929): n equals a,t,g, or c
  misc_feature (943)..(943): n equals a,t,g, or c
tcgacccacgcgtccgcgcgtccgtcggtcggtgcgtccgggccgccggcttcgmcctcgccatggcaccctggctgccgctgctgtckctgctggggctgctcctgggcrccgctcccgccccgccccgccgagcagccgacgctcaggcccgggaggcggcgtacccggagctgctggggcccgcccgcttcgcgctggagatgtacaaccgcggccgggcagccgggangcgggcgacgctgggggccgtgcgcggtcgcgtccgccgggcgggcgaggggtcgctgtactccctgagggcgaccctggaggagcctccctgcaacgannccacggtgtgccagctccctgtgtcyaagagaccytgctctgcagctttgaagtcttggacgagctaggaaaacacatgctactgaggcgggactgcggcccagtggataccaaggtcacagatgacaaaaacgagacattgagttcagtccttccactgttgaacaaggaacccctgccccaggacttttctgtgaaaatggcctcaatcttcaaggagttcgttaccacctataatcggacgtatgagtcgaaggaggaaacccagtggcgcatgtctgtcttttccaacaacatgatgcgagcacagaagatccaggcactggaccgtggcacagctcagtatggggtcaccaagttcagtgaccttacagaggaggarttccataccatctacctgaatcccctcctaagagagtaccatggcaagaacatgcgcctagacaagtctgctggcgactctgccccatccgartgggactggargaraaagggggscgtcaccaaagtcaagaaccaggcatgtktggctcctgctgggctttctcartcactggtaacgtggagggccagtggttcctgaaacaggggcctgntctscctctccgancargarctcttggactgtgacaaggtggacaaggctgcctg

SEQ ID NO: 2705 - DNA, 1462 bp, Homo sapiens
  misc_feature (7)..(7): n equals a,t,g, or c
ttttganatgaattcctttgggaatttcgtgacactatagaaggtacgcctgcaggtaccggtccggaattcccgggtcgacccacgcgtccggccggactaaccagctcctccaggcgctgggggcgggtgtggcaggaggaagcccgatcagccccaggctgtggatgtgggagaagggcgagctcagggggccatcatggggttcccccagaggcaacctggcctatcagggctgctcctcctcgtgtgggcactggcctggcccctgccttgtatgagcttggagctgatcccctacacaccacagataacagcttgggacctagaagggaaggtcacagccaccacgttctccctggagcagcctcgctgtgtcctggacgggcttgccggcgttgccagcaccatctggctggtggtggccttcagcaacgcctccagagacttccagaacccacagacgcgagctgagatcccagccttcccacggctgctgacggaggggcactatatgacactgcccctgtccctggaccagctgccctgtcaggaccccgcaggcggcggcagggacgtccccttgctgcgggtgggcaatgaccccggctgccttgctgacctcctccagccgccctactgcaacagccccctccccagccccggaccttacagggtgaagttcctcctgatggacgccaggggctcaccccaggccgagaccaggtggtccgaccccatcgctcttcaccaagggaagtcgccagcctccatcgacacgtggccagggcgacgcagtggtggtatgatcgtcatcacctctatcctctcctccctggccagccycctgctcctggccttcctggcagcgtccaccscacgcttctccagcctgtggtggccggaggargccccggagcagctgagaattggctccttcatggggaagcgctacatgacccaccacatcccacccagcgaagccgccaccctgcccgtggrctgtgagcctggcctggaccccctccccagcctcagcccctagcctggcccttgtggctggggcgtgtgtggctgtggccagtgtgggggcaaggacgtggtagttattcccagcccctgcaccctcctcctcacccctgcccacagtcccactgatgtaggacagatgtcagggttctagacgtctttggtgcaaaaagggggttttattcaagcacagggacaggacccatgggcagggagagcggcaccggggtggtgaggagtggcccgttatatatactttcgagttgggagggcttagagagagcgtaagtctctaaggaattttggaagcaaggtctccagggtcctgagggggctagctgttgttaggaaaaggtcatttattactgtttagtaaaaactttcacgagaaaaaaaaaaaaaaaaaaaaaaaaaaaaaaaaaaaagggcggcc

SEQ ID NO: 2706 - DNA, 760 bp, Homo sapiens
  misc_feature (438)..(438): n equals a,t,g, or c
  misc_feature (741)..(741): n equals a,t,g, or c
gggtcgacccacgcgtccgctgaccagtccgttatagatacttcttcctataccaaaactgtttaaacaggtgccaccacaagggatgtcgtccttactctctgcgggtcttcaagcatccctttgtgggaaargtctctgggcaagcacgtggtatttggtctgctgcttgcttccctttttccaccagggatgttgtgatcataagtcaaaacaacagtatattccaaatctcaaaagctattgtggcctgagcacaattgaaatctagcagagtttttcctatgtagctttagagtaactcttctgcttctctgtcacttacaattcaggttctgcctttgcctaagagcatgagcagaagagtcctcatgtgacgcttagttctattgcagtcctgggtgaaactatttaagcwatggggctgctkctccccanwtcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgacaataaaaaaaaaaaaaaaaaaaaaaaaaaaaaaaaaaaaaaaaaanaaaaaaaaaaaaaaaaaaa

SEQ ID NO: 2707 - DNA, 706 bp, Homo sapiens
acgcgtccggtctttgccatttgggggatgtttgctgtgtgccaggctctgtactaggatctgtctaaacttctctcgtgtagttcttaaatgagggagttgaggcccattgaaaggtctgtggttccaacttgaattttaatgcctttttgtgggctacacatggcttcacctagcatcattcttctgttaatcttcttcttctttttttttttttcagtatgttcagttagccagtatatgtttgaaaatgagtgtgagagcatgagcaggaggaggggcagagggttggggagaagcagactcaaagttgagcaggggccagatgcagacctccatcccaggaccctgggatcatgacctgagccgaaggtagatggttgactgactgagccacccaggcgccccctctcttgttaatctttgatttccatcagaaaatgacctgaaacagtacttttataaaattaaagtgagggatgcctgggtggctcagtcggttaagcgtctcccttcagctcaggtcatgatctagagtccgaggatcaagcccaagttccactgtcaggctctgtgctcagcggagagtctgcttcccttctgccactcaacctgctggtgtgcatgctctctctctttctctcaaataaataaataaataagtaaaaaaaaaaaaaaaaaaaaaaaaaaaaaaaaaaaaaaaaaa

SEQ ID NO: 2708 - DNA, 1934 bp, Homo sapiens
ccacgcgtccggaagaggaggatgaggatgaagatgaggaagaggaagtggcagcttggaggctgccccccagatggggtcagctgggagcttcccagcggcctcgtcctccccgccctactcatcgaaaaacctgctcccagcgccgccgccgagccatgagagccttccggatgctgctgtactcgaaaagcacctcgctaacattccactggaagttttggcggcgccaccggggccggcggcggagctcgcacaccccaagaaccatctttcaccccaggaagggggtgcgacaccgcaggtgccatccccctgctgtcgttttgactccccacgggggccacctccaccccggctgggtctgctaggtgctctcatggctgaggatgggatgagagggtctccaccgatgtcctctgggcccccagtggaggaagatggattacggtggactccaaagtctcctctggaccctgactctggcctcctctcctgtactcttcccaatggctttgggggaccccccgggccagaaggggagcggggtctggcaccccctgatgccagcatcctcatcagcaatgtgtgcagcatcggggaccatgtggcccaggagctatttcagggctcagatctgggcaccgcagaagaggcagagcggcccggggagaaagccggccagcacagccccctgcgggaggagcatgtgacctgcgtgcagagcatcttggatgaattccttcaaacttatggcagcctcatccccctcagcacggacgaggtagtagagaaattagaggacattttccagcaggagttctctacaccttccaggaagggcctggtgctgcagctgatccagtcgtaccagcggatgccaggcaacgccatggtgaggggcttccgggtggcctacaagcggcacgtgctgaccatggatgacctgggcaccttatatggacagaactggctcaacgaccaggtgatgaacatgtacggagacctggtcatggacacggtcccggagaaggtgcatttcttcaacagtttcttctacgataagctccgtaccaagggttacgatggagtgaaaaggtggaccaaaaacgtggacatcttcaataaggagctcctgctaatccccatccacctggaggtgcactggtccctcatctctgttgacgtgaggcggcgcaccatcacgtatttcgactcgcagcgcaccctaaaccgccgctgccctaagcatattgccaagtatctacaggcagaggcagtgaagaaagaccggctggatttccaccagggctggaaaggttatttcaaaatgaatgtggccaggcagaataatgacagtgactgcggtgcctttgtgttacagtactgcaagcacctggccctgtctcagccattcagcttcacccagcaggacatgcccaaacttcgccggcagatctacaaggagctgtgtcactgcaaactcactgtgtgagcgtcgtatcccaggcctcaagcccattggtcaatgggcatggggacgtgggggacccttccttcccgagaaactccagttcctctcttgcctctccccctcccagttccctatggtttttcatatttaaatgttttaattgatttctgtatttttttttctttgagagaatacttgttgatttttgatgttcagggggtggccatggaacagcctcttctccctctgctagggaggagtttggccttgtggcctgggtggggcggtcatcccccttcccgtgtgcaggggcgggggcaggaacatctgtgctggggtggtgggcgggcaaagggagtgtgcctgccagatattcaaactttgttttatacgtatatataaacgccacggtcctgctctgctcaataaaggatcctttggaaaaaaaaaaaaaaaaaaa

SEQ ID NO: 2709 - DNA, 2815 bp, Homo sapiens
gggtcctggagtgccctcggctgatagagactatagttcgagagttcttgcccaccagttggtctcctgtgggggcagggcctacccctagtctatacaaagtaccctgtgctactgccatgaaactacttcgtgtcctggcctcagctgggaggaatattgctgcccggctgttgagcagctttgatctccggagccgcctgtgccgcatcatagctgaggctccccaagaactggccttgcccccagaggaagctgagatgctgagcaccgaggccctccgtctgtgggctgtggctgcctcctatggccagggcggttacctttacagggagctctacccagtgctgatgcgggccttgcaggtggtgccgcgggagctcagcacccacccacctcaacccctgtccatgcagcggatagcctcactgctcactctcctcacccagctaaccctggcagccggcagtacccctgctgaaaccatcagtgattctgctgaggccagcctctcggccaccccttccttagtcacttggacacaggtgtctgggctccagcctcttgttgagccgtgtctaaggcagaccttgaagttgctgtccagacctgagatgtggagagccgtgggcccagtgcccgttgcctgcctgttgttcctgggagcctactaccaggcctggagccagcaaccaagctcatgcccggaggattggctccaggacatggagcgcctgtcagagagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccggaaagaacatcagggggtccagaggcagccgacttctctgaccagctgtcgttaggaagcagcagagtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgcactgattcgcctctacaccgggcttcagacaccccctcgggactctctccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccagttgcctgtgtccctggagtgttacacagtgcctcctgaagacaacctggccctccttcagctctacttccggaccctggttactggtgcgctccgcccacgttggtgccccgtgctatatgctgtggctgtggctcatgtcaatagcttcatcttctctcaggacccacagagctcagatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactgacttcaacagtgctccaaaatggggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtgctgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcctggaaaaaaaaaaaaaaaaaa

SEQ ID NO: 2710 - DNA, 1985 bp, Homo sapiens
  misc_feature (332)..(332): n equals a,t,g, or c
agccctgctgaagtacaggttcttctatcagtttctgttgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattctyctcaaagccatcgctccgcagcaggaacaccattttcaccctaggaacccgcggctctgtcatctcccccactgaacttgaggcccccatcctggtgcctcacacagcgcagcggnagagcagaggtatccatttgaggccctcttccgcagccagcactacgscctcctagacaattcctgccgcgaataccttttcatctgtgaattttttgttgtgtctggcccagytgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactggggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgaaaaaaaaaaaaaaaaaaaaaaaaaaaaaaaaa

SEQ ID NO: 2711 - DNA, 772 bp, Homo sapiens
  misc_feature (694)..(694): n equals a,t,g, or c
  misc_feature (754)..(754): n equals a,t,g, or c
  misc_feature (759)..(759): n equals a,t,g, or c
  misc_feature (769)..(770): n equals a,t,g, or c
gggccgggcgggcgcagtcgggagccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttgcggatttgctgaaaacctaccggagtcggggaacgcgcaagcagcggccatctgtgaatatcccagacgcatcccgggacgctnagtggcaaccatcaccccggaagaacttaactggtgaaaggccccggatcaccttccagncccangaagcaaatnnga

SEQ ID NO: 2712 - DNA, 3433 bp, Homo sapiens
aattcccgggtcgacccacgcgtccggacccgggtggctgcgcccctgcctcgcttcccaggcgccggcggctgcagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgactgggctggccatccagtatgccctgaacatcgcattctcagaagcagagggggcccggcccctgagggagaatgtgccacgggtcataatgatcgtgacggatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccacatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagatgaaaaaacgtgcacaaagatagactactgtgcctcatctaatcatggatgtcagcatgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgacgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaggccatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtagaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtattggactttaccttgatatatgtatatggatgtatgcataaaatcataggacatatgtaaaaaaaaaaaaaaa

SEQ ID NO: 2713 - DNA, 3258 bp, Homo sapiens
gcggccgcgtcgacgctggccgctgtgtagggctggtgagtggctggggctgtctgagccatgaacaacttcagggccaccatcctcttctgggcagcggcagcatgggctaaatcaggcaagccttcgggagagatggacgaagttggagttcaaaaatgcaagaatgccttgaaactacctgtcctggaagtcctacctggagggggctgggacaatctgcggaatgtggacatgggacgagttatggaattgacttactccaactgcaggacaacagaggatggacagtatatcatccctgatgaaatcttcaccattccccagaaacagagcaacctggagatgaactcagaaatcctggaatcctgggcaaattaccagagtagcacctcctactccatcaacacagaactctctcttttttccaaagtcaatggcaagttttccactgagttccagaggatgaagaccctccaagtgaaggaccaagctataactacccgagttcaggtaagaaacctcgtctacacagtcaaaatcaacccaactttagagctaagctcaggttttaggaaggaactccttgacatctctgaccgtctagagaacaaccagacgaggatggccacctacctggcagaactcctggtgctcaactatggcacccacgtcaccaccagtgtcgacgctggggctgctcttattcaggaggaccacctcagggcctccttcctccaagacagccagagcagtcgtagtgccgtgaccgcctctgctggacttgcctttcaaaacaccgtgaacttcaaatttgaggaaaactatacctcgcagaatgtcctcaccaagagctacctctcaaaccgaaccaactccagggtgcagagcattggaggggttcctttttacccaggcatcaccctccaggcctggcagcagggtatcaccaaccacctggtggccatcgaccgctctggcctgccgctgcatttcttcatcaaccccaacatgctacctgacttgccaggccccctggtgaagaaggtgtcaaagacagtggaaactgctgtgaagcgctattatacattcaacacctaccctggctgcacagatctcaattctcccaacttcaattttcaggccaacacggatgatggctcctgcgaggggaaaatgaccaacttctctttcggtggggtttatcaggaatgcactcagctctcagggaatagggatgtcctcctctgccaaaagttggagcagaagaatccactcactggtgatttctcctgcccctctggctactccccggtgcacctgttatcccagatccacgaggagggttacaaccacctggagtgtcatcgaaagtgcactctcctcgtcttctgcaagaccgtgtgtgaagatgtgttccaggtggcaaaagctgaatttagggctttttggtgtgtggccagcagccaagtacctgaaaactcaggactgctttttgggggcctcttcagcagcaagagcataaaccccatgacaaatgcacagtcatgcccagccggctactttccactgagactctttgaaaacctcaaggtatgtgtttctcaggactatgagttgggaagcaggtttgcggtcccctttggcgggttctttagctgcacagttgggaaccccctggtagatcctgctatatccagagatttaggggcaccgtctctgaaaaagtgccccgggggcttcagccagcacccagccctcatcagcgatggatgccaagtgtcctattgcgtcaaatccgggctcttcacaggagggtccctgccccctgccaggctcccacctttcacccggccacccctcatgagtcaggctgccaccaatactgtcatagtgaccaattctgagaatgcgagatcctggattaaagactcccagacccaccagtggaggctgggagaaccgatagagctgcggagggccatgaatgtcatccatggggatggtggtggtctgtcaggaggggctgcagctggggtcacagtgggggtcaccaccattctggctgttgttatcaccttggccatctacggcacccggaagttcaagaagaaagcatatcaggcaattgaggaaaggcagagtttggttccaggcactgcagcaactggagacaccacttaccaagagcaggggcagagtccagcttaaatctctccccgaaaatggtttctctcatctccagtgtggtcattgctgaccactctgttttcctaagcattgaaatggcaagtgcaaccaaaagtaggtatattcgtgacttcttgtttaggtctctgggccaggaaattcatactgttacatggataaggttgggattggggagagggaacagttgggactagaagcaaaagtgattctgggactaaaataggaagcagatgtcctttcccaatgtgtgttgctgtcttcacctgaatgcatttgtgtaaaaatagcggagggacaatgtgaacatttgtatttggaagctatgaatttactctgaagtttgcagttgtttccaatttgtgagctctaagagtttctgcctgtaagaactactctccttttattttgatttttaaaaaactgtctgaatttcacactcttagagcctggaagagccctgaaaagacacaagtcttgcctggctactgctttttaactttgagggctctatgttgacagactgttatctcctctgggtgacctcaaacatctgaaaagaaagatgttgcctgtgccaattccactttttccagctgccccttgatgaacactcccttataccagaccactcttggacttctgactggtgtcatcaagtcctcagaaaatattttaagttattttaagttattaaggaagggatgatttggagacaaggagtaatgaaagatgggtaaaaactggaaaagattctggtgctaagtactaccccttcatcttccatggatggtcattacctttcctgtcctcctgttctatgaacacacacacacacacaccccccccacatttcaataagtcttcattgttctgggtccttacctttcctgtcctcctgttatatgaacacacacacacacacacacacacacacgcacacacataccacatttcaataagtcttcattgttctgggtccttacctttcctgtcctcctgttatatgaacacacacacacacacacacacacacacacgcacggtcga

SEQ ID NO: 2714 - DNA, 2055 bp, Homo sapiens
  misc_feature (2014)..(2014): n equals a,t,g, or c
  misc_feature (2016)..(2016): n equals a,t,g, or c
  misc_feature (2038)..(2038): n equals a,t,g, or c
  misc_feature (2045)..(2045): n equals a,t,g, or c
gacgatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcaccacatcagcagtcaaaagcacaagctgaaatgcagtccagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaagagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcttgtacaggtctcagacggacactgaagggaatgstacygscgagtcaagctcaacaggtgtgagcgtggagcccagscacttyccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtcttagacaaggcaggagatgagatggacctggaaggcatcagcatggacgcccccggctcatgagcgatggggatgtaactgagcaagaacattntngaccgatgacaattatcaaagncggggcntaccattgta

SEQ ID NO: 2715 - DNA, 1639 bp, Homo sapiens
  misc_feature (12)..(12): n equals a,t,g, or c
gtgacactatanaagtacgcctggcagggtaccggtccggcaattcgcggccgcgtcgacgtcaggcgggccgtgggttcccggaggggstcttgaggcgccatttcaagtcgcccccagcctctcccacagcactcctgttttcccgggcctcatcatggcccacggccctcagtcgctgtggagcctgggcttcacagtgacactcacgtttgaactcccggtcggctgtgtgcttggtagaatttgtcatccaatacaggcgtgtaacacgggcttgatgacacccaccccacagggcccctgcaggaccgagatgatgtccaatgacaagccctggcttccagccaatgctcctgcccacatctctctcccaggagccaggcttacctctacctgtgcacctgggctgtgactcatgactggaatgatctggctgggcctgttcccccaccagacttattttcaggcgccccagcagccaccaaacatctgtcaactgaagtaatgaacctgcagttgagaggcagctaaacctaggttgaaggttagggagacagctgagttgaggtcaaatccccccggccagttagcctttctgagcctatttcctcaattgtaaaaggaagacaatcatgatgctgacctcagaatcsagcgaggaggaagtgaggaggtgcatgtgaagcattgtgcgtgactggtggggctaactgggctctggaagcggtarctctggggccctaacccctttctgcctcatgctaattgacctatggcatgtccagtgacatcatgactgaaaaaatgatttgaaartataatcgctgtcaggaattgtctcctggtctcaaactcctaggcttaaggaatttgcccaccttagcctaccaaagggcggggcttacaagcatgarccatggcacccggccccaaagtgttttttctattctctcagtcmacagttacacagaaaatttctgtgaccactggtcacgaaagggagtggaggtctctccctaccggcaaccaagcagtcgattctgcagtggacaccagctgggtgttctcttattgaattaattctgacactatctgtccagagatagcattagattccacaggttgaggacttagtccccacttgtcccttatttctgatgctgatcacaagamctargttattttgccggtgattctgactgactggctattaattagggtttctgtgacccactccttgggttcaattaatttgctagagaactccctcatggaattcagagaaacacatttaccagcttattataaaggctgctacaaaggatacagatgagatgcgcagagcaacgtgtgggatggagtgcagagcttccgcgccctctcctggagcaccactcttcaggaacctccatgtgttcagctattcagaagctccctggacccagtcctttcgggtttttatggaagcttcattatgtagacatgattaattataccattggtcattggtgatcaacttaaccttcagcccttctcccctcccggaggttggagggtggggctgaaacattccaacttacaggcccgtcgacgcggccgcgaattcccgggtcgacgagctcactagtcggcggcc

SEQ ID NO: 2716 - DNA, 4995 bp, Homo sapiens
gccgcgccgaggaggctgccgctctggcttgccgccccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaatgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgagtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaaccggtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagctcaacagctcgctggagagatacgatggtatcgggcctcccttcagctgcatcttcaggatccagaacttgggcttgttccccatccacgggattatgatgaagatcaccattcccatcgccaccaggagcggcaaccgcctactgaagctgagggacttcctcacggacgaggtagcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccacgccaaggcctccctcaggctctgtggagggcatttgctgccccagctactaaggtgctaggaattcgtaatcatccccatcctccagagaaacccagggaggaagactgtaaatacgaacccaatctgcacactccaggcctctagttccagaaggatccaagacaaaacagatctgaattctgcccttttctctcacccatcccacccctccattggctcccaagtcacacccactcccttccccatagataggcccctggggctcccgaagaatgaacccaagagcaagggcttgatggtgacagctgcaagccagggatgaagaaagactctgagatgtggagactgatggccaggcaagtgggaccaggatactggacgctgtcctgagatgagaggtagccgggctctgcacccacgtgcattcacattgaccgcaactcacacattcccccaccagctgcagccccttgctctcagctgccaaccctcccgggtcacttttgttcccaggtacctcatgggaagcatgtggatgacacaatccctggggctgtgcattcccacgtcttcttgctgcagcctgcccctagacatggacgcaccggcctggctgcagctgggcagcaggggtaggggtagggagcctcccctccctgtatcaccccctccctacacacacacacacacacacacacacacactgcctcccatccttccctcatgcccgccagtgcacagggaagggcttggccagcgctgttgaggggtcccctctggaatgcactgaataaagcacgtgcaaggactcccggagcctgtgcagccttggtggcaaatatctcatctgccggcccccaggacaagtggtatgaccagtgataatgccccaaggacaaggggcgtgcctggcgcccagtggagtaatttatgccttagtcttgttttgaggtagaaatgcaagggggacacatgaaaggcatcagtccccctgtgcatagtacgacctttactgtcgtatttttgaaaaattaaaaatacagtgtttaaaaacaaaaaaaaaaaaaaaaaaaaa

SEQ ID NO: 2717 - DNA, 1378 bp, Homo sapiens
tcgacttctgggatgtagattctcctttattgaattcttcattttcactcgcagtatgatttatttttttcacactgtattttacactgcatatgtttctcttataacgagggtcactttcttcctgcccaggattggaatcaattacagctatgcaatgttttttgtttagcatcttcttaattacaggcttggcagaagagttttgtgaacaactctccatttcactggctgaagaagaaatacaactgtcctctacagttgaacatttctgtatgacagcattttcatggtaatgaggattaggttcatactttggtttttccaaaccggggaaacaaacaacagccaaaaaccagtgtgcagcttcattaaggggtacaaaaataaaatccttctcaaaaatatctacgtgccgggtccatgtttttactctcccatgccgtttttgctgtattgacagattagttgtttcatgatttctcctctctctctgattaaggcgtttatagaaaaaagaactgaatatatgaattcggtcagcgtcttccttcttcagtttttcaagcaccaagtatttcaaataaaagtctataataacatcatttaaaaattctccttcatttagacagtgcaggtcctcattggtaacagagatgcctcccttagctggaggtggtggatatactatcaacttttctactgggccaatgaagatggtgtggttttctccagtttcttcttcttcatcaaaaaactgaaattcttgtttgcttctaagttgtattttagattcaaatgatacagttttaattttgttttccttttgcccacaacttcctttgatgctctcttcataggttcttgtacaggcaacaagtctgccattagcttcttcaaagggaattttcgcaaaaaaattggagatgttattctttataccaatttcattaatgatactttcaaataccatatttgccggaggatcaaggccattttgaaaaattaaaattatatattgttcttctaaatttgttaatttatttactcctttacaatcattccaaactttatcctccttattcatttgcagttggatgctcagcttttgataaactgctggaattgcttgaagaaacactacaggtaattttcggacattacaccattcacatttagttagatcagaggtatttaatataatctctacaggatcatggtctggttcgtctagctgtatcttgataaaatctaaacaaaaaattacaggctctattaacagccggaagagtgttcctactcgtcgacgcggccgcgaattcccgggtcgacgagctcactagtcggcggccgctctagaggatccctcgaggggccc

SEQ ID NO: 2718 - DNA, 1983 bp, Homo sapiens
gacgttgaagatgagaacaagcagaagaaacaattggatttctatgaaaagaaaacagattggtgtacacttacacaaatttgtgcagattatttgtctagaaggaaagtcatacaggttgggcagtctggtcacaaaaagggacaggggttgagggggttctggtgactgtgatgaaggcctcactctcaggcctccggtcccactgaaggtcagatgaaaggtagtcttccctggcggttgctgctgccactgaatgggccctaactttgtcgtcttgtgtttgaatcttctgcaggacacgttagcgtatgccacagctttgttgaatgaaaaagagcaatcaggaagcagtaatgggtcggagagtagtcctgccaatgagaacggagacaggcatctacagcaggtataacggtcagcatgtccttgtgtgcaaagggcagccttgctcttaagctttccaaaaagaatttccacagctgagggaaaacaagatgcttcctctggaatgtgagtccaaagagttaccagcgctgccctctagtgatctcagctcagcatatgcactaaccgtgtgtttacagggctgagtagtgctgcagtgtgaagtgaatggaaggcctcgaggtgtttgtggctggccaccctgatcagcctgcaggtagtcccgatgaagccagggcacagggggattcgttccagcttgttcactttattctgccttgccaggttactgaaagtccctcgtttgctctcaccagccttcctggaaatgtggactcttgaaagaaaagctcccgtgctcttgaagtatacctgcttgccaggggagtccaagaaaattttgacatgtatttttaaaaaaagaaaaaaaaacagctttaataccaatcattatagtagaaaaagaaaataaatatgtattgaacacccactgtgtgcaaacactgaactaagtgtcagttaatcattacgtctttccaatagtctgtaactttccttaacagcagtctcctctgtggtcccttcacagtacttggtacagaataggccccattaaatgaatgttactgatgtagtaggtgtcatttttttttaagtgttatctttcggatcctcataagcactatgtgaggcagctgtcaccctgattttacagaaaggtaactgcagcccagcacagtgatgtgacttagcccaaggtcactccacacattacctcatcacctacttcatttgcagagaaaataaaagctgtcacaggagagctcctgcggccactaattcccaagcatctgcactgttcttgtstcctctcctgtgacagtgggaagtttgcctctgtccacccaaagcccctagcgctcatccccgcccaccttggcagagctttgcgttctaatgtgtatgtaactcttcaatatccagaacgctycaccctgccagacccttcccagcgacgtctcagcacactggtttctcttctgccctgtcaaagcctctcttctgccctgtcaaagcctctcttctccctgttgcccctgccttcttttctcttctttgcagccaaacttcgactaattctctaaacttaactttccccattttcttatctctcactcgctcttcagcctcttccctgctaactccctcttctctccaactcagcagttggggtgacaggtggcctgcagctttcaggcctcatcttagccgactgctcggcagcatctagcgctcctggcgctcttcccgtttgaaacactattccagggctttcctgacacttctctctcgtagttttcctcaaacccttctggctgttccttctctgtctccttcctagtactgcctcttctggaccaccagtaaaggtttgtggagtctctaacctgtatcctcctgccctcactccatattctctccgcgtcgacgcggccgcgaattcccgggtcgacgagctcactagtcggcggccgc

SEQ ID NO: 2719 - DNA, 1116 bp, Homo sapiens
  misc_feature (380)..(380): n equals a,t,g, or c
  misc_feature (1053)..(1053): n equals a,t,g, or c
  misc_feature (1062)..(1062): n equals a,t,g, or c
  misc_feature (1097)..(1098): n equals a,t,g, or c
gggaaggggagggccagatattccagctgcayaccacwctggcrgagacacctgctggctccctggacactctctgctctgcccctggcascactgtcaccacccagctgggaccttatgccttcaagatcccactgtccatccgccagaagatatgcaacagcctagatgcccccaactcacggggcaatgactggcggatgttagcacagaagctctctatggaccggtacctgaattactttgccaccaaagcgagccccacgggtgtgatcctggacctctgggaagctctgcagcaggacgatggggacctcaacagcctggcgagtgccttggaggagatgggcaagagtgagatgctggtggctgtggccacngacggggactgctgagcctcctgggacagcgggctggcagggactggcaggaggcaggtgcagggaggcctggggcagcctcctgatggggatgtttggcctctgcttcctcccagttcacagccagagttgcctctcctcctcctcttccccaacccccagaccatgaccagccttagaaaatccatgtactctgttgttagagggcccagagttccttctccacccccgctctctctctcttggcctgagatctctgtgcaggaaccaagatggggctgaagcctctggaggcagttggttgggggcgggcaggcaggaggccctccctccacccccccaccctcagcccggcaacttctgggttccrtgggttttagttccgttcttcgttttcttcctccgttattgatttctcctttctccctaagcccccttctgcttccacgcccttttcctctttgaagagtcaagtacaattcagacaaactgctttctcctgtccaaaagcaaaaaggcaaaggaaagaaagaaagcttcagaccgctagtaaggctcaaagaagaagaaaaacaccaaaaccacaagggaaaagaaaaacccagtttcttaggaaacgcaaacgatttattatccagattatttggataagtcctttttaagaaaaaaaaanaaaaaaacncgagggggggcccggtacccaattcgccctatagnnagtcgtattacaattcac

SEQ ID NO: 2720 - DNA, 4034 bp, Homo sapiens
gtacccacaattttcaggtgggtgtgtaagagctaatggggccacagatgctatgcataccactgcctagttgttgctagagagccttttcaacctcagagaacatagcattccatgctaaccatcatttaaaattcctgcaataaatgaaaaaaataaacacagagctgagagtataattcaactagcctcgctcccaaatgaagctgattccagatagaaagcagattttcatatttactgtatgtgacagctgcaggaattaaatgaatcatctgtctatctctattgccttgttcctcctgtgctgtgtgcatctatccctggggttgtctgtcttcccattccaggaagacagatcagtgtagtttcaattattaattccatgtttggatcacagtaacaccagttccagttcagtgacctgcagttcctattgatttaagtgatgaattatctacactgcaatgtattattaactttattttgtctcttattccttctgcattcatgcatcaaaataataaagcaccattcacaggctaaaaggacccgtttcccttctcacatttcccataagggcgaagccaacacacaccagggaggtaattacacagagctggggtgggggctggacatttattttacctctgaattatttatctcagctgtgaatttgggggaggggttgggggaggtcctcagtggggaacaaaggggcccaggagggaagttaatgaagacaagtgacgattagaacctgggagattcataagaaatgaaataacctcaacccaaaagtttaacttctgggagtcaatctgcccattctgataatgatggggggatgggtgtaggagtggtaacgacagtggcacagtgtgaagggaaggaggcaagagaagagagcaccatcagtttctcctgccatctcttttggattgctctgcctgccccatcgcaagacctactcagcaaggtcagactccagtgagacatggatttgtggatgtttggcagaaatgtgctggccttatggctaacctaccattgtcttcatcttctttgggtaaaagcacatcctcctattaccttttgaggaacttcctttccctgggtacaatctggtaggactatcaatccagatgccctaccttgctctgaccaaatgcatgacccaagctgggtcagtgaggttctccctccatgacatttgaattacagacaaagggcacaaaagaccgagggtaagtggcatctgttcactagcgctgatgcctgggtctgactgttgagcaattgctgctctcaataccttctgaagatgatctgcaagccttgtttttcaaccttccctttgattctagatgccccaccccatagtctttcaataaatgcttttttttttaagttaactaaatttgagtgtgttttgttgctttcaacttagagaactctggctaagcagccaaaagacatggctgtatctaaagtgtccctgagccctcagagatggaaaaggtgaagagggaggggctacagatcttgtctacacctcttctgccaatcaagcaacaattacatcaatagggagatgggcaggaggtgaagtgaaggcattcctctgtcctctcgctcccatttctagttagaactgaatccaacctcccagcctgcaggactcctgttggggcaactcccaaagtcaaggagtctgaagagacacctcatctgacaatcccacacagagggaagacttctggaggggttgcctagggtcaggcaccccaggcatcccgcctatgagccaaacccaagaggaaggaaagacacccaggacctcccagtttgaaagtgaagataaagctgctaagtgcgtagaagtttccatgtgcagacaattggaggattacctaaggtctcatttctagtgctattacactcagaaattgcctcacctatgactgctcccattttgtgactcacagctctctacgctgcactggtatgaaacagatgttgtgaatgttttattgtagtttccaattgccacccttcattcatctgattcagacctaagagccttgggctttcctttcttttctttctcctcctccaccctttgattttaagggcctagaggtgaacatctaacaggcagaacctgattctacctgtcaactcagccccttatagcaatggagaatagcccagcaatgcctgagaaatgagttctttttctttccagaacttcaccacataaggagagaaggatcagaaaaccatgtgattagattatatggaagaaggtcaaagattaaaaatccactgcctctcattattagaggagggatgacagattcagaccagagcacaaaagaaaatacattatttcaaaacaggatatgaaacccagtcccaggtgattagtctctgttaagtaaatttactatctaatcttttaactgtcttccgaaattgctggtccaacattctctccctcctccattggaagcttaaccctgggagggtgctgtcatccaccttaatggaatggggagctcatttcaggggggtgtaggtgggggtggggtggctggggtggaagggtctgtaagtgaaatgcaccctgtaataaaagcaggatgtgtgcactgcagaccagcctgactggaggtaggatggggatggaggttggggcaattgtccttcctttggtttcagagctaggcccataaatgaggagactatccttcaacctcactccaggctcatcctgggaaaactggactctcctctttccgcacagccccaaggggcccacatgtcaaagaatctcatgcttcggggttgctctcaaaccagatcaaccttcaaagctttgattttaaacgaatgctgctctgcaggctaaatatcacaggcctgtgttggggcccgaagaggacaagatgtgcacttggaggccagacaggcttgcaacaccatccaagcaatgagaaaacaagacatagtggaaaagaggatctgtttctcagtatctgtcttggctggggtaccactgtgaacatggcatgcaacaatcagagaggcagaggataccaaacccaaaggaactcttcccctgtttaccaggaggaactcctttttttctgtacttcactattttctcgtctgtttagtctaaaaggctgaactattacacaaagaaagttctctccaagaatgagttttccagagaaagctcttcagacaagggcagtgtttgaaccactctccacagcctggagaatggggtgtgtgtttaacagaagggggctggggccaaacaggactccctgaaggattcccaaggtgctctgtttgtgtgatttatcccttctggaaaatccaaacatacaaatgtgcctgctgcaaaagtcagggcagtctccaggactcaggttcccacacaaagctaaccacatatagcttgcctgccctgaaggttttctctattttaaccttcgtaggttttcaaccaaaacagatgaaagggaggtgcatgtagttttgctggggatcagcagacctcatttctctctctcttcttagctcctaggctcacttcacaaaaaaccctcggagaacaggaactgggcaaaaaggggcttccctcagctcctgggatttcagaaccagacattgtcatcctgttcaccaagcagtcgacgcggccgcgaattcccgggtcgacgagctcactagtcggcggccgctctagaggatccctcgaggggcccaagcttacgcgtgcatgcgacgtcatagctctctccctatagtgagtcgtattataagctaggcactggccgtcgttttacaacgtcgtgactgggagatctgctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagag

SEQ ID NO: 2721 - DNA, 2365 bp, Homo sapiens
cccgtgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcggtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagctccactgggaggagtgatactagtccaccttattattccaggtcttaatgaaactactgtaaaacttcctgcatccctaatgtttgagatttcagatgcactcaagacacaattagctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactggttctcagcaaaaggaccccggaaacattgcaaactattctaatacctcagtttgaattgccactgagcactctagctccaaaaagccttccagaatttcctgaggcaaaaacacccttcccttttgagaaacctaggggcacattggcttcaagtgaaaagccatggattgtgcctacagctaaaatatctgaagattccaaagttctgcagcctcaaactgcaacttatgatgttttctcaagccctacaacatcagatgagcctgagatatcagattcctacacagcaacaagtgatcgtattctggattctatcccacctaaaacttctagaactcttgaacagccaagggcaacactggctccaagtgaaacaccatttgttcctcaaaaactggaaatctttaccagtccagaaatgcagcctacgacacctgctccccagcaaactacatctatcccttctacacctaaacgacgcccccggcccaaaccgccaagaaccaaacctgaaagaaccacaagtgccggaacaattacacctaaaatttctaaaagccctgaacctacatggacaacaccggctcccggtaaaacacaatttatttctctgaaacctaaaatccctctcagcccagaagtgacacacaccaaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctgttctgaataggacaactacaagacctactaggcccaaacccagtgggatgcccagtgggaatggagtgggaacaggggtcaagcaagcacccaggccatcaggtgctgatagaaatgtatcagtggactctacccaccccactaaaaagccagggactcgccgcccacccttgccacccagtcgac

SEQ ID NO: 2722 - DNA, 1623 bp, Homo sapiens
ggcacgagctaagaagggggagtcctgaacttgtctgaagcccttgtccgtaagccttgaactacgttcttaaatctatgaagtcgagggacctttcgctgcttttgtagggacttctttccttgcttcagcaacatgaggcttttcttgtggaacgcggtcttgactctgttcgtcacttctttgattggggctttgatccctgaaccagaagtgaaaattgaagttctccagaagccattcatctgccatcgcaagaccaaaggaggggatttgatgttggtccactatgaaggctacttagaaaaggacggctccttatttcactccactcacaaacataacaatggtcagcccatttggtttaccctgggcatcctggaggctctcaaaggttgggaccagggcttgaaaggaatgtgtgtaggagagaagagaaagctcatcattcctcctgctctgggctatggaaaagaaggaaaaggtaaaattcccccagaaagtacactgatatttaatattgatctcctggagattcgaaatggaccaagatcccatgaatcattccaagaaatggatcttaatgatgactggaaactctctaaagatgaggttaaagcatatttaaagaaggagtttgaaaaacatggtgcggtggtgaatgaaagtcatcatgatgctttggtggaggatatttttgataaagaagatgaagacaaagatgggtttatatctgccagagaatttacatataaacacgatgagttatagagatacatctacccttttaatatagcactcatctttcaagagagggcagtcatctttaaagaacattttatttttatacaatgttctttcttgctttgttttttatttttatatattttttctgactcctatttaaagaaccccttaggtttctaagtacccatttctttctgataagttattgggaagaaaaagctaattggtctttgaatagaagacttctggacaatttttcactttcacagatatgaagctttgttttactttctcacttataaatttaaaatgttgcaactgggaatataccacgacatgagaccaggttatagcacaaattagcaccctatatttctgcttccctctattttctccaagttagaggtcaacatttgaaaagccttttgcaatagcccaaggcttgctattttcatgttataatgaaatagtttatgtgtaactggctctgagtctctgcttgaggaccagaggaaaatggttgttggacctgacttgttaatggctactgctttactaaggagatgtgcaatgctgaagttagaaacaaggttaatagccaggcatggtggctcatgcctgtaatcccagcactttgggaggctgaggcgggcggatcacctgaggttgggagttcgagaccagcctgaccaacacggagaaaccctatctctactaaaaatacaaaagtagccgggcgtggtgatgcgtgcctgtaatcccagctacccaggaaggctgaggcggcagaatcacttgaacccggaggcggaggttgcggtaagccgagatcacctccagcctggacactctgtctcgaaaaaaaaaaaaaaaaaa

SEQ ID NO: 2723 - DNA, 1987 bp, Homo sapiens
  misc_feature (1554)..(1554): n equals a,t,g, or c
ggcacagtttccagggaaagaagggcggggatgtcagggctggagagtgcccgtgtccttctgtgtgcattgggctccttcctccttaattctctgctttccacttttaggctgaactccagtgcacccagttagacttggagcggaaactcaagttgaatgaaaatgccatctccaggctccaggctaaccaaaagtctgttctggtgtcggtgtcagaggtcaaagcagtggctgaaatgcagtttggggaactccttgctgctgtgaggaaggcccaggccaatgtgatgctcttcttakakgagaaggagcaagctgcgctgagccaggccaacggtatcaaggcccacctggagtacaagagtgccgagatggagaagagtaagcaggagctggagacgatggcggccatcagcaacactgtccagttcttggaggagtactgcaagtttaagaacactgaagacatcaccttccctagtgtttacatagggctgaaggataaactctcgggcatccgcaaagttatcacggaatccactgtacacttaatccakttkytggagaactataagaaaaagctccaggagttttccaaggaagaggagtatgacatcagaactcaagtgtctgccrttgttcagcgcaaatattggacttccaaacctgagcccagcaccagggaacagttcctccaatatgtgyatgacatcacgttcgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccrgaaaggggaggagcgcarcagttgcatttccggaaacaacttctcctggagcctccaatggaacgggaaggagttcacggcctggtacagtgacatggagaccccactcaaagctggccctttctggagctcggggtctatattgacttcccaggagggatcctttccttctatggcgtagagtatgattccatgactctggttcacaagtttgcctgcaagttttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcaaaaataactgctgatggtagctggcttttgaaatcctatggggtctctgaatgaaaacattctccagctgctctcttttgctccatatggtgctgttctctatgtgtttggcagtaattctttttttttttttttttttgagacggagtctcgcactgttgcccaggctggagtgcagtggcgcgaatcttggctncactgccaagtccgcctcccgagttccaagccaattctcctgcctcagcctcccgagtagctgggattacaggtgcctgccaccacacccagctaacgttttgtatttttagtagagatggggtttcaccatgttggccaggcagatctcaaacttctgacctcgtgatgcactcacctcggcctcccaaagtgctgggattacaggcgtgagccactgcgccctgcctgtttgtagtaatttttaggcaccaaatctccctcatcttctagtgccattctcctctctgttcaggtaaatgtcacactgtgcccagaatggatgaccaggaaccttcaagagtggctgaaaagattgcagagttatcataataaattgctaacttgcgtatwaaaaaaaaaaaaaaaaaaaaaaaaaaaaaaaaaaaaaaaaa

SEQ ID NO: 2724 - DNA, 2602 bp, Homo sapiens
  misc_feature (126)..(126): n equals a,t,g, or c
  misc_feature (2540)..(2540): n equals a,t,g, or c
  misc_feature (2564)..(2564): n equals a,t,g, or c
gggttcttcgggcaactttcctttccgggtgttctgaagcggttttcctgtaatcctcagtgaggaaacccaccgtgaatcggattgccgttcagtcccacggaagcctggctcgttggccatgtnggggacgcatgttcattaagttcattaaaataatttcatttgtcttggtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatgaagttcttattctaaaagtctgaatgcttagaacaaacttaacatgtttatagaatatggtctctttgtaccaagtactttgcttaagagctcctttgggccactacatattttggtttctagaaaatgtttgtttatgaagaagtcgatggaaaactgcaaacatatgcagaaaaggtagaataataaaaaaggtctaatgaactccattcagctttgaacctatccactcataaccattgactggccttttaaaaaaaagtattgggcagaattaaatttccacctaggtgatggggaaggaaagtgttcgcctgtnccagcctgtggttcctgcctgggnggtttacccagtggtggcgccaggccaaggtccattca

SEQ ID NO: 2725 - DNA, 1416 bp, Homo sapiens
atatgaagggaaagaatttgattatgttttctcaattgatgtcaatgaaggtggaccatcatataaattgccatataataccagtgatgacccttggttaactgcatacaacttcttacagaagaatgatttgaatcctatgtttctggatcaagtagctaaatttattattgataacacaaaaggtcaaatgttgggacttgggaatcccagcttttcagatccatttacaggtggtggtcggtatgttccgggctcttcgggatcttctaacacactacccacagcagatccttttacaggtgctggtcgttatgtaccaggttctgcaagtatgggaactaccatggccggagttgatccatttacagggaatagtgcctaccgatcagctgcatctaaaacaatgaatatttatttccctaaaaaagaggctgtcacatttgaccaagcaaaccctacacaaatattaggtaaactgaaggaacttaatggaactgcacctgaagagaagaagttaactgaggatgacttgatacttcttgagaagatactgtctctaatatgtaatagttcttcagaaaaacccacagtccagcaacttcagattttgtggaaagctattaactgtcctgaagatattgtctttcctgcacttgacattcttcggttgtcaattaaacaccccagtgtgaatgagaacttctgcaatgaaaaggaaggggctcagttcagcagtcatcttatcaatcttctgaaccctaaaggaaagccagcaaaccagctgcttgctctcaggactttttgcaattgttttgttggccaggcaggacaaaaactcatgatgtcccagagggaatcactgatgtcccatgcaatagaactgaaatcagggagcaataagaacattcacattgctctggctacattggccctgaactattctgtttgttttcataaagaccataacattgaagggaaagcccaatgtttgtcactaattagcacaatcttggaagtagtacaagacctagaagccacttttagacttcttgtggctcttggaacacttatcagtgatgattcaaatgctgtacaattagccaagtctttaggtgttgattctcaaataaaaaagtattcctcagtatcagaaccagctaaagtaagtgaatgctgtagatttatcctaaatttgctgtagcagtggggaagagggacggatatttttaattgattagtgtttttttcctcacatttgacatgactgataacagataattaaaaaaagagaatacggtggattaagtaaaattttacatcttgtaaagtggtggggaggggaaacagaaataaaatttttgcactgctgaaaaaaaaaaaaaaaaaaaaaaggaaactcgagggggggcccgg

SEQ ID NO: 2726 - DNA, 936 bp, Homo sapiens
  misc_feature (294)..(294): n equals a,t,g, or c
  misc_feature (298)..(298): n equals a,t,g, or c
  misc_feature (925)..(925): n equals a,t,g, or c
gaattcggcacgaggaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgkgcaattatttnctgnacttttttgttcattaatttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaaaaaaaaaaaaaaaaaaaaaaaaaaaaaaaaaaaaaaaaaaaaaaaaaaaaaaaaaaaaaaaaaaaanaaaaaaaaaaa

SEQ ID NO: 2727 - DNA, 2053 bp, Homo sapiens
acgctgggacttgggcggtggtggaggtggtaaccgtgatagtagcagctccggcgrcagcaacagcgactacgagggatggcggcggctgcagcaggaactgmarcatcccagaggtttttccagagcttctcggatgccctaatcgacgaggacccccaggcggcgttagargagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatagtgcagatgctaatttcagtgtctggattaaaaggtgtcaagaagctcagaatggctcagaatctgaggtggtaagtccaaagttttcattcttcatgtttttattattttaaatttcagctaccaaatatatttgagacaagactcaggatgagctgtctgatatttaaatattaagcaattccatttaagtgctggttcctctaggcactgaaataaaatcattttttgataaatatagaagtttccagtcatgaaaattattggcctattttaatgaatttagtgtgtggttaaagttgatttcgtgtgttttaatatggtcatgatgatcatttatcttttccgttactaaaaccttattgcatttatttaggttcaacagtttgaatcacttgtagggctttttatgataggctaagacaaaagttaaagaaaattggaaattgacagggtcttgctctgtcatgcaggctggagtgcagtggtgccatcatagtgcacttgagcttcaaactcctgggctcaagcaatcttcccacctcagccttccaagtagctgggactacaggtgtacaccaccaagcctggctaattactctgtttctttaaaacgatttttaaaacaatgttattttagtttaggaagttgctgaatcttagaactggccattttatataagcaaccttttctaatcatgcctttagaagttttctgttatttaaagttctgttattttagagcaaaaatcttttatgaaattcaatctaagattttttaaatgctgagcattctaatttttttccgaaaactagtggtatttaacaattacagttactatgtctttggaaggaaaattttcatgtagttattttatatcaaaataactgcagtgttgggtaaattaataatacatgcattttaataatacagttgctaaactgacttgtaaaaatctttctctttcaacttaccaaaatcaatctgcatcccagtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcaaaaaaaaaaaaaaaaaaaaaaaaactcga

SEQ ID NO: 2728 - DNA, 1239 bp, Homo sapiens
  misc_feature (405)..(405): n equals a,t,g, or c
  misc_feature (473)..(473): n equals a,t,g, or c
  misc_feature (1223)..(1224): n equals a,t,g, or c
gtattgatacgaattttgactacatttctgatggtgtgttttgctggttttaacttaaaagaaaagatatttatttcttttgcatggcttccaaaggccacagttcaggctgcaataggatctgtggctttggacacagcaaggtsacatggagagaaacaattagaagactatggaatggatgtgttgacagtggcatttttgtccatcctcatcacagccccaattggaagtctgcttattggtttactgggccccaggcttctgcagaaagttgaacatcaaaataaagatgaagaagttcaaggagagacttctgtgcaagtttagaggtgaaaagagagagtgctgaacataatgtttagaaagctgctacttttttcaagatgcatattgaaatatgtnawgtttaagcttaaaatgtaatagaaccaaaagtgtagctgtttctttaaacagcatttttagccctngctctttccatgtgggtggtaatgatctatatcaccaacctkaatctctctgccttttttttcaaacaccccttcatcatccatcttaatttgcataaggacatatctactttaatgtactaccacagtttacagttaatgtgggaaagaccagcttcagtatcctcttcagctaggattgccctaacttttaactttcacagtttcctgattcatatttgcccaggctctgatgccttgaattggttttggctctcttttttggatctgtttttgttgttaaacatcataatgcagtctctcattaatttttaccatcatttaccctgataatctgcctcttctccatttctccttcccttactacctttctttgaattactgtaactgattggtcccaccaaaattttaaagtacatgaagtatcttcattggttcatcctcttgccccctccagatgtcaaaaaactttatcctgccccctagctgaccacccaggttcctttatttcagtggcccatgtgagtctaccttcccctaaggagtgccctaatccagccctttttttgtttcttatgacccatatctttaggctcttcccatttctaggtgggagataggtaagtttcaaatctatgccagtcttatgaatattacattagggtaatgtgctataatgaagaaataaaaaatacagtgcttaaaagaaaataaaattctatttctgtctaaaaaaaaaaaaaaaaaccnnggggggggccccggt

SEQ ID NO: 2729 - DNA, 1057 bp, Homo sapiens
  misc_feature (348)..(348): n equals a,t,g, or c
gaattcggcacgagcggcacgagattttaggtaaatgacgaagggaatgtggtgaatgtcactgtccagagccataaatcagacaaaaccatacatagcatgctgaaaaacttttgtaatggaacacccaacaaatgacacctaacctgtctgtgatccaacaagtccgataacatgctgctgtatttgtattctctgggaatctcagtattaataatttcatttcccacaaattctagcattcatgtaaggaaaaacatggctaatcaatatcttaaaggggcaatctttcagagcagtggttttcaaagtgtggccggacagcattggcagcatcttaatctcctngggactttgttaaaaatgcaaattctcagccccaccctagtcctactgaattgggaaactggcgtgggacccagcagtctttgttttaacatgttctccaagtgattctgatgcctgttcaaacttgggaaacacttttagagcacttgaggaacctaaaagatgactggttcagcattttgtgtggtagataagaaagaaattatcacaaaaaatcagaaatgaacagtgagagaaaaataggaccccagacagtttataccttccatttgctgttttaaaagtgtgagcctgccaagtcaacaagtatgcctttagcgcacatgtaaatagcctgcacttcctaaatctcgtgtggcctcccatggttacattcttcaaaggtwaactgagttgagaggaagattcagcatttaaaagagaagggttgaaaaagattgtgtgtgtgtgtgtgtgtgtgtttaattggcccagggttacttaaataaatcataaccattttgccacattctgtaactgtttagctaaggtcaaattaagtttaccctatggattttgtttcatcttttgtttcgtgtatatactgtttgcctttttcataaaaatcttggatttgttatatattgttcctgttatttttgacatctttgctattgtaaataaattactattttgttttaagttaaaaaaaaaaaaaaaaaaacwcgta

SEQ ID NO: 2730 - DNA, 1760 bp, Homo sapiens
  misc_feature (24)..(24): n equals a,t,g, or c
  misc_feature (39)..(39): n equals a,t,g, or c
  misc_feature (255)..(255): n equals a,t,g, or c
gccttcaactcttgttttattganttatgaattcttaantcttctatggcaggagacatctatggggaggctttgtttgttttttgagacagggtctcatttgtcgcccagggtgagactctgtctcaaaaaaataaaataaaataaaataaaaacaaagaaaaaaaaataaaatctttaggcattcccagacacaaagatctcagagacagacaacagagagcytccgtgttcatctgcccgaggctgtttgtncacagttcccttaaaagatgcctggaaatgctcccaacaacaagggactcaagtatggggctgagtttgttaaaaaagcagctaaatgtgtttaggaaacacacgaagtgaaaccagacagtgatggcccatgtacaagacttgtgcttgaagctttggtgtgcctccatggccaatttttcaggcaccaaaacccattcctgattaattattgttaaaaaagcagctaaatgtgtttaggaaacacacgaagtgaaaccagacagtgatggcccatgtacaagacttgtgcttgaagctttggtgtgcctccatggccaatttttcaggcaccaaaacccattcctgattaattattgatatacaatgcaaaccaaactatgaaaacacagactttttttcagaagagggaaataaaggcacagaaacctgccaaaatagatatttttttccataagaatagtatggttgattaaaatagtttatcactagtaaaacttgtatcactagagcagacaatacaaattagttttttaaaaaatgacattcactgaattcttggtctgtgcattcaatgtgaataatcatcaaaaatatattacaattaaaggtttgtaaggagctctgtctgggatttctgcagtatattatttcggaggagaagaaccaccataaagtatgagctatccactgttcctttttatgtcatgtatggtaatcagtctatctcctaatgcaggctcacaaacttccacggtgagatgtctaagtgacttagtgaccttcacactcattaaaggcagccctgtccatcaaactccatacctagaaagttcaataaactgtattacattttaataaatatktctgtgtactttttgttttttgcttttaagctcagcttaaattttgtcaaggaaaccatttcacaagacagtatgtcacagcctactatcagcaatagtccttgtttattagaatctgcagatgtccatattacatcaaatataaatatatattatatttacatttccttcttagctttcaatttaggtgagtgtatttatagataatgccactaacgcaccactattctaatcctcagtgcaactcataccttctttccattagatgctcattaatgtaagacagcatcttaaaagaggggtactgttcttttttaaaataaaaggaaagaaagggaatccaagaatggaggtctagacatttcctaagagatttttgttttgttttttatacttagaaatacttgaaaaatgtggtccctttttgtagtactagtctctacttggggacaagaaaatagaatatgcaactcagaaaggaaagascccaaagamgararaacctgcttgtttactccattaacctgtttaattaagatctgcttttaaatgcctgatgctgtgccagtatcatacaaaacatcttccaccttccaagcagctgaagcacctcctcaaaattctgtttgtcctgaataa

SEQ ID NO: 2731 - DNA, 791 bp, Homo sapiens
gaattcggcacgagctcaaggctaaaatcttgatctctcctgaatatgaggaggtgtgttaggcatgttttggggattggattaatagtgttaaaaaatttgtattttcacaaaaatagcatgtacccatcacccaaactcagcagctttcaagaagcttttctttttttctttcttattttaaaaaatcctttaaccttatgtagttagtatatcttttttaaaaagtagaaaatcatgtaaccttaggatttttagttttaatgtagagtttcacaaatttccatctttagtaagacaaaagggtcacatattggctgtctccttcaactatactttcttcagtataaaatatgtttaccatggttgtcattatcgagcacgtaactgcatgttagactctatgctaagtgttttacataatcatttaaagctcactaaggccctaggagtaattattatcctcccatcaaaaaggtaagtgaaatgttaacctgaagtttgactactttaggtctctgagctagtaagtacaatagccaggtttcaaaccaagatccttttaactgcagcacctgtgccttatctggtagcgtcatcttggttcatacatttaaaaaagagttatctatgtgccgggtgccctggctcatgcctgtaatcccagcactttgggaggccgaggagggcggatcaccaggtcaggagtttgagactgaccaataaggtgaaatcctgtctctactaaaaaaaaaagggggggcccgtacccaatcgcccaaaaagatcgt

SEQ ID NO: 2732 - DNA, 2267 bp, Homo sapiens
cggacgcgtgggtcccttyccctcacccgctccacgccctcctgggccgagtggagttgggtggtgtcgggagcctctccctgaggggcaccgcggcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgktattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagarcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccaggttttatttatctgaatgattgttgcatttgaatactgtagccatggtgagtgagcagttgaagacttcctttctgcaccttcatagttaagggttcatcttctcaagaaataaagttgtgctgggttgtttcaattctgtagatcacctagaaactaggtaacaaggcccttggatcacaatgagcacattgcaggtctttggaaatgctgggaaggggttacattcaagtaactgctgacgtccttcctctctgtcagacccatgttggcctgtaattatatttttctgaatctaaaaacaaatagaaatttctgatatcttttcagtctccttcttttctttccattcatcacttaaatctcattattgtataacgtttcaaattatgacctggattgaaggaagtctgttttgtcagggactttgttaggtgaacatcagaatctcaactacaacaaagctg

SEQ ID NO: 2733 - DNA, 1351 bp, Homo sapiens
  misc_feature (133)..(133): n equals a,t,g, or c
  misc_feature (1305)..(1305): n equals a,t,g, or c
  misc_feature (1344)..(1344): n equals a,t,g, or c
ggcacgagtgcgcasgcgtggggctctctccttgtcagtcggcgccgcgtgcgggctggtggctctgtggcagcggcggcggcaggactccggcactatgagcggcttcagcaccgaggagcgcgccgcgccnttctccctggagtaccgagtcttcctcaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaaaaaaaaaaaaaaaaaccncggggggggccccggtccccatttggccctttggggggnggtttta

SEQ ID NO: 2734 - DNA, 1605 bp, Homo sapiens
gcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttycccttcggtcttccacagcagtattattgtctttgtggagttgactaatgataatttaaaaatcctgtaatggatttctactaaaataaggtcatagtggcatataccaaataaaatcaaatacagaaatacaaaaaaaaaaaaaaaaaaaactcgagggggggcccgtacccaatcgccctaatgatgaatcgt

SEQ ID NO: 2735 - DNA, 1921 bp, Homo sapiens
  misc_feature (1906)..(1907): n equals a,t,g, or c
  misc_feature (1912)..(1912): n equals a,t,g, or c
  misc_feature (1921)..(1921): n equals a,t,g, or c
gcgacgcgaaggttgtcgggatccgcggcagcagcggctgcttgagatctgtttctggggcctctggcggtggcggcctggggcggcgcgacggctggtgcgcaggtacactgatgctgaagtactatgagccttcggaacttgtggagagactacaaagttttggttgttatggtccctttagttgggctcatacatttggggtggtacagaatcaaaagcagccctgttttccaaatacctaaaaacgacgacattcctgagcaagatagtctgggactttcaaatcttcagaagagccaaatccaggggaagtagcaggcttgcaatcttcaggtaaagaagcagctttgaatctgagcttcatatcgaaagaagagatgaaaaataccagttggattagaaagaactggcttcttgtagctgggatatctttcataggtgtccatcttggaacatactttttgcagaggtctgcaaagcagtctgtaaaatttcagtctcaaagcaaacaaaagagtattgaagagtgaagtaaaataaatatttggaattactaatttgtcattaaatcattctatgctgattagcttcataaacattgaactttttgattttatagccacaatgctgcatattcatactttaattcctaaagaataatttttaatgttaaaacgtgataatgcaataaatagaaaaatgtggtttacaaaataaaaacggtcttcactagttaccacctgaagtaagatgtctcgtttggaagctaagaagccatcattgtgtaagagtgaaccactgacaactgagagagtcaggaccacactttctgtcttgaaaagaattgtaacatcatgctatggcccctcaggtaggctgaagcagctgcacaatggctttggaggttacgtgtgtacaacctcacagtcctcagctctgctcagtcaccttttggtcacacatcccattttaaagatcctgacagcctccatacagaatcatgtgtcaagcttcagtgattgtggcttattcacagctattctttgctgcaacctgattgaaaatgttcagagattaggcttgacacccaccactgtcattagattaaataaacatcttttgagtctttgcatcagttatctcaagtctgagacctgtggttgtcgaatcccagtggactttagtagtactcagatcctcctttgtttggtgcgtagtatattaacaagtaaacctgcctgtatgctcaccagaaaggaaacagagcatgtcagtgctttgatcctgagagcctttttgcttacaattccagaaaatgctgaaggccacatcattttaggaaagagtttaattgtacctttaaaaggtcaaagagttatagattccactgtattacctgggatactcattgaaatgtcagaagttcaattaatgaggctattacctatcaaaaaatcaactgccctcaaggtggcactcttttgtacaactttatccggagacacttctgacactggagaaggaactgtggtggtcagttatggggtttctcttgaaaatgcagtcttggaccagctgcttaacctaggaaggcagctaatcagtgaccacgtagatcttgtcctgtgccaaaaagttatacatccatctttgaagcagtttctcaatatgcatcgtattattgccatagacagaattggagtgactctgatggaacccctgactaaaatgacaggaacacagcctattggatccctaggctcaatatgtcctaatagttatggaagtgtgaaagatgtgtgcactgcaaaatttggctccaaacatttttttcatctwattcctaatraagcaacaatctgcagcttgcttctctgcaacagaaatgagggtgtttcccggnnacttncctaaaagn

SEQ ID NO: 2736 - DNA, 1524 bp, Homo sapiens
  misc_feature (1524)..(1524): n equals a,t,g, or c
atccggaattcccgggtgtgttcgacccgtccgggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcaggttggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcacctttaaaan

SEQ ID NO: 2737 - DNA, 1513 bp, Homo sapiens
  misc_feature (1502)..(1502): n equals a,t,g, or c
  misc_feature (1512)..(1512): n equals a,t,g, or c
gcagaatgtttaaaggccttaggtatatggagcgagctgctgaaastatggcaaggtggttgatctggccccactccatttggatgcaaggatttcactttctacccttcagcagcagctgggccagcctgagaaagctctggaagctctggaaccaatgtatgatccagatactttagcacaggatgcaaatgctgcacagcrggaactgaagttattgcttcatcgttctactctgttgttttcacaaggcaaaatgtatggttatgtggataccttacttactatgttagccatgcttttaaaggtagcaatgaatcgagcccaagtttgtttgatatccagttccaagtctggagagaggcatctttatcttattaaagtatcgagagacaaaatatcagacagcaatgaccaagagtcagcaaattgtgatgcaaaagcaatatttgctgtgctcacaagcgtcttgacaaaggatgactggtggaatcttctgttgaaggccatatactccttatgtgacctatcccgatttcaagaggctgagttgcttgtagattcctcattggaatattactcattttatgatgacaggcaaaaacgcaaagaactagaatactttggtctgtctgctgcaattctggacaaaaatttcagaaaggcatacaactatatcaggataatggtaatggaaaatgtcaataaaccccagctctggaacattttcaatcaagttaccatgcactcccaagatgtacgacatcatcgcttctgtctccgtttgatgctgaaaaacccagaaaatcatgccctatgtgtcttaaatggacacaatgcatttgtatctggtagttttaagcatgcgcttggacagtatgtgcaagcctttcgcactcaccctgacgaacctctctatagcttctgtataggcctaacctttattcatatggcatctcagaagtatgtgttacggagacatgctcttattgtacagggcttttcctttcttaatcgatacctcagtttacgtgggccctgccaggaatcattctacaatttgggccgtggccttcatcagttggggctgattcatcttgcaatccactattatcagaaggccctggagctccctccacttgtggtagagggtatagaacttgaccagttagacttacgaagagatattgcctacaacttgtctctcatctatcagagcagtgggaataccggaatggctcaaacgcttttgtatacctattgttctatataaagcaccgcaactgagaacagagcaatggcagctgctgtgtgaggaccagtgtcttctgtctcagggcttattatttgtaactccaaaatagaaatgacaatttcagaattacctaacaaacagtgtatttatttttaatatgtgataatgatcttgtggtatatatgcaaaattattcctacaaaaaaaaaaaaaaaaaactcgtagggggggcccggtacccaatccnaatttttccnc

SEQ ID NO: 2738 - DNA, 1308 bp, Homo sapiens
  misc_feature (7)..(7): n equals a,t,g, or c
  misc_feature (9)..(9): n equals a,t,g, or c
  misc_feature (1241)..(1241): n equals a,t,g, or c
  misc_feature (1247)..(1247): n equals a,t,g, or c
ttggcancngggagagggaaagaggaggaaatggggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcattatggggtatgtatgaccttcattttccaagaaatagaactctagcttagaattatggatgctctaaaatgtcagaatgggaactctcctcgaagttctcccaaactcagagacagcactgccttctcctaaatgattattcttttctccctgttttctggtattttctaggcatccttctcaccacagccataacccttttttacttccattaggccgtataactggngggacngctggtcggtatataatactggtwccaacamaggggttctggatgtacacmaggttatctt

SEQ ID NO: 2739 - DNA, 1411 bp, Homo sapiens
  misc_feature (541)..(541): n equals a,t,g, or c
  misc_feature (1324)..(1324): n equals a,t,g, or c
  misc_feature (1370)..(1370): n equals a,t,g, or c
  misc_feature (1395)..(1395): n equals a,t,g, or c
gaagattctttcttctgaaagccaagcaccacaaggaaaaaaaattattaatagctcaggttaaaaacacccatttaaacaaaaacaagagcatttgtaataggaagtgtttatacaaatagcacatttgtgatatgttgaaaagcatctctcttggcaaccaatctatgtttgaggaagattgggtaatgctgatgtgttccattcatgaaactgtatttgatacataatcctattattaattcgtatgcttagtcaacctaggaaatcaaaataatgttttgaagttcttatttgagcaatatggccttgacttggagggtagttttagttgttttgtttttaagtgactgtggtttaaagcacaaatgccccaaggtggggagacttctctctgtgattattgttgctattaaattctgaactgtatccatattttaaggaaggagctaaaaatggaaattcatgaaacataaatggtatcaagaactttatcagtatgctttgttgaaagcagaaattaagataataattgagttcnaattcgcctctccgcattgcctattgatacactttactaatcatgaaattctaacctaaaaggaaaacattttcctgcttgtcttagaagaaagtggaataattccactgattgtgataatggtttcaatttctacacaatataaatatccagtataaaggaaagcgttaagtcggtaagctagaggattgtraatatcttttatgtcctctagataaaacacccgattaacagatgttaaaccttttaatgttttgatttgctttaaaaatggccttcctacacattagctccagctaaaaagacacattggagagcttagaggataagtctctggagmagaatttatcacacacaaaagttacaccaacagaataccaagcagaatgatgaggacctgtaaaataccttgtgccctattaaaaaaaaaaaaaaaaaaaaaagccagtarctgaatccattttgatttttggttgagtttcctacacaaagaagaaaataactgagaatctggaatgttgtagtccatcctttaaagagtaagaaagtagcagttaatgctagtaaccgtgaattaggcaccactgaaagcacatcccgaatttctttaacaacaacattttatagtgaacactacaagtttttatatttaaaawttaagactctgtatatccttaaggtgctctatgctttaccmgtaattcacagggtatttcaaatggtagaatcattttagcttctgtgcttcctttttctaaataatgcaacttgtaagagttgacnatgtaataagccttataatagtataaccgtccaggagatatatatntatatatccacccccccccacgggnacacagattttaccaa

SEQ ID NO: 2740 - DNA, 1195 bp, Homo sapiens
ggcacgagggaaaccccagagggtgtccagttggaccagggagatattagacacttaacagtattttcagtctgtccatctctttattccaatgtgagaaatggaagtgtttttttttttacgtttattggctcttcatatttctctacattatttttaatgtgcagtttcttcaattggttagtatttccatactatttgcaactttatggcctttaaatataggacatattatatagcagaaattttgactttaaatcctcttgagtagtatattttgagaagaaaagctatactgctcttctggatggtttccatcctttatttaggtcttttctttttgaattcaagtgttttgtatgcttagaaagtagacatgtataatattgagatcggttatttctgagctggaaattggaaactttggaaactcaggaaattgctctgacaatgttttaactgctctcaatttaagaaaatgacgaaatgtataaaaaagacaaaaataacgtgtgctgttttttccaagtgctttttctaagtgcttttccattgtgcaatgaggtgaagtttggtaatttttcggtgtagtagttaaatattgctcaatttttatttacatgtaaagaaaacagatttaaatgtttatgtggccaaaaggtgtcatttaaaaggtaaaataagtttatgtagaatgtatgttcatggtgcttatttttaaaatgtaattcaagtttacagtattacttaatgcttctttacagaatttaatagagaaacaaggctagaacacatctacatcctgaagagccgtttataacttcatattatatgatgacaaagttcattattttccttaaagttgagcaattgacttttatggtccaatgatgaacttattattaataaatgattgagttaactgtgaggcttctcattaaaatacaatattgcagctatcagttggagaatatattataaaattttcagacagtatatcagaaaaatgtttttatttgtactgtatagaaaatgtaattttgctgttaactctgtactttttaaattgaaaatgttttataaatttgcttttaaattttcttatgaagccatttgcaaattacatacttaatttaataaaatactttagccacaaaaaaaaaaaaaaaaaaaaaaaaaaaaaaaaaaaaaaaaa

SEQ ID NO: 2741 - DNA, 1361 bp, Homo sapiens
ggcacgagggagaactgctttaattagcctaggtgaaaagtagtcctagcagtgtaaatatgtataattagagttttctaatttcactgtgagatctctaacttttgagtggcaaacagatcaagtcttttgctcatagacttttctgtggggttattaaaatgcaaaagctttatttttttaataatgccatactccattagtgtcagatgatggtatggaatttgttcccttgctttcccccactgttactgcttcagtttatagattgccagcagagttcagaaatagagcagggatttacccgttctttgcttggacatcccattttcttttgtccagacccatgttggcaatcatgtatgaactgtgttatactttcagtgctttcttttttctttttgataagatggatatcaaaaatagttgctgtgcaaaagttagagtcttcttcaagaagaaaaccaattctttttctaataatatcctgtgaaattgcttcattcattcatttatttttaagccaaatgtcagcagagtgctgctgcttttatctagtaattttgatatgtaagtattaatgcatttttaaaagatgtctacattgaaacatgttcttcccagtgtcctgcttatgatgctttgttcagattttttgtaagagaccagttagtacactgggggtgtatattgtgtacatgtgtcattttagttaggcatgtaggccaaatgtgattataaatgaagttgatgaacattaattttgttattagtgagttttttgaattgtaaatggatttccagtttaccttctgttgtctacagcttttttaattttaaggtttgactaattgtatccatctcattgtacagtgttttagttgcaagcagaaagtagaatttggtataaagcaggttatttctatattgaaaggagtacagttgaaattgtagatttaagattgttaaaatcatgacaattctaacttgtctattctaacctattgtgtacaatctgattttttaaaattgtaaacatgtatgatcttggtttcatgtgtttttgaaagtgttattgtttaaaaaatgaaaaaagcatatctgctaaagagctgtcagttttcattactgactctgtaaaatacactgttctttgtgtactgtgtgttattttgccagctgctgcattagccttcaaaagtatttggaaacttaagatgaactacatttcttgcaaagtacattcctttctgtggtattttgtcctgtaactgaagtatagtaattattttatggaaatgttagcaattctgtaccaactttgaataaaatgaaaaatttataaaaaaaaaaaaaaaaaa

SEQ ID NO: 2742 - DNA, 810 bp, Homo sapiens
gaattcggcacgagccggagtcctttctgtattgttgtgattttgcttctggagtgtggagctcgtaaagtcacactcgtcctacagagcaacccagtgttttgcctttgttcatgatgtatgtgatgatggcttaccttacccttttccagatgggatcctggatgtcattctccttgtctttgtgctctcttctattcatcctgacaggacattgtttatctgaaaatttttatgttcgaggagatggtaccagagcatatttctttacaaaaggggaagtccacagtatgttctgcaaagccagtttagatgaaaagcaaaatctggttgatcgccgcttacaagttaataggaaaaaacaagtgaaaatgcaccgagtgtggattcaaggcaaattccagaaaccattgcaccagactcagaatagctccaatatggtatctacactcctttcacaagactgaactttgtaacatgttaaggtacaaagccagaggactgtgctattcaaggactactgtaagtctattgtttctcaaaagacaatgagaaaaaaagaagagaatttgtatttcctgccgttttgtcataggtgagctcctttgtgcattttaagcacatgtaagtggttcagcacagtatgcctttttctgtgctttgaaaacttgatatgctcaagcttgtttgaatttattacatctaaccattttgcttgttccttgatttttataagcattcaattaagttagtattatgtcaagtaattttgagaaaatgtaacttgacattttttgcaagtaaaaaaaa

SEQ ID NO: 2743 - DNA, 804 bp, Homo sapiens
gaattcggcacgagcggcacgagcttgaaatggcgtcttctgatgaacactcatccatccttcaaggtctactctctcatcacagcttgtgactcttccactttttgaactggtgtttcccattcccagttcacagagccctttctcattgaactatttatctgagttccctctgccggaacatgagccatgcctagagtagccacctagtagtgagtgacagctctgtgctggatgcacataaatggtctcccttaactgccatgagscctaaagaaggtttgctacagctattttacagatggggaaaactgacagagagatattaatgaattgcccacatgcaaatatgtgctgagtcttggatttgcatctttatcgtgactccacggagacccaccctctaagaccagagccagtgtcctattcatcttttgtctctgcagcgttcagcatggcactgtcttggcttacaaaatctgctctatgcttgctgactgctgaatgaatgaatgaatgaataggtagtcacaaagaatgtttagaatgtttctcagacaggctgagaaaaaacacaacgaaacattatttccgtttggaaagtttttttatttttgtgttcagtactgaagtaaaacaaaaatctgaataacagctgcaccgttaaaaatgaaattaccaatatatgaactctaggcatcatgcatatataattttttgtagataacttttcttctcattttccttctcattctcttcatctttttctttttgtttgagcaaaaaaaaaaaaaaaaaactcga

SEQ ID NO: 2744 - DNA, 1446 bp, Homo sapiens
cggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatragaaaggcccagaacgtgcaggtctgcggaggggaagtgtcctgagtgaaggaggggacccccatcctgggggatgctgggagtgagtgagtgagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccstagacctgctccccagaggaggggccttgacccacaggacgtgtggtggcgcctggcactcagggacccccagctgccccagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaagccaaaaaaaaaaaaaaaaaactcgagggggggcccgtacccaattcgcca

SEQ ID NO: 2745 - DNA, 1445 bp, Homo sapiens
  misc_feature (1047)..(1047): n equals a,t,g, or c
aggaattcggcacgagcggcacgaggactccttctcttctgcagaagcagatgggaatatgctcttttaaactatgagatactggacagacatgaggaggaactaccgtgtcacgtatcaagtagtgttgttatttctgtgcttctccctcctaacagaatgtaaaacctttgaacccaggtcagagaggtctttattttcatatcccctgtgatgtctaatttatttggatttacagataaatgatcggtaaactttagaaacagcactccagtttatagctctgtgctgtagacttactgaacaactacagtgaaaccaattcaaaaagggatattttgtattatgatttagtctcctacttccaaggctagtttttaaggctgtgaagggaagctgaaaatgacacagtgtttctgggatgaccagacagacactgtatccagagatgctgtctgcgcagcgggggatagtaaaccccttagtacaacattaattggcatggtggtttatgagttaatgtaataccaaatattaacataaataaaaatatatttaagtgataactaagctggacatatatcttaaaagacaactacagcccagaaaacaatgaacattgttgtcctacagctattttgtcactgtgatgatacctaattttaatcttaaagggagctgatgtttataacctagaagttgattttgataacatttgagaaaacttcataaagctggcacaggtaacatatttagttttgtatatctgctgtccaatttgagtctctaaaaattatcttagaatgaatatgaaattcgcaggtataaagaccaagttttcagaaataaaaaatgtccaagtactttgaaacatctatttttcactcattattcagcctaggatattagcacttgtgtccttgaacagagatgagaatgtttgttatccaaagaccaggaaggtcaccagccaagggatatacagtcgtgcctcatcttctgtgcctttgtattcctttatgctttgtagcttaacaaaaggttttnccttgtacttgttaagtttccatatatttgttaaatatatacttcacacttcacagttgctcatgtcagaacagactattgaaaatgtaaacctggccaggcacggtgctcacgcctgtaatcccagcacattgggaggctgaggcaggcggatcacttgaggtcaggagtttgagaccagcctggccaacatggtgaaaccttgtatctgctaaaaatgccaaaaaattagctaggcatagtggtgcacgcctataaccccagctacttgggaggctgaggcaggagaattgcttgaacccaggaggcggaggttgcagtgaaccaagatcacaccactgcactccagccwaggtgatagagtgacactctctcaaaaaaaaaaaaaaaaaactcga

SEQ ID NO: 2746 - DNA, 1106 bp, Homo sapiens
  misc_feature (374)..(374): n equals a,t,g, or c
  misc_feature (405)..(405): n equals a,t,g, or c
  misc_feature (864)..(864): n equals a,t,g, or c
  misc_feature (988)..(988): n equals a,t,g, or c
ggcacgagctcgtgcgaattcggcacgagtcaacctctcaaatacctggaatgacaggcacatgccaccactccttgtttagttttttaattttttcattttttctagcgattgggtctccctttgtcgcccaggttggtcttgagctcctgggctcaaatgatcctcttgcctctgcctcccaaagtgttaggatcacaggcatgagctactgtgcctggcctaaatcatattcatatcactaacccagtattcctgggytaaactataaatatcccaggaaaaartctttgtttgctgcaaaactgtataaagctggaatcaaatcccagccctgccccttactaggttgatctggaraagtttttaacctntttgcaacttcaaggtccaccccgagtcctnatctataagatagggaggacaggttagctaaaaggaacaaatggaaatacctagtaaagtaactgataaatatgccaatgaactgtatttctggtaatacctttactgagaattagtctgcaagactgattaatatccaatgtgatggttaatgaagaatgaagcattctagcaatctgacatgggccccctgtgtaaaagggatcgcacacacagagaaaaaagaagtaatattgggagagaacagggctttgcttaaacagaacagtatgggccaccagcagcagtgagagacaggtaaggcctctgtgagccttcagtcggcagtgggtcataagaaaatagaaatagtgatcaaaccaggaagagagaatgaaacccattctcactcttttaaaagcttctgtttggagtaagcccaatggggagccatcagtgtctctgacatccatatcatcntattatacttccttagctcaaaccacactcaagaaagcacaggaaatcagaaccacagtggaagatggatgagaagctggaagaggaagtgttcagcaatggcacaccattctttgccttattntatgtccctgagcttgttcagcaacagcagcaatctttcttaaaccaaagggatccatgcttggatcttcttcacaggggacaagcctgcaagccagataccatttccctgctaacat

SEQ ID NO: 2747 - DNA, 586 bp, Homo sapiens
gaattcggcacgagggactaccaacaagtgttgctggacgtccggcggtcattgcggcggttccctcctggtgagaagctctcccggtcctgccacatttggaaagactgtatctgttccaggtcataccatgtgacctaatatgctggaccctgccgcctcagggaccttcagagctctccttttgctgagtcatccttttcttgactggtcactttcagacccccactgtgaaagcctgaaccaaaaataatttctcctggcctagaggtggtgaatgagagaagaggtttttgtttttccttgaagccacaaaaaggagttaataaggattgttagagccatcagtctggcattaaagagcagattggtgtggaattgggcaccaacaagaatgagtaatatcttaattaggtttaaaaacgatggtaccttgcgcatacatatgtaagattccttagagggaagagaggccattccctgtttgtgtaagagtatattccttaattaacaaattaagcagcaatagataaaaaaataaataaataaaaacaaaacaaacaaaaaaaaaaaaaaaaaaactcga

SEQ ID NO: 2748 - DNA, 1508 bp, Homo sapiens
ggcacgagcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaaaaaa

SEQ ID NO: 2749 - DNA, 1471 bp, Homo sapiens
  misc_feature (1470)..(1470): n equals a,t,g, or c
caaaaaataataatgataatttaaaataaataagtaactaataaaaagattttatatcccagtcttatgatgttggttggcaaggctagataaaaagatgttagaatgaaagaacatatttttagtgatatgtaaatgaaggattctacaatagtcatatatttttatatgaatgaatgttgggttgggctggagaggtatgtgtgtgtaaatataaaggtctcacattcagagtatagctctgaaataatggaactcatgtctacaattcaacatgcatctgtatagttacatctcatgtaaatatacacagacatattttgcagccagtaattgacagttaatgtccaaaacaggtgattgataggtaacagaaattagataaccaccaattttgcccaagagaaagactagaaggactaaaagcagttgaatgtatggtactgacattgtcataagcagtctgataaccagtttattgaaacgtgtgcattaacagagaatttaattttaaacccataatttctcctatccattaaaatattataattgttagtagtatgaaaccaacaggaaatgttttttaatcatttagtgaggtgattcatttgtttcatgggcaaacactatccaggaaaagccttgcttgcctgtttcccaaagagctctaagaaatagaatcaagtgtaaaatggttcagaccattcaggatttcttgtcactcttctcaaccccgatcttcctgttattactgatgtttgaaaccctgtcattagccccggcctggttaaagcccctcagagtcacctctcattcatagcaatagaattcaaccccaagtggttgatggtgtccccagcacagccgagagacctgatctctggattcagtgcttttagctcttcgagtttaccctaagataccttcgggcaatatttttaaccaacccaaaagctcttcaggtcatttctgaagaggacaaggtgaatcttggcttggaacaccatttttgggctcttgctactgaatgaatcagaaaggaattttttctgaagagcattagaaagtaaaggagatgttaaaataagttcttgaagtatgttttatatttatctaaaacactgattttaaaagtttacattcaaatgtgtattcaaaagaagtactgatttgtaattattatagtttgtgtgtatcatccccttttaaccgtgcctaacaactgtacttaaattttgttttcctagtgtaacaaatgtttcccataagattttctagagccaaataatgggagtgaaaaattccttaagtgttatataagaaaatatattagaaaatcagctttggattatacgatttctaaaatatactaatacagaatcctcagtaatatgttttgaattggattttttctcagaactgttacataataaataatacatcaaccagaaaaaaaaaaaaaaaaaattnc

SEQ ID NO: 2750 - DNA, 1910 bp, Homo sapiens
ggcacgagatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaaaaaaaaaaaaaaaaaaa

SEQ ID NO: 2751 - DNA, 3036 bp, Homo sapiens
ggcacgagctcgtgccgaattcggcacgagctggtgcctctttctcttaagtccaccaatcctactggattagggttctacccttacgacttcatttaaccttagttacttcataaaagccctttctccaaatactgtcacactgtgggttagggtttcaacgtatgaattttgaggggacatgattcaacctgtgacagtgagcattctcagacctacctaactcctgttgtagtccttattctgagtggtcctcagttctctgagtggccctgaccaggtgtcatgcccacagtggagcagtcgcctcaatgattgctctcatgggcacataggcgagtcctctggggggcattgcaagcctctcactgcttagttccccatgggaaagctgaccttaacactactgctttgtctacttcagctcctgccaccagaagtatactacagcaggtggggtgccaacatgatggctcaaactccgctaaattccatgaggtccccttggcctatggaaattttattatttttccccttattctcctcttctgtttttataggctcagcatagatcaacaggtccactacctatacagatatccaaatgggcaatatgatacagtgccccatttttatcatacaaaggcattgtctactctctgtgagagattattctggagtcccttgccgagccaccctttaaactttagaaaaggtacaaaataatttctgagacactcatgtagcatccctatgaggtcaattccaaagataccgatgactcccttttccctctccatgcccaagtctttaaatagatagattggtgtggatagacagattataaatgagaggtaggtggatagacagacaattgaagggtttgctcaattatacatgattcatgatagatacataaattcatagctataggattgattgatagagggtagatgccagatggatggatgatgagatagataataaatgataatagctagctagctagataactgcatgggttttgcttcttccaattaagccccgaagaagtgagttggtgccccaatgttggtagttcttttgactgagtggtactgagcacatgttgttttgtctgtgtgctgtagagcaggggtcagtaaactatcaggccctggaataaggccaaagaatcatatataatctggggcctgtttttgtatagcctgtgagctaaacatgggttttatatttttgaaggtttgtgaaaaagcaaagtgacaatggcaatggcaaagcttagaatatttaatagtatttaatagaaaaagttgactaatccctactctgaggccagtttagaggcaatagaaaatgttcctttcaaaatcctgttacacatttccctgattttttcaggtgaggaaaagggagtctgggatggggatttagcatttcttttttggccaccacagaagattaacattaataaatatttattaagtacatgctgtaaaattagaactgcgtttagtgagaaagtggtacaaaagaatataagtcaaaagagttgaccctcaaggagctgcaaactcaggaaaactcaagtcatacatgtgaagtgtgaagcaatagtacaaaacaatctatgactaaccagctgaagaaatggaactaacagtaattgctgttggattaagatggtaacaaaatctgcacaggttgaagtcaccagggaaaaagagccatggttttgactttaaagcatgtttagagatgtgtaaattcccccaaactgggaagccaagatttaagtgcttgtaatttcctggtacttaggaataccaaatatccagtgacttattaaaataggagagtattggtctaggagtctgaactccagagccatctaaacagtggaattattcttgaagaatttttaaagagatttccagtaatattacttgaatcatgggttgctattattcatggtgtgataatctgaatgtatgtatcctttggtgatgttgcaaaagcctaatcccaagacttcagacaggattctgaggatcataaaaattcatcacagagccctcaagccttcgtataatttggagagtaattactgctttacactgattaacactggaaaatcttttaattgacataatgagaaagaaataccaatgatacaatgcatccacaagatactggggctgtacaggttctgctctaatcatatgctgaatgacgtcaggttccagatattctggacaagtaacttttcattcttcttagctggtgaccagctctatttatataaaatctctcagggttaaaaacctactattgtgcatttatctagcaaggggctgggaatgaccagcccttgtgatctgtcaatcatgagaacatgaagtttgatttttgaagtattggatgaaaaataattgtcaaatacattcttgtaatttttatcactctaattgccaacaaagtacttgggcaagacttggggaactcatcctctcactgaggttctaggatccttatttcaagcccatttcattccataactgatccagaagtcacttttatagacccttatagaatcaccctttattatattcaagcaagtgtgtgccttgtgtagtttagatatgccagtactgttgtctttggaatcaagagatgagttcaaattactagattcttgtgtagtatatctatgactatataaaaataatttcaatactactacagtagtttttagattgtaaaaaaagctgttgttgtttatagccacttgagataactgaggaacattttttcttttggccaaatatgcatttttctgagacctctctggaggggagtggaacgttacaactagaaccaggctctgggaaatacaaccacatctgtgtttcgtaatgattttgaagctagattttagttgtagggattttttgtctattctgccaggggtattaacatactcacttcctgtaaaaagatttaaaaaaaaaaactaagaaaaaaaaaaaaaaaaaa

SEQ ID NO: 2752 - DNA, 3086 bp, Homo sapiens
  misc_feature (1)..(1): n equals a,t,g, or c
nctcgtgccgaattcggcacgaggtcgcctcagcgccggctcccggccgggccgcggccgccgaccgttgagccgccggctgagccgcctgctgaagtccctccctcaggaacccctccgccaccctccacctccgaaccgctctcgcggcggcgacccatgtgggggttcaggctcctgcggtcgccgccgttgctgctcctgctgccgcagctcggaatcggaaacgcctcgtcctgctctcaggccagaaccatgaacccgggcggcagcggcggcgcgcgatgctccctctcggccgaggtgcgccgccgtcagtgcctgcagctttccaccgtgcctggagccgatccgcagcgcagcaacgaattgctcctgttggcggcggccggggagggactggagcggcaggacctccccggggacccagcgaaggaggagccgcagccgccgccccagcatcacgtcctctatttccctggggatgtgcagaattaccatgaaattatgactcgtcatcctgagaattatcaatgggaaaactggagtctagaaaatgttgctaccattttagcccaccggttccccaatagttatatttgggtgataaaatgttcccgaatgcatttgcacaaattcagctgctatgacaattttgtgaaaagtaacatgtttggtgccccagaacacaatactgactttggagcttttaagcacctttatatgttattagttaatgcttttaatttaagtcagaatagtttatcaaagaaaagtttgaatgtttggaataaggactccatagcatctaactgtagatccagtccttctcatactacgaatggttgccagggagaaaaagtgaggacctgtgaaaaatctgatgagtctgccatgagtttttatccaccatcactaaatgacgcatcttttactttgattggattcagtaaaggttgtgttgttttgaatcagttgctttttgaattgaaagaagccaagaaagacaagaacatagatgcttttatcaaaagcataagaacaatgtattggctggatggtggtcattctggaggaagcaatacttgggttacttatccagaagtcttgaaagaatttgcacaaacaggaattatcgttcacactcatgtaacaccttaccaagtacgtgatccaatgagatcttggattggaaaggagcacaagaaatttgttcagatacttggggatcttggtatgcaggtgactagccaaattcattttacaaaggaagctccttccatagagaatcacttcagggttcatgaagtattttgagattacaggtatattaatgaacttgttcagtggaagaacataagcacttttgagtgttataaattcagataatgggatgtaattcatagctgcattgtcagttttggggtatggggggaagcacacattcctaaaatgtgagtgtaatgtgcaatagtattttttgcttgtgaatgtgagcagttattaatttggattgagttagaattagttaatttgaaatctaacaaggtggtttgtaataatgctgaggagatataagacccttaaaatgaaagttacaacattgttcttataaaaggtaactaaaattgttactgttggaaataactgattttctgagtaatgttttaaactaatttggtgacattttaacagtaattagctattttgagtggaaatattttcatttctcttcaaacaaaagcaaaggtacgatgctgttttctatcattttggaataactgcaccctgccttttgtgtttttgtaaactccttgactcattctttcatgtgtcaccaagtacttttctcatgagagtcaacatatatttgtttccaaatgtccacaagtgtacaatagtgtaaaggtggtttttaaaaacatagccaggtgtggtggcacgtgcctttagttccagctactcaggaggctaaggcaggaggattgcttgagcccaggctgtgtggttcaccataattgtgtttgtgactagctactgcactccaacctgggcaacatagtgggacttcatctctaaaacaaaacaaaacaaaattacacttaagcactattgtttaatttttaattgtcagtttatcattattttgggtaagacattctggggtttcttgaatcttgtccaaaaaccagttgttttggaaaattgctttaaattgagcatatttatgtatattggataaaaatgtactacagagcaaatttcaaatttttcattatatcagtctttttgaaaggatcaacttggataaaataaatatataatgctctatttgttagagctctattaaaaaggaaacagattccatagatctaagtcaatgtttctccagaagcatgattttgtctgccaaaagaaaatagctctctttggccaaaatgcaaaattacattgctataagaaaagttacaagggaaagtttgaagacacaaatgatttaattttggctcaaaaactgaatttgcttaacactgctacataatttgggtgaagtttccttctgcccgtttttcttgacctagataaatacactttgagaaatccagatctaataaatgtcaaccaacattgacattgtaattgggtgattacaataaaaggtgagcagtttgttgtttattaataattagcttttgcaggtaatgaaatagcagggaagtaacatgctgctttaggactaaaaaaaaaaaaaaagacactgaagcttaataccttaatgacccagaagacctagatttataaagccatatagaataaaaatgttaatttcttggtttcttcccagaattatattttaatgactccataaatacattccaaatattcagagattcatgagaaaggattcttaacaaatgtttaaaaataacatttctttttggtgttttaacacttaattttataaactgcagaacagcatctctaaatggcttttttttttttttttaaagacaaagtagtattatgttgctccagtttcttttaaatacctccgtttccttttggagaccaaaaatccccatcca

SEQ ID NO: 2753 - DNA, 1382 bp, Homo sapiens
  misc_feature (1382)..(1382): n equals a,t,g, or c
gccggctggcagcacgactcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggaggttgcagaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaactagtattgcaataagcaaatgcaaaaatattcaatagaaaaaaaaaaaaaaaaaaaaaaaaaaaaaaaan

SEQ ID NO: 2754 - DNA, 3145 bp, Homo sapiens
ggcacgagatttaatagagctagctcttggtaatggtgaaaataatgagttttggttggttttatttggcagatgtttttagaaataaaagtacttagacctagtgcagcctctaggaaaagtcttgccttttcattagagaaaacaggaccaaggtttcagttttcaaacagctgttgttgaatgtgtagaacccagttccatctgttttggttcattgttacagaacttagtccagtcatttgggctaaagccaaccaaaagcttagttgcctttctcaacaaacactggtactggtatacttttgtagatgaaaccatcacaaggtatttagtgttaacttgtgtgccaaattcagatcactatgtcgttgttgctctagccttcagtgtcataacacaggggggataaaacagaggggatgagggaaatgaattctgttaataattattcttcctggtatgcctgttttgcttcacaaaggctactatcatgctggatagataagaacaggagatggcagtggaaagggattgcttgttaccacagagaattctcttcaaattaagatatgtcattagaatgcttggaccagtcaatcttttgtacttatttgaaaatataggaacaatttagcagctgcaaatatgcccaagctatttttaatagatatactaaacttattgttgacaaatttcagcctccttaattttttttttttttggtaattacctataggcttaaaagtcattcgttgctgttctagtataattagtagttccgtgattgaaagtttattgtaattctactatcttcaaattagatacattttcaaaaggaaaagataattttttagaaacatcttaatattcactatttcctgaaaaaatccaagcagttaacgctttctggatggtaacaaagtaccttctaaaagataagtgctatgacaccatgtatgaatgtaattctcttagtaatttacctctgactatttggtgtcttaacgctttggtttatataatctcaggggttgtctgcaaaccaaaactgacatattctgtggttagcttttattacttttttttttaacagaatgctttgctttggttatatttcttctttcttcttttgtcttatatggattaataactagtctccatgaacttcacttgaaagagcctgtaaaagttagatgagtctaaaagtgctctttgaagtagcagcaaattgggagtatatgctctgttatatagaaataaattgtccttgctattttcttacatttagctttgctagattgtatatacattgagctaagaccttaggaaattcactttctgcatgataaaatgacccaataaatattccactttgcttaataatgtacatacagtgcattattttttctatttgtagatgaatttaatgacagataattgtctgttccccgctgaaactgaagaaatctagtttttttgtgaacatttttgtggtcttatggataaggtacatgaagatttttgcagcagtattagtggttcagtggctgcactttattaatcagtgtgttaatttttgacagtgattggactagaccttttcaaatagagtctgagggtatcagacagtgaaaatgtgctgtaactaagtagcatgtaaatcagttgattgtaaaacgtttcgctgggaacttattttagctatattttacttcagacagattatgatacaataatctacctgtgcatcagttagtaggtgctgcagggtttcttactatttacagaaacattttgtgcagtctttgttataaattttcagaagactatactctttactttgaaggtctattttttaattatacctcatttagctaactagtattctaatacctggtagaaaaacagtgagccagcctttaagcatctaacaaaatttagactctttgttttgttttgaactgaagacatcattgggaaaggtaggaaatattagtttaggatagagcatacatgtcatatccagtagcataaaaaaagtattatctccctgtctccattaataaatttagctgtgcaatataggtgcgtttttgcagaagtttctagtaagagattataactccattttacaggttctgaatgctcagagtctatattaaggcttataaagtttttcctgtgatcagtaagtgacacatttaagcagacattcttttcaagttcatgacttagattcctttacaaatttagttctcaatctttaaaaaccacatttcattatgttggttaattattataaattttaagcactcatttctgcaatcaggtttctcagaattttttttttttaaacagaagagacattcctttttccttgttacatccaaggggggcacaggggtgggtggaaaggaatgtctaaaaatgaaatcccttgatatagagggacctagacggacaggatatgctaaaataatttcaaattctagcacaattttagagtagaataagtcatttttttagactaataaaattaatggctgtcatgttcactctgaaaaaaatctaaatgactgaaatgtacagaaataaaaattagcaaacaattattctagggatattttcagattttacttcatttcttgaaatgcgtgtgccatatgcaattgcatttcttgtgccaagaaactaatagaacttatttcactttacctttttttaaaatgtgaatttagttattatagttcaattttatggccttacagatggcttttattttgtttgcagctgacactgcagttcctttcatgcaaaataccataaactgtttgatgaaaatcatgcccctaatggaaactctctagtttttccatataactatcctactgtacatgtttaaacatattttatttttgctccaatggcttaatgtgaaaagctcctgcagataagtggacctgtcatgtggttaatcttgtttaagccaattcattaactgtgtactgatactgatgctatgttttttttaaatggattttattccaggtgaactttttttttataataatgttcgtctaaaataaaaactacataatgaaaatgaaaaaaaaaaaaaaaaaaaaaaaaaaaaaaaaaaaaa

SEQ ID NO: 2755 - DNA, 1502 bp, Homo sapiens
tcgacccacgcgtccggaaaaaaagagaaagggtggaaaagagggattccagagtgccaggcacacagattttctggaaggtttacatgaggactgctgtggtttgaatgtgttccccaaagttcatgtgttggaaactcaacccctaatgcaacagtgttgatcagtggaacctttaagaggtgattaggtcatgaaggctctgccctcatgaatggatgaaggtagggtgggttagttatcttgggagggggttcctgataaaaggatgaggttggcttcctccctttctgtctttccccttctccctctcacatgtggtcactctcttgcccttttaccttccagcataggacaacacagcgagaccttcaccagatgcaggcccctcactttcccagtgttcagaaccataaaccaagtgaacccttataaatcacccagtctgtggtattctgttatagcaacacaaacagactaagacagggacactcagtgagctcttctctctacttgatggagcactccctgcgtggtgccttgtatttgtagacatgatgctgtaaatgctctttgagtgtctcgaaggcttttatgtttgaggagtttacagagaagcccgtacagggttcaggtccattctgttgcttctttgctccttagttcctcccctaatctgatgttaaattagatcatagtgtggtccttggaccaatagtatcagtagcacctgaaaatcatgctggaaatacagattcacaggctgctccccagaatactgaagaagaaactctaggagtgagacccaacaatctgtgtttaacaagtccccaggtgagtctgatgcacaaagaaacgtgagctgctgtattagatggtgttgagttcatgccaccgaatcactgacacacacatctgctcactgcttgctcttcgcacaggcccctggatcctcctggaatccctgatccctgttgctcccttgcggagttttctagtccctcttatttgaagcatgtctttcagagcctcgcaccacccagcttgggtatctggtgaattctgtggtctgcatgtccatgtttttgacattctgggaagggtggcccaggctgtgatttgccatctactgctgcaggctatggatggtattcagaagggaggggagatgctgtgtgcgtgttctgaagggtttcccactaaatggagagactgactctctccataagtatttgatttttactttatctcctcgttgacttcacagtgtaagtgcagtttgtctctactgggtgatgcatgcagataaatgtttatgtgaacataagaagtctgcatgtgtgggtgaactctccacatcatgtcatttattgtccatcattacgtatctgtggtgtctagcacattcctctaccttattttctgtcattgtacctacttctacctgaacacgtattaaatatcttattaaaaatacacaaatattaaaaaaaaaaaaaaaa

SEQ ID NO: 2756 - DNA, 719 bp, Homo sapiens
  misc_feature (234)..(234): n equals a,t,g, or c
  misc_feature (279)..(279): n equals a,t,g, or c
  misc_feature (352)..(352): n equals a,t,g, or c
  misc_feature (719)..(719): n equals a,t,g, or c
aaagggaatgacgatatgggaaagaaaatacatttggatgttacagatatgtgtgttcctggagcccaggggccaagcccctccctgggggacttggattggtgatctctctccttggccccaacctgacatctttacttgtccttttaggaatgtctgatggaaattcctcctaacctggggtcatactccatttcattctctgggctcagtgagagggaaaatttttttttnaagtaatttactgaaaacccagatcacaccatcataaattccagnttaggtgcaattctgcccacaatgaaggcaaagtgtttacactaatttgaaaaacagttttagcctcttattncccccaaacttcattcttgaattttgtaaatttttgtgggcaagctgtgggaaaggggcacaaaagtatcactggaagtattttttcaaaaaaggaaaaaaggcagtcttcctctactaatgagaatgcaaaatgttgaacaactgtaaaatgttttcaccctgcttttagacataaagctttaaaaaactgtgaggtcttttatcacttccccattgtatatgtaatatggctccagataattactctgccacggggtgaaaatcttccataactctcccctatatatatgtatactccaccaccttatcttgttatgtcatggtggtgggagtatttataccacagaaacaggcaaatgatacan

SEQ ID NO: 2757 - DNA, 738 bp, Homo sapiens
  misc_feature (1)..(1): n equals a,t,g, or c
  misc_feature (14)..(14): n equals a,t,g, or c
  misc_feature (66)..(66): n equals a,t,g, or c
ncggaagtcggcgncacgtagtagggaaacctgggacgccgtgcaggtaccgggccggaattcccngggtcgacccacgcgtccggtcaataactgtcatagtgaaaatgtggtttttaagagtagtagctacttatgggggtgtagaaagaatggcctctctcttagacaatttcattttaaacatcatagtcatcttttgcatagtgattgactcctatctttgtggtttcatgtatttctttgtgattgattccccagtgcctgcctgcagtccattgcaactctcccaaactttaatcctgcagcttcagcccactgctagatatttccattgatgacctgtcatctgaaacctagcattcatcatgtgctgtgttgtataattgtatgtctgtgttattgtattactttcccaagtaaagtttttgtgtaaggacttaacactgctttgaatcccctgtacctattatactgctgtgtacaaagtaggagttcaaatacatgtgatcacaatagtcttccattcataactcatcagcagctcagtccttcttatgtctagtctcagttcattcagccaaagctcatttttgtcctatccaaagtagaaagggttcttttagaaaacttgaagaatgtgcctcctcttagcatctgtttctgactcccagttatttttaaaataaatgatgaataaaatgccaaaaaaaaaaaaaaaaaaaaaaaagggcggcc

SEQ ID NO: 2758 - DNA, 1548 bp, Homo sapiens
  misc_feature (9)..(9): n equals a,t,g, or c
  misc_feature (397)..(397): n equals a,t,g, or c
  misc_feature (1538)..(1538): n equals a,t,g, or c
  misc_feature (1542)..(1542): n equals a,t,g, or c
  misc_feature (1545)..(1545): n equals a,t,g, or c
aagggccgnctggacatggacggcctggaggtggtggacctggaggacgggaaggacagagacctccatgtgagcatcaagaacgccttccggctgcaccgtggcgccacaggggacagccacctgctgtgcaccaggaagcctgagcagaagcagcgctggctcaaggcctttgccagggagagggagcaggtgcagctggascaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagccagggcgcaagcatnctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtragcagggatgggctggggagttgcttgtgccaccaagacgtgccaggtctgtactcctgttgtctttttccctgctcctggtgccctgaagagaccagcaarggggcagaccccgcactcgccacaccgccgctgcagcttgggccatccgccctctggacctgtgtagggcctcactgctggagcggggaaacscagctcagcccaggccmagctggggagaaggcgctamctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaaaaaaaaaaaaaaaaagggcggccgctctagagnaacnagngaa

SEQ ID NO: 2759 - DNA, 1558 bp, Homo sapiens
  misc_feature (1443)..(1443): n equals a,t,g, or c
  misc_feature (1460)..(1460): n equals a,t,g, or c
  misc_feature (1494)..(1494): n equals a,t,g, or c
  misc_feature (1537)..(1537): n equals a,t,g, or c
  misc_feature (1543)..(1543): n equals a,t,g, or c
gggtcgacccacgcgtccggatttttatctgcctttttttgtctggcagtcaaactttcacagtccctgttaactcctgtttcttcttaactttatttcctagcagtaactctgtgcataatccatattgttcagagtttcactaagtaagatgtaatacagcccactgctgatttactgatgaaagaaaatcacttataagatgaaccctgctgtaagacagagatgtctcttgttttgttttcagcagaagctgatcctgtctcattttttcctgctacaggttcctcagtggtgtgctgaatattgtctttccatccactaccagcacgggggcgtratatgcacacaggtccacaagcagactgtggtccagctcgccctgcgggtggcggatgaaatggatgttaacattggtcatgargttggctacrtgatccctttcgagaactgctgtaccaacgaaacaatcctgaggtattgtactgatgatatgctgcaaagagaaatgatgtccaatccttttttgggtagctatggggtcatcatcttagatgatattcatgaaagaagcattgcaactgatgtgttacttggacttcttaaagatgttttactagcaagaccagaactgaagctcataattaactcctcacctcacctgatcagcaaactcaattcttattatggraacgtgcctgtcatrgaagtgaaaaataaacaccctgtggaggttgtgtaccttagtgaggctcaaaaggattcttttgagtctattttacgccttatctttgaaattcaccactcgggtgagaaaggtgacattgtagtctttctggcctgtgaacaagatattgagaaagtctgtgaaactgtctatcaaggatctaacctaaacccagatcttggagaactggtggttgttcctttgtatccaaaagagaaatgttcattgttcaagccactcgatgaaacagaaaaaagatgccaagtttatcaaagaagagtggtgttaactactagctctggagagtttttgatctggagcaactcagtcagatttgttatcgatgtgggtgtggaaagaagaaaggtgtacaacccgagaataagagcaaactcgctcgtcatgcagcccatcagccagagccaggcagagatacgcaagcagattcttggctcatcttcttcaggaaaatttttctgcctgtacactgaagaatttgcctccaaagacatgacgccactgaagccagcagaaatgcaggaagccaacctaacaagcatggtgctttttatgaagaggatagacattgcgggcctaggccactgtgacttcatgaacagaccaggtagccttatgctcccatgtcagccaggcattaggctgagattcaccttctcctgcccattctctgtcctgagttcacattgatggcgcanaattgcacacaagcatnggaggggggcttggttttggacttaaggcttttnctgctagagcacccggaaagttttgatgccggctttgggaggntttggnttttttggccgcatt

SEQ ID NO: 2760 - DNA, 1425 bp, Homo sapiens
atgcaatttgaccctacttccctctcagtcctaagggcctatctttcatcactaggttgaattatctcccatgtttgatttgcctctatctccctatgggcttgcaacaccatgacgggcacattgcaagtgcacttagacaaatgagatcagatgacctggggaacgtggcttgtacacacctttctgtgttctgtagcatcagctaagaccttaaaatcagtaagaaagtatctgtctctctgttcacccataggaagcagcttcgtggtgagtgaagggagctacctggacatctccgactggttaaacccggccaagctttccctgtattaccagatcaatgccacctccccatgggtgagggacctctgtggacaaaggacgacagatgcctgtgagcagctctgcgacccagaaaccggtgagccatgggagccgggatggggatagaaggtgggagaggctgggttgaaagaggcattgtgctccctctacctaaagaaccatggattctgagccattgacaagtggctgaataagaaggcccatcaatctaataaacactaatgtatgtgctgccattgcctttcaaggggggaaattcttagagagccacagactctcagagtaagaaaggaccacagagaacatctggcctagctccagacaagcaaaatgtctgcacttcagatatccctgcattcagagcctatcttcttggtactagctgggtgatcttgagcaagacactgcctacctttcagtacaagagaatgaaaatagcaccaacccacaaaactgtcattaggattgaatgagaagctgtgtggaaatctcacagcatattcattaattcactcaacaggtatttctttagtagccaggcatatttttaggtattgggaagacagcagtgatcaaaatatgcaaaatctccaccctcatgaagcttacatgctagtggggtagacactaaacatgcactgtggaatatggtagccactagctacatgtggcattttattttaaattaattgaaattaaataaaagtaaacattcattttcccagtcataccacccagatttcaagtgttccatagccacacactagcagctacattgttgcacaacatagatatagaatatcttcatcactctgaaaatttctatgggacagtgctgcagtggtcaaacaagcaggtaaattatatgactctgttaggtgatgatagatgccggtgtaggggaaaagaatgatgtacaaagcatgtggagtgctaagctgggagtttgggtggagtttcattatacagaaagtggtcaggggaggcctctctgaggtaagaggatcacttgagcctaggagttcgagtccagcctggacaacatagcaagatctcatctctaaaaaaaaaaaaaaa

SEQ ID NO: 2761 - DNA, 776 bp, Homo sapiens
cccacgcgtccgcgctgagggaggggttgcttcgtccccctggctctcacccacctgtctcccacccccgtgatgtgactcagctgctcaccctactagagtctctttcccgttcctttgttctgtgtctggccgtgggatgggacacgggcggaggctgggaaggcacctgctggctcttcctgtcaccctctccgagcggtgtctaggctccccggtggagaatgagacacactcgagggatgggacagagctgcctgatggcagccgagagccaagcagccctagacgagtgagtgagtcccgagtgaccccggcgaggacagaagagccacctgctgagcccagcctgacccctgacctgcggcttgataacagcagagggagcctctaacctccctcttccgctggcgttgggaaacagccatggggctcacggggcctcctcggaggacctatgccgcctctccatcactcagctccctcagcgcggggaggaaatgaccgctcagttctattatctccaaagctgaaggatgatctcaagttttatcggcgaggaaactcatttgattttaaatgattttcggcctggaaagatttggctcaaggacgctggacctggctgggcagagcagagagacgggggtgtcctcggtgttaaaaatggggttgtgcgcaaatgtgccacatctgtgacatgtttattgttctttgtgctttcgcatgtagaaaaataaagcaaactttttctgattaaaaaaaaaaaaaaaaaa

SEQ ID NO: 2762 - DNA, 941 bp, Homo sapiens
  misc_feature (811)..(811): n equals a,t,g, or c
cccacgcgtccgattaaaacggagaatacagatgcaagctggaatttgaatgtttctctttctatgattgggcctcatggatatatctctgcatcagattggcccctaatgattttttacatggtgatgtgtattgtttatatattatatggcatactctggctgacgtggtctgcctgttattggaaagatatattaagaatccagttctggattgcagctgttatttttttgggaatgcttgaaaaagcagttttttatagtgaataccaaaacatcagcaacactggactgtcaacccaaggcttattgatatttgcggagttgatttctgcgattaagaggacgttggctcgccttctcgtgatcattgtgagcctgggctatggcattgtgaagcctcgtttaggaacagtcatgcaccgggtgatcggactggggcttctatacttaatctttgcagctgttgaaggcgtgatgagagtcattgggggttctaaccatttagctgttgttcttgatgacattattttagcagttattgactccatttttgtgtggttctaggatcagacatgccttggaaaatctgctaacagctgtggagcctctcttcacagaacacagacacaaggagctttgcatgacagggcagttaaagacttaccaaattatatctgtggacatcttaggagtctgaggagcctacttagggaataataactgatctaaagagttgtttctgactgaacttgtttaaaaaagcatattctactttgttcagagctgctagttcagaatccaagtttgntgaataaaattatagttaaataaatctgattttctcagagagtaatataaatatcttcctctggtgtcattttcatattttctatgttaaaaaaaattaaagacattcatttgctaaaaaaaaaaaaaaa

SEQ ID NO: 2763 - DNA, 1556 bp, Homo sapiens
ggcacgagagctgccccgtccaggttcatgttcctcttatttctcctcacgtgtgagctggctgcagaagttgctgcagaagttgagaaatcctcagatggtcctggtgctgcccaggaacccacgtggctcacagatgtcccagctgccatggaattcattgctgccactgaggtggctgtcataggcttcttccaggatttagaaataccagcagtgcccatactccatagcatggtgcaaaaattcccaggcgtgtcatttgggatcagcactgattctgaggttctgacacactacaacatcactgggaacaccatctgcctctttcgcctggtagacaatgaacaactgaatttagaggacgaagacattgaaagcattgatgccaccaaattgagccgtttcattgagatcaacagcctccacatggtgacagagtacaaccctgtgactgtgattgggttattcaacagcgtaattcagattcatctcctcctgataatgaacaaggcctccccagagtatgaagagaacatgcacagataccagaaggcagccaagctcttccaggggaagattctctttattctggtggacagtggtatgaaagaaaatgggaaggtgatatcatttttcaaactaaaggagtctcaactgccagctttggcaatttaccagactctagatgacgagtgggatacactgcccacagcagaagtttccgtagagcatgtgcaaaacttttgtgatggattcctaagtggaaaattgttgaaagaaaatcgtgaatcagaaggaaagactccaaaggtggaactctgacttctccttggaactacatatggccaagtatctactttatgcaaagtaaaaaggcacaactcaaatctcagagacactaaacaacaggatcactaggcctgccaaccacacacacacgcacgtgcacacacgcacgcacgcgtgcacacacacacgcgcacacacacacacacacacacagagcttcatttcctgtcttaaaatctcgttttctcttcttccttcttttaaatttcatatcctcactccctatccaatttccttcttatcgtgcattcatactctgtaagcccatctgtaacacacctagatcaaggctttaagagactcactgtgatgcctctatgaaagagaggcattcctagagaaagattgttccaatttgtcatttaatatcaagtttgtatactgcacatgacttacacacaacatagttcctgctcttttaaggttacctaagggttgaaactctaccttctttcataagcacatgtccgtctctgactcaggatcaaaaaccaaaggatggttttaaacacctttgtgaaattgtctttttgccagaagttaaaggctgtctccaagtccctgaactcagcagaaatagaccatgtgaaaactccatgcttggttagcatctccaactccctatgtaaatcaacaacctgcataataaataaaaggcaatcatgttaaaaaaaaaaaaaaaaaaaaaaaaaaaaaaaaaaaaa

SEQ ID NO: 2764 - DNA, 340 bp, Homo sapiens
acgagcagcagccctggcatgttcctgccccacaggaatagaatggagggagctccagaaactttccatcccaaaggcagtctccgtggttgaagcagactggatttttgctctgcccctgaccccttgtccctctttgagggaggggagctatgctaggactccaacctcagggactcgggtggcctgcgctacttcttttgatactgaaaacttttaaggtgggagggtggcaagggatgtgcttaataaatcaattccaagcctcaaaaaaaaaaaaaaaaaaaaaaaaaaaaaaaaaaaaaaaaaaaaaaaaaaaaaaaaaaaaaaaaaaaaaaaa

SEQ ID NO: 2765 - DNA, 2340 bp, Homo sapiens
  misc_feature (96)..(96): n equals a,t,g, or c
gacgctgggggcgggtgggggcgcggggtaccgggctggacggccggccggcgccccctcattagtatgcggacgaagcggcgggctgcgcggagngacgtcccctgcagccgcggaccgaggcagcggcggcacctgccggccgagcaatgccaagtgagtacacctatgtraaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggsccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgracatccttcagtactcagagcctcagtcaaggttctgggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtwttgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctactggcggtgtataccaggcagtgtgccagtttaaaaagatgaaaaagaataaaaacttttgaggaamaaaaaaaaaaaaaaaactcga

SEQ ID NO: 2766 - DNA, 2143 bp, Homo sapiens
  misc_feature (2136)..(2136): n equals a,t,g, or c
tcagacaagcactggacgtggcggccattttkttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccgcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgkttttgtttttttaggggggagggggggtttcccctcctttgcccagacttctctttgarcacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaaytgttcgcttaaaaaaaaaaaaaaaaaaaagggcggccgctcyaraggatccaancttacgt

SEQ ID NO: 2767 - DNA, 991 bp, Homo sapiens
ggcacgaggaattttgtcacgtgagctgttgggttactgagtgagtgaagttcactgtctgcaattgagcccttttgaggattcttaaaacttcagcctttttcagtctttccatctcattccccttaaagaaacacatttggactttgtctggctctctggtaaaccctgtgacctgcattactagggcacagtgacacagaaaagaaagtgtgtgtttggtaaatatttattgagcacctgcagtcttatgtttagcagtatgcatggtgcctgctcttggaaagcaaagcaaaccagttcatcagcaggttttctttgcctgcatgtsctgtgcccagccttgcagttgacacgagagaaatataaaacatggccctggccttccttcatttaaacatttctytttcccaagcacttactctgtgcaaggagctggagaagccaaagctggagaaaaacaaaggagggcctgccctcgagaagttagtggtctaatgttgtggttctcaaactcaggcgtgcgtttgaatcgtctgggggccttgccagaccacagaacccatcccctgagtttctgaatcaatgggtctgaggttgggctcgctgagaatttgcatctttataaattccagataatggtcttgcggctgggtaggcaccatggtttaagaaccactggtctggccgggcgcggtggctcacgcctgtaatcccagcacttcgggaggccgagacgggcggatcacgaggtcaggagatcgagaccatcctggctaacacggtgaaaccccgtctctactaaaaatacaaaaattagccgggcgtggtggcgcgcgcctgtagtcccagctacacgggaggctgaggcaggagaatggcatgaacccgggaggcggagcttgcagtgagtcgagatcgcgccactgcactccagcctgggcgacagagcgaaatccgtctcaaaaaaaaaaaaaaaaaaaactcgtag

SEQ ID NO: 2768 - DNA, 912 bp, Homo sapiens
  misc_feature (896)..(896): n equals a,t,g, or c
gggtcgacccacgcgtccgcctcaaggtgcctactttgctggttccctttccagcagctcccccacctcccttagccccccctcctctggcagcctctcctgcctctgctgagctcccctccacgtgttccacccccttaccctgctgttgtttacatccaacctgcctgagaatttcctctggggaggaatctattcctgtcatggtctagtgcctgggagggagagaactttctgggggtagggtgccctccatctgaaacaggccaggtgagcatcatgcayaaggcctccattctgtccgctcagattctgggtggggccacaggcaaatctcctgacttatggggagttggcttgtggttcctcccttggatagcctccatggaaccactataggctttcccaacagctgcctctgaaatagctgctgcttcgagatcctccctttttaaagcactttctaaagccctcaggatggcgggagcraacagcactggtatattctaggagtaagtgcaggaattcagcagtgagagcatgtctgggaccacctggactgccatccatttaacctcaaatctctttgggatactcgccctccctgggaaccagagttctggctctaacattgagcagctatgcactagttccagagaagccactaacaggctgccatgtgtagatgtaggttcttaagagatcacaggctgggtcatctgatcactggatggatagctcagcctggggcatttagtgttttccctggtgataaatccccaagrcagctggatttggagctggtggcaagttgaaattattaaaaattgatttgtgtgggactgtcaaaaaaaaaaaaaaaaaaaaaaaaaaaaactcgaggggggggccggtanccaattcgccctatag

SEQ ID NO: 2769 - DNA, 2273 bp, Homo sapiens
  misc_feature (146)..(146): n equals a,t,g, or c
  misc_feature (1087)..(1087): n equals a,t,g, or c
agctgactgaagccttcaaatacttcctgcagtcatgggatacattgcgtacttgaaggaccgaagctgagtggaggagcagtgccctcagccagcatgacccgcctggcacgctcccgcactgcatccctcaccagtgccagctncggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggycattcctgggtgagcccttgggcagggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctytgcccaaggaagacagaacatggagaaccgtcaggcaaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttygtggtgactgcctttgggagcccgcagtggnccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattccagtgtggtgatgccatgcccatcatgggaggcttttggagaaacagaatgtttgggcaggggctgctggtgctgcttgggttttgggttgagggtgctaggagaggatggtctccacccatctttctatttccagtacacgtcacattattttaccggtgagatgagaatgtcacaaacattaaaagccttatgtgctc

SEQ ID NO: 2770 - DNA, 784 bp, Homo sapiens
gaattcggcacagaaaaaaaagagagactgggtcttactgtgttgcccagacttgtcttgaactcctgcctcagcctctcaagtacttgggattataggccaagaagccaccatgcctagcttcttcctgtcattgatccagactaatactctggggtcagcctcatttcttctctttctcactttgcacatccacttgtcaccaaatckrgttcattctgcatcctaagtaagtcctttgattcctccagttgttcattagtaatgtctcaartgtaattttttctagtagttttcagcctgtctttcckgccttcagtcttaacttctccagtacatakgccacattgttgtcagcakgatcawattttatttaaaaatactttacawakgtttatkgccaaatattagraaatacagattcatggaaagaaaaatcactgtcccaaggaggtcactggcatggtgaggttaaggggtgattttaatttttaaaaatgtatattttttcctgtgtagagtagtaacacccttgaaaacacawtcccttgtaaagtctctaattctgtactccgcatctagstgrtctcttctttctcagatattttacaatttcatttatcaccacctttctctagcctttacccgtctcttcaatattwacatatgcagaagtttctcctaacaaacacctgcctctgcctcagttctgctaccaccctgttgctttctttcccttcacaatcaaatttaagagtgtcaaaaaaaaaaaaaaaaaactcga

SEQ ID NO: 2771 - DNA, 1638 bp, Homo sapiens
ggcacgagagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtagctatgccagcggggctgggcaggccagccgggcatcctgaccgatgggcaccctctcccagggcaggcggcttcccgctcccaccagggcccggtgggtcctgggttttctgcaaacatggaggaccactttctgataggacattttcctttcttctttctgttttctttcccttgtttttgcacaaagccattatgcagggaatattttttaatctgtagtattcaagatgaatcaaaatgatggctggtaatacggcaataaggtagcaaaggcaggtgctttgcagaaagaatgcttggaaacttgagtctccctagaagtgaaaagtgagcagaggcccctagaaaccctcctctgaatcctcctaattccttaaaatagatgcaaaatggtaagccgaggcatcgcgcaaaagctggtgcgatgcttcagggaaaatggaaaacccacgcaagaataatgattgattccggttccaaaaggtgtcacctacctgtttcagaaaagttagactttccatcgccttttccttccatcagttgagtggctgagagagaagtgcctcatccctgagccacacagggggcgtgggagcatcccagttatccctggaaagctagaaggggacagaggtgtccctgattaagcaggaaacagcacccttggcgtccccagcaggctccccactgtcagccacacacctgcccccatcacaccaagccgacctcagagttgttcatcttccttatgggacaaaaccggttgaccagaaaatgggcagagagagatgacctcggaagcatttccacagatggtgtcaggggtttcaagaagtcttagggcttccaggggtcccctggaagctttagaatatttatgggtttttttttcaaatatcaattatatggtagattgaggattttttttctgtagctcaaaggtggagggagtttattagttaaccaaatatcgttgagaggaatttaaaatactgttactaccaaagatttttattaataaaggcttatattttggtaacacttctctatatttttactcacaggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctcattgatgtgatgttacattccctttaatctgccaactgtggtcaaagttcataggtgtcgtacatttccattatttgctaaaatcatgcaatctgatgcttctcttttctcttgtacagtaagtagtttgaagtgggttttgtatataaatactgtattaaaaattaggcaattaccaaaaaaaaaaaaaaaaaaa

SEQ ID NO: 2772 - DNA, 810 bp, Homo sapiens
  misc_feature (1)..(1): n equals a,t,g, or c
nttgaagattcagatagaggtattaagatgtgtggcatttacttaaaccatcacatttttttctttctacgcccccttgcctgtaaaacacctgggaagttccactggtgtcatccatcctgatgcttcagaccaccctcccttcttcacagaccgtgtcactttgcctgtgggtgggggctagccagccaccaccctcttttctgtgctgccagctccaggtcttcctctgcctgctccacaccactcgccgctgtccctctgcactccctgccttggtgcgtgtagtcccagtgtctcactgccaaacctcttggttacgctgcggggatctgtttctttgcctgagatccttcctgaggagcgtccattcctctggagtctctccttgtttggaacaaatcgcttcgcctttttctacttgcctgctgaagctttggagcacttgtgattgcagttttctgccgcaacccctgagccgagttcctcacattcttttacctttatggactgatgggattgggtcacttttgaatgtggctttcataggaaagcagcttaaacataaatatcagaagtgatgattatcatatgatacctcagtgattttaaaagccatagaagaaacttgactatgcctggtcaccttcttggatctgctgtctaaatgatatatatctgctgtctatgtgatatatatatatgatatatatgatatgtatatatgatatatattttttttaatgcaggaaagtatactttgtaaggagcagatttttttgttctcagtggaaccctgtcaaatcgcat

SEQ ID NO: 2773 - DNA, 386 bp, Homo sapiens
  misc_feature (2)..(2): n equals a,t,g, or c
  misc_feature (7)..(7): n equals a,t,g, or c
  misc_feature (31)..(31): n equals a,t,g, or c
gngtggngatcttgagtaatgtttacagganacagctatgaccatgattacgccaagctcgaaattaaccctcactaaagggaacaaaagctggagctccaccgcggtggcggccgctctagaactagtggatcccccgggctgcaggaattcggcacgagatgcatatctcaataccttgaacgtgtatcatttctttgtgttaggaacattccaaattttctcttctagctatttttcaaatatataacacattattgttaactatggtcaccctactgtgctatcaaacactagaatgtatttcttctatctaactgtatttttctgttcattactcccccagaccccagcttctggtaccatttcattctttacctcctcga

SEQ ID NO: 2774 - DNA, 452 bp, Homo sapiens
  misc_feature (445)..(445): n equals a,t,g, or c
gaagaaaggaagcaagcaagcaagcaaggacttgggtaaattatatggggctgaactaagtgtattattctgctctggctgccataacaaaatacaattgaaattaattttctcacagtctggagactggaagtctaagatcaaggtgccagtagggttgatgtctgatgagagctctcccctcgggctgccttcccactctgtgttcttgtggcctttccttggtgcatgggcatgggggagagatagtgcaaactctttggtgtctcttcttataatgatatgaattctgttggatcaggaactcactcttatgacatcatttaacttcgattacttcctttgaggcctcatctccaaatacaagcacactgagggatgagcaacactccaactcaaaaaaaaaaaaaaaaagaaaaaaagaaaaaaaactcgaagggggggncccggta

SEQ ID NO: 2775 - DNA, 625 bp, Homo sapiens
  misc_feature (6)..(6): n equals a,t,g, or c
  misc_feature (11)..(11): n equals a,t,g, or c
  misc_feature (43)..(43): n equals a,t,g, or c
  misc_feature (46)..(46): n equals a,t,g, or c
  misc_feature (68)..(68): n equals a,t,g, or c
ttaccntcacntaaggggaacaaaagctggagctccaccgcgntgncggccgctctagaactagtggntcccccgggctgcaggaattcggcacgagctcgtgccgaattcggcacgagcagcaacagcaacacaggtgtggagttgacagacaggtacattgaaccagagctgtgatttagacaagccaggaacctcatgtatgtccataatgctgctgacattcactcttcacttccccagcacattactgtcatatctcccagagaattatgtcataccttctctcttctcaaacctgcaacactggatctgctgtgttcactctcagttggtaacctgtttcgtatttcagagagacaatgtaagcactgagaagagaactcttgcacactccaacacctcatctgccacctctcaccatctgtctccttgtactactggagatggtctgccctcctcctggggaggccaaactcatccacttctgcactagattccgtcctcttttatcttccctacatcatgtgttttccttctatactcatcattccttttagcaataaatatctttaaaaaaaaaactcgagggggggcccggtacccaattcgccctatagtggag

SEQ ID NO: 2776 - DNA, 506 bp, Homo sapiens
tccgagttttttgtaccactgattgttctttcggtggtgttgttagaattgagctagttatttatagttctctgttgaaagagcccacagggaggagaggtgagctgagcatttgaaattcaggatctggttaakgttgtcagctcagtggatttgagaatattcacagataagcaactcagaaggatcatacttgtattgtaggccctcaggtattcaggaaatagatcttctcttgtgattcaatagccataatccaaattaaacatctggcttttccaatgtgtatttttgaatgtatgtgtcatttcttcatagacatatcaaatcattactatgtggtaagattttatccagaagattctcttcctaaaacctttatatatgacccttttaaagcataaaattattttaggtgtgagtttttattatgcaatacaaggatacagtctttaattttctacctttaagctcgtgccgaattcctgcagcccgggggatccact

SEQ ID NO: 2777 - DNA, 820 bp, Homo sapiens
  misc_feature (1)..(1): n equals a,t,g, or c
ntgcacagggaaagacctggatgctctattcattcaacagaatacagaaggcactgggaatagagtgaacaatgacaaccaatgcacagctgcccacaaggtgggctcctgggggagggtcatccctctgagaagagggcggcaccaagacccacacacctgaaaaatgtggtacttcatgtcgctgatctcgatggtcttgctgctgtccccatcctgttctgatttattggtcattagtgtcttgaacctggagcaaaggagacaaagcaaggtgggttttgaaccttttacttcaccactgtgtggcgatggcaccatctgtcacctgaccggctaccacaagacggaacattttaaaaattactgctgtgctcctaaaataattttcagcaagtgccattttacaccatcttaggaagacatctgagctgagcccaattctgtccccaccacccaccctacaagcgacctgacgcctgtggccagaatgctgactcttcattccaggatatttatgttttctaataataaaagcaataactaggccagaaagaacaccacctcagagcccccctttcctgctgccctgggtccaccccgtctcatcccgctgtggggcgagtggggctctgctgcaatgtgactgcagtctgaggggcagaggctgcagggtacagccccagcgagtcactctctgtcacctggaatctgaaacaaggtgcttctgtgcccctgggctgggagtttgttatctgaggctgcctacctgttagaagctgtcaccagcaggactttatgtgcataaaacagctttcct

SEQ ID NO: 2778 - DNA, 597 bp, Homo sapiens
tggcggccgctctagaactagtggatcccccgggctgcaggaattcggcacgagcccggccgccatcttgggtcatcgatgagcctcgccctgtgcctggtcccgcttgtgagggaaggacattagaaaatgaattgatgtgttccttaaaggatgggcaggaaaacagatcctgttgtggatatttatttgaacgggwttacagatttgaaatgaagtcacaaagtgagcattaccaatgagaggaaaacagacgagaaaatcttgatggcttcacaagacatgcaacaaacaaaatggaatactgtgatgacatgaggcagccaagctggggaggagataaccacggggcagagggtcaggattctggccctgctgcctaaactgtgcgttcataaccaaatcatttcatatttctaaccctcaaaacaaagctgttgtaatatctgatctctacggttccttctgggcccaacattctccatatatccagccacactcatttttaatatttagttcccagatctgtactgtgacctttctacactgtagaataacattactcattttgttcaaaaaaaaaaaaaaaaaactcga

SEQ ID NO: 2779 - DNA, 360 bp, Homo sapiens
  misc_feature (340)..(340): n equals a,t,g, or c
gaattcggcagagaatcagcatgtctatcacctcaaatacttatttctttttattgggagcattcaaaatcctctcttctagctattggaaaatacacactaaattactgttaactatagtccccctgcagtgctgcggaatgccacaacttatccctcctctccagctgtagtttagtatccagtaacatactcttttcatttcctttctttgggcagaaggctagatgttgcctgtttttgttttatttttctgcttcacatatagcgcacgaaagcagagtgtattcaaaaaaggaaatgtgtttgaaaaaaaaaaaaaaaaaactcgagggggggnccggtacccaattcgcccta

SEQ ID NO: 2780 - DNA, 1849 bp, Homo sapiens
  misc_feature (222)..(222): n equals a,t,g, or c
  misc_feature (1300)..(1300): n equals a,t,g, or c
gtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccancagygggtagggtgcaatctggtgtgtgttccagcagtgagacggtgttattgtgaaggtggcattcatctgcggaccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgncccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaaatcaccttgtgtgttgtagctcatttgtttcaagagagaatcaacagatcatattcagtgtcttgaataaattgctctattttgatattagaaaaaaaaaaaaaaaaaaaaaaaaaaaaaaaa

SEQ ID NO: 2781 - DNA, 926 bp, Homo sapiens
ctcaaccacaactagaatttgcacaatataagcttgaaacgaaattcaaaagtggtttaaatgggagcatcttggctgagaggaaagaacccctccgatgcctaataaagttctctagcccacatcttctggaagcattgaaatccttagcaccagcgggtattgcagatgctccactttctccactgctcacttgcatacccaacaagagaatgaattattttaaaattagagataaataagacgtgcgtggtttcttaagcacagctcctccttcttgatattgcacatgcacttcagttcatggctagctgtatagcttccgtctgtaaacttgtattttcaagaatccttggtattgaatttttagaaatgctcacataattgttgggactgattcattcctccacgatatgcctcctctctctgatatcctgctaactgtagccgttgtggcatttgagatgacaggacatatatatatatggccccacacttgaccttgagtgcctgaatgctctgaaatcaagcatatggcacagcgctcaagacttttgggtttgtgtccttttttctatggctgtctcttctcaattctggagaggtctggttccagtggctggtttcyarggattgattcttaagctctggatcacagagagaagcaacaaggaactatactcaactcaaaactttttaggagaatcatgaaattggtctattcaaaggatggagttgagtccatwmtgttattgttgcaagaggttgcatatttggtgagtcagttatataaaatagtgttcttattgtaaatatgatacttctcataatctattttatcatgtgtataacattcaaactgacaaatatattgacttatgaataaaggtgtcaaaaaacaaaaaaaaaaaaaaaaaaaactcgta

SEQ ID NO: 2782 - DNA, 608 bp, Homo sapiens
ataaaaaaagatgtttttcatttttttcatgttatctatccaagcactgttccatggtcagcaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattastttgttaaaagcaaaagtggtcgtgtgatatgctaaatgttaattactgattttatatgtttaaatcacgccaaacaaattatgtctgtgccatccagggtctgttgttaatctttttctgagtacttggattgggataaagggcttgtactatgcactttttattaatgaataaatagaaaac

SEQ ID NO: 2783 - DNA, 1368 bp, Homo sapiens
  misc_feature (1)..(1): n equals a,t,g, or c
nccgagttgaccccacggtctgagatgtccaagctgcccacagacagcagtgtcccgcagacaggcgcggcgaatggtgacagagacgtcccgcaggcggagaatacaagagcttgaagaacgccgcaggcgattcgtggaagcctgcagagcaagggaagcagcgtttgatgccgaatatcagcgaaatcctcacagggtggacctcgatattttaacctttacgatagctctgactgcctctgaagttatcaaccctctgatagaagaacttggttgcgataagtttatcaatagagaatagttatgtggtgacactacttcaagagaacctctgcattccagtcataccaatcctgcaacttgattttcagaagtcaagagtatatcgcgataagacagtgcacaggtggaggggaaaaaaagggggagggggaagcttatcttgaaaaagcatcacagaagtagaaaaaaatgtcgaaagcattataactgtaacgttctttgagtttgtgattgatccacatttttccccctgcattatggaaaatgtctctcagcattgctttattacaaagtaaaggatggttttataaaattgagactgatgaaacatcaatactagagcccatgaggatgaaagaaattatcaaatagtgctgaacagaataagatgttaacgctgagttattaggactggaaggctatgaaaagaacttgaaattgtcggaatatgtgctctcttcatgtcatattcaatagaagtttctagtttaagattgattttgtgttttcttaggcatttcaagtgacaagcaaagtaaatgtatatattatgtgataaatcatgttttcaagaacgtcaaatttctggacttttttctttcaatttttaatttttaaagtttttttggtattaaaaaatctattcacaagccaaaaaatatataaaatatacagcgaaaagccttccattcttgttttcctccatccagtaccaacgatgacctttaatagccacagtttcctttccgtccttttagtttccttacgtgtacacaggcacatataaatgtgggtttacttgttttatttcttcacagaagtcggcatattatatttactggtttatacattgctttctcattaagaacatatgttgacccttccacacccctgtatttcctcattattttttaaagtggcattttattccattctgaggttatgtccaaatttacttaaccagggatatattgacggacatttaggttgtttcccatctctttctttgggcagaataaaaaattgctagagtagttcatcttgtacaattgctagagtagttcatcttgtatatcatgtggc

SEQ ID NO: 2784 - DNA, 701 bp, Homo sapiens
aattcggcacgagatgagaaccactgccttgtgacctccagtagaatgaggccccagtgttgactgcactggaagagtccaggagcttgttaaaagtgcagatagactgattccaccccagaatggacaccgagaaatcttggatcccaagagtttggttggctttatcatgccccttagtcatttctgagtggttcctcatactctgcatccatgtgatgagaggcaaatttcctcatgatctgctttgcttcctcatcaagctactatgccccaccattgctggctctgcttatggttgctgcaatgtaggcagcgctgtttcttgttcttaccacttttaactatcttaaaatagaacctgactctgattctccattaagaagtggaaactggctgggtgtcgtggctcatgtctgtaatcccggcactttggcctcctatctgaggctaaagcagggggatcactagaggccaggagtttgagactagcctgggcaacatagtgagaccctgtctctatcaaaaatttaaaaagttagctgggcgtggtggtgcacacctgtcctctgagctctcagctacttgggaggctggggcaggaggaccgcttgagctgtgatcatgccactgcagtccagcttgagtgacagcacaagaccctgtcacaaaaaaaaaaaaaaaaaaaaaaaaaaactcga

SEQ ID NO: 2785 - DNA, 1794 bp, Homo sapiens
  misc_feature (1788)..(1788): n equals a,t,g, or c
ttcttttttgttcatgggacatggtacctaagcaaataggagttgggtttggtttttctcctaaaataatgctcaatacttacctaatcaaatggcatccatttgaataaaatgacaataactaaagctagttaatgtcagtgacattaaactaactccaggattcaggagttttaatgttagaatttagatttaacagatagagtgtggcttcatttgtccatggtagcccatctctcctaagaccttttctagtctgtcttcctgccttcgaacttgatgacagtaaaaccctgtttagtattctcttgtgcatttggtttgttggttagccgactgtcttgaaactattcattttgcttctagttttattttacagaggtagcattggtgggtttttttttttttttctgtctctgtgtttgaagtttcagtttctgttttctaggtaaggcttatttttgattagcagtcaatggcaaagaaaaagtaaatcaaagatgacttcttttcaaaatgtattgtttagcacttaactcagatgaatttataaattattaatcttgatactaaggatttgttacttttttgcatattaggttaatttttaccttacatgtgagagtcttaccactaagccattctgtctctgtactgttgggaagttttggaaacccctgccagtgatctggtgatgatctgatgatttatttaaagagccgttgatgcctccaggaaacttaagtattttattaatatatatataggaatttttttttattttgctttgtctttctctcccttcttttatcctcatgttcattcttcaaaccagtgttttggaagtatgcatgcaggcctataaatgaaaaacacaattctttatgtgtatagcatgtgtattaatgtctaactacatacgcaaaaacttcctttacagaggttcggactaacatttcacatgcacatttcaaaacaagatgtgtcatgaaaacagcccctttacctgccaagacaagcagggctatatttcagtgacagctgatatttgttttgaaagtgaatctcataatatatatatgtattacacattattatgactagaagtatgtaagaaatgatcagaacaaaagaaaatttctattttcatgcaaatatttttcatcagtcatcactctcaaatataaattaaaatataacactcctgaatgcctgaggcacgatctggattttaaatgtgtggtattcattgaaaagaagctctccacccacttggtatttcaagaaaatttaaaacgatcccaaggaaagatgatttgtatgttaaagtgactgcacaagtaaaagtccaatgttgtgtgcatgaaaaggattccttggttatgtgcagggaatcatctcacatgctgtttttcctatttggtttgagaaacaggctgacactattctctttgattagaaaataaactcataaaactcataatgttgatataatcaagatgtaaccactataaatatgtagaagaggaagttttaaaagaccttaagctggcattgtgaaggaacaccatggtagactctttttgtaaatgtattttgtatttaatgaaatgcagtataaaggttggtgaagtgtaatataattgtgtaaacaaatcctgttaatagagagatgtacagaatcgttttgtactgtatcttgaaacttgtgaaataaagattccacctctggttaaaaaaaaaaaaaaaaaaytcggggccagttcccccccggctattttaaaaggnaaaaag

SEQ ID NO: 2786 - DNA, 783 bp, Homo sapiens
ggcttttttgggtttatactgggaatttatttttactaaattatttaacttttctaattatgtaattatgtaagctagcttttcatgtttatgtatgtatggtgtccccttgtgttatttttcttcctcttggtttttgaattagtgttaaatagaatactgtctggattcttaaaatattttcatttccatcatggttataacaaatttgctgcatgcccaaactgacaacagcaatcactgagggaacaggttttgaatctttcttttgtgttatgaagtttatcgtctctacttgcttgagatttttgttattttgggggtttgggggtgctttttgttttgtttttgccaaatgtaacatgaaagcagatgctgcagctttagtctgttatgctgatttagtaaaaaaaaattttttacatatattgcttgctttcgatgcttctgtgaaattttttyctaaagcttttgtgcagctgtatggtaaaaatatggkgattaattkgaagagcttacattgaaagacaatgtaataggaaataaatgtagattgcagttggtcaagaattttgtagagaggataacaagacttaattactgaaaaacagtaacatagcattttgaaatataatttttaaaatattgatgctttccttttaaatggaaatttaaawtttatgattaaaagtttaaacattwatgataattttcctcatcagttctcccataggaaataaagcatgtgaaagggtaaaaaaaaaaaaaaaaaaaaaactcgag

SEQ ID NO: 2787 - DNA, 1037 bp, Homo sapiens
tcgagttttttttttttttttgacagagtcttgctatgttgcccaggctggagtgcagtggcaatcttggctcaytgcaacctytgcytcctgggttcaagcaattytcctgcytcagcytccytagtagctgggactacaggcacctgccaccatgccaggttaactttttgtattttagtagagacagagtttcaccatgttgcccacgctggtgtcgaactcctgagctcaggcaatctgcccaccttggcctccgaaagtgctaggattacaggcttgagccactgcacccagccaagctgtacttttttttttttttttaaagcttcaaaccttcaatatttcattaagagttacagtttggtttcagtcattckgaggraaattaaggaaggggcttggcccawacctggtaaaagaatggaaggaaccaatttttaaccatttggaccagtgattytcaatgggagtgctttttgtcccccaggaaacatctrgaaaggtatawkgagatatttstggsttgtcacaatttgtgatgggggaaaaaagaactaccagtatcagggggatacaggcccggtatcaggtggatagaggcctggaatattgctaaacattctacagtgcaaagacascctttmacawacagaactatytggtccaaaatgtcaatagtgctgaggttgaagaactcaatattttatatgttttcagggaatttctatgtgggcttgggaaagtttgaagtcaattgtcatttgtatatttaaagggatatattttatcattagtctataaattccagttgcaaagtagaggccctgcacatttgtgcacatatacacacaccagaaataaaytmtctkgcaattatcttctctatcattgacagggcaatgacctatgaaaattatgttatgtctaatagtccctcattgttatgtgcaaaacacccagcaaagctcaagttaagrttgtggtcacaaagaaaagagctatcattgctttatgatgttgtctgaagttaatga

SEQ ID NO: 2788 - DNA, 905 bp, Homo sapiens
cgacggtttcaccttgttggccaggctggttttgttggccaattgtctctaaactgctgtcaaaaaaaggaatggatcagattgtcttgaatagggcagagctaacctgtaatcacctgtgtgatgagaaasagctttgactgcattttactcctgacctggcctaagctttctgtttacataagatttttcaagaattcaacttcaagtagcagccgagagagctgcctcaggattctctcaaaaactgggaataatatgggaacatttgtttcttctaaaaataaggcaaatgttacattgaatgatttggggggtgaggtttaattggaaatggtctctggggactgaaaactgatgtttttgcagattacctcagggaaacggaggtttgttgagtttacagacacattaaaccaaaggccgtgggaaaacccctctccagctccaggggattggtcaggaccacccactaaccagtgccttccttcttaacattcacttttagcagcttgtgtttattttacatgggcagttttgatgggaaattgccatgaccacaggggtttggagttctgctttttttttttcttcttctttttcgggggactgggggactcctcccaagatcacattttagcatctttctctcctactccatttagaaaaataagtaacaggtgaaatgtggtctcagtgttaacgggataattctgctaccggctcctccctgatgattctgaaatacactactgaacgagctctggctggtcctttctatcctggatgtggttcttctgtgtagcaattccttgatgtccagtttggaaagatgtactcttctcaacaagaaaaacttaaatccgtcgtgcccaaaaaaaaaaaaaaaaaaaaaaaaaactcga

SEQ ID NO: 2789 - DNA, 1705 bp, Homo sapiens
  misc_feature (1281)..(1281): n equals a,t,g, or c
  misc_feature (1704)..(1704): n equals a,t,g, or c
tggccatggaagcgctagaaggtttagattttgaaacagcaaagaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcagtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagatttgcaaacaacagctcccagattcttgcggctagtgggagaccaagggactccatcggagatnaggacccgttcacagctaagctragctttgagcaaggtggctcaragttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcaaaaaaaaaaaaaaaaaaaaaaaaaaaaaaaaaaaaaaaaaaaaaaaaaaaaana

SEQ ID NO: 2790 - DNA, 1666 bp, Homo sapiens
ggtggagttcgcacctccagctcgggccgatgtggaagctttggagagctgaagagggcgcggcggcgctcggcggcgcgctcttcctgctgctcttcgcgctaggggtccgccagctgctgaagcagaggcggccgatgggcttccccccggggccgccggggctgccatttatcggcaacatctattccctggcagcctcatccgagcttccccatgtctacatgagaaagcagagccaggtgtacggagagatcttcagtttagatcttggaggcatatcaactgtggttctaaatggctatgatgtagtaaaggaatgccttgttcatcaaagcgaaatttttgcagacagaccatgccttcctttattcatgaagatgacaaaaatgggaggcttactcaattccagatatggccgaggatgggttgatcacagacgattagctgtaaacagttttcgatattttggatatggccaaaagtcttttgaatctaaaatcttggaagaaaccaaatttttcaatgatgctattgaaacatacaaaggtagaccttttgactttaaacagttaataacgaatgctgtttcaaacataaccaatctgatcatttttggagaacgattcacttatgaagacaccgattttcagcacatgattgagttatttagtgaaaatgtggaactagctgccagtgcctcagtcttcttgtataatgcctttccatggattggcatcctgccttttggaaaacatcaacagctgtttagaaatgcagctgtagtctatgattttctctccagactcattgaaaaagcttcagtcaacagaaagcctcagctacctcagcattttgttgatgcttatttagatgagatggatcaaggtaaaaatgacccatcatctactttctccaaagaaaacctaattttctcagtgggtgaactcatcattgctggaactgaaactacaaccaatgtgctacggtgggcgattcttttcatggccctttatcctaatattcaaggacaagttcagaaagagattgatttaattatgggccctaatgggaagccttcttgggacgacaaatgcaaaatgccttatactgaggcagttttgcatgaagttttaagattctgtaatatagttccattagggattttccatgcaacctctgaagatgcagttgtacgtggttattccattcctaaaggcacaacagtaattacaaatctttattctgtacactttgatgaaaagtactggagagacccagaagtgttccatcctgagcgatttctggacagcagtggatattttgccaagaaggaagctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctgaaactgcctgggatgttttcgggaacaagaatgtatatttgccttatccctgaacttggtttaatcaaatcaatgtgtgtattagaataaaagtcacagcatcaaaaagmcaaaaaaaaaaaaaaaaaaaaa

SEQ ID NO: 2791 - DNA, 1078 bp, Homo sapiens
ggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcytgggcccagctcctctactatccccccgacccatcctcagccagcgctgcccccatcggctctggggaggacgaagtccagcagactgcagcgcggattgccggggcyctgggtggcctgcttactcccctcttcctccgtggcgtcctggcctacctcrtctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcragggtgatgctggctgctcttctgaacaaataaaggagcatgccgatttttaaaaaaaaaaaaaaaaaaaaaaaaaaa

SEQ ID NO: 2792 - DNA, 1947 bp, Homo sapiens
tgtaaacagattggagaatctagcaataagattcaaagctaatctggagcataaaggcacagttcagagacagaataacagggatcacaagcatgaattaaaaggaatttatttgcttcaagttcctagatacaaccttcccatgctgcacttctccactgtcggagcacgttccgaaaaacagaatgccttgatccctggtgggtgcgaaggcagttgttagggatggcaggcattggtgggctccaaaagatgaaggccccacacacaggtgtgctgcatttgggatctgtgtgggtgtttcttggaccctttcttctgggagtagggtacacactaacgtttaatccgctgtctgggtgcatgtccacagtacggtggctaaactcgaacatcactgcaaataggacgctgagcaggtccgtctgtcatgtcacgccactgcacaggtccttgtccccacacgacggggagtacttgcgtcagatgttattgaatagctcgtctcgggcaggggaagcggggagttggggatattaattgggggttttaattctattatcatgtcagctgacattatgactatataatgtagttagagacaatttttatcttgcttatagtaaaggttcagcctgccaattgtaaatcattctaatttggcaggcttatttttgacattggaaagggcagaaagcgatttgccccagtagtgtaataggagttatagaccagaggctgaaacccaaactatataaaaaggaattcagtggagggggctttgtaatctccattaatttgtgttgctacttccaggatcaccaaaaattacatgtaattttacatgttaaacacattgaaacataacctatgtttataaagcataacgggcttcccttccagaagctctcctgcttgtcatgaagtgagaacaatgaaaagtcatagcagatactcagtttaactctgtgtagaacctagtagtgtttgagctgttattcagatttgaattcagactgtgtgttgtttgcttatggacactgcctgtcgttctgtcactgttaaattaatgagtctataaggtttttcttccagaggccataggtgacatcactaaaattgcaagataaattgtaatctttgctgctgctgcactccccaacctctcccccaccccccgtggtgtgctgctttctagatgagcgtgttttggagcaggcccatctgggacactctatgctttcaccaaggaagtgcgatctgagcagccacaatccagccaaaagaggatcgtagatatttgctctgatcaactagatgaaaatatagcagaatggatttagcccactgctctgttttatccaactgagtctctgaccagcaattggtgcataattattacagcaaaagttaagaaatgaaactgtagcaattatgtaaatgaatgtgttggcctcttaatacctgttactagtggacttcctgtgaggaagttagttttttgttttgatgaaatgctttcgttttttaaatcttaattctgctgtccacatcctcccaaagtgtgcttacttcatttgtttaatttaaatgaactttcctccttgtatgtatgaggtgacttggtgggtggggtgggtggtttttgtttttgtgttttttctttcttagggcatctgtaggcctcaaaggacctttcctttaggtcatattcctcagaaagtcttcaatcttcccttgtttttgtttgtttgtttttcttaaagaatattttcaaagcttaaatttgtatattaatttaggactatttagaagtataggctgtcgttggcggcagcagtatattctgaaatgtctcatagatatatatttttgaataaagatggtgttgttgaacaaaaaaaaaaaaaaaaaaaaaactcgagggggggcccggtacccaattcg

SEQ ID NO: 2793 - DNA, 2209 bp, Homo sapiens
gagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggattggaaccttctgcagcaatggcactgtgtcccggatcaagatgcawgaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtragaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcaataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaamccataagytgcacagaccaccggtactgccaaaggaaatcctactcactycaggtgcccagtgacatcctycamctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccgacaagaggcctccaggcagggtctgacggtgtcctttataccttatttcaaagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctytaaytgmagccccacgagcggcaagcagctagacctgctcttctcggtgacacttaccccaaggactgtggacttgactgtcatcctcatcgcagcggtgggaggtggagtcttactgctgtctgccctcgggctcatcatttgctgtgtgaaaaaaaaaaaaaramaaacaaggggccccgctgtgggtatctacaatggcaacat

SEQ ID NO: 2794 - DNA, 1317 bp, Homo sapiens
gaaggactgtttagtgctacccgtcctgagcaccaatgggtcaagccagtgctcttgcttccctcctgctgagagcactggccttggtcctgggtgccaggattgggaagggggggcaaaggggaatgattatcatctccatagctgcccttcccagcactgggtgccaagagctttacattcactaatttaatcccattaacaactctataatagagtgggcacttctgtgccattctacaaatgaggattcggagactcgaacagcctcagagtaacctgccccagttacacagttagtgtgttacggatttgggtctagaatccaaatgagggctgttgggtcacaaaacacctatctccatgattagatcaatgtwctcaaacttgaacgtgcattcaggtcaccaggggagtcttgtcaakatacagattctgatcctgtggktctgggytgaggcctgagcctcagcctttctgacaagctcccaggagatgcagaggttgcaggtcttagaccacacttggaggaaccagatgcagtgttgcacccctcttctatgtccacgaagtgtccacaagtgagagaaggccgagtacagaaaaaaggagaaggaggaagaccagtttttcccttctgcaaaatgttgttctgtcccctgatgcaggggtccccaacccctgggccgaagaccggtaccagtccattgcctgttaggaaccaggccacagagcaggaggtgagcagtggacaaacattaccacctgaactcctgtcagatcagcggtggcattagattctcatcggagctggaaccytattgtgaactgtgcatgggagggatccgggttgcacgctccttatgagaatctaatgcctgatgatctgaggtggaacagkttaatcctgaaaccaatctatgaaaaactgwcttccacaaaaccagtctmcacggwcaaaaagwttagggaccactgscctaatgtatacctgacaattaagaaacccacagycaagagctttgctcccatgaaagctcttaaccagcaactaaattcagtttccatgtatctgtcagagatcttttccagaacacttgggcctcaacagactggcccaattttgcactttaggaaatcagcctccaggagtaagaactggtacaactccttccccaagatgaaacccgaggacacagtgatagtcacaactgggtcagcccaaaagcttgctgtggtctgccacacacacactgggagaaagcgaatgctgcttctttaaggacacctcaggggcatccaagggccattcaccga

SEQ ID NO: 2795 - DNA, 3633 bp, Homo sapiens
ggcctcctgacctcaggtgatctgcccgcctcagcctcccaaattgctgggattacgggtgtgagccactgcgtctggcaaatttttggcagttacaaataaagctgctattaacatctctctctaagtttttgtgtgcatgtaagttttcaactctgggtaaataaggagcaggattgctgggtcatatggaagtgtgtgtttagttttgtaagaaatcgccaaactgtctttcaaaggggctatacccttttgcattcccaccagcaatgaatgagagtttctattgctctgcattcttacctgcatttatagtgtgttggattttggccattctaatagttttgacttgcggtttccgaatgacagattatattgagcatcttcatgagattctttgccatctgtatatcttttttggcaaagcatctatttcaggtctttcaacatgatccagcagttctgctgcttgatatttacccaaggagttgaaaactttttttttttttatattctgacattcttctaatggattgtgatttgagttaactttgtagggtggggtggtggtatcttagaaatggaactctttggaaataatacaggggggtattttcttccccctaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggtaaatatggtggaattacaggcatctaaatcagactaacaaatttagtcattttagaatctcaaaatagttttacaaattggaggagactttggaagtccatggaatccattcaaactaaaaccttttggttttagtgatgttggcagttttctaagtaaaaatgaaaaataattgaatatctgcatctttaaataaaattatttgactgcctgcatggggctttctcttgtccttcccacattaatgataaatgatattccaactttaaatgaatcataattgtatgaaagtcctatttttatattgacttatctaattttttaaggctatggaagaaatgaatggcaaagacttggagggagaaaatattgaaattgtttttgccaagccaccagatcagaaaaggaaagaaagaaaagctcagaggcaagcagcaaaaaatcaaatgtgagtgaaatttgtatacttaaaaattgtataaattttaatatttatacactaattggaaaataacaggtgttgatcagacttgttaaatgcataacatctctttaaagaagacttgaacgtttgagagtcatagggaaacaccagtgatctaagtgtttattgaactcttactatgaaccatatttgtgaaaataatcagaattgtaaataactggaattttggtaaattggcaagatgaaaaatctgtctagctttttttttgttttgtattgggtgacagagtctcactttgtcactcaggctggagtgcagtggcactctttcggctcactggaacctccacctcccgggttcaagagattctcctgcctcagtcttctgagtagctgggttacaggcgccaccatgcctggtaatttttgtgtttttttttttagtaggggtggggtttcgtcatgttggccaggttggtctcaaactcctgacctcaggtgatccgcccacctctgcctcccaaagtgctgggattacagctgtgagccaccatgcctggcctatctcacatattttctttgtattttacagaatgttcttctgaaaatgtcttaaatattagctgtccaaatatcttaatacattttgttaaagggtggagagttttttctctgagagataggaaatactaaatctctattcatgatagactgtttcttcaccagtagtgctcattgccaccccaaaaatttcatgttcgatggatggattttgaaaatgaaatgagtattaaaattataacacagtagtgcaataagaaaacaagtaggtgtgtaatgagttatactaattagggagacctttttagagaatctgtaaataggtatctgcttaagactgaaggaaacttagttgggtaagaattgaagttagctcctaaaaagttagttactgatttcctagaagaggggtaattgttcttgaatgtgagagcaataatcactgtcaatactattcaaggttaattttctgttgattgccctgtttggaatttaaaggaagaggatgcttctacatatttctgttacttcataatcagggaattgatcaagttctagtttctgcagttaattgtccagttggacaagttggcaagctctgaacctcaatttcttcagttctaaaatgggatcagacaaaattatgtaatagctctggattatgtgattatccaagtgacccatgcttgttctgggaccaaagaaaatatactttgtaggtttgatgatagtgtaaatgaaggaagactacaaaaagagttagttttaatgctctatatttcaaacacctggatatactaaacagtgtaaaataacttctttttatttctttcagaagacgatatatggttaatttattaaagtagaatgtaagtataggagattatattagataatgtgattagagcagttacatttggtacttgatagagggagatactaaatagaaggtggaggatgtcagtatatctgttaatatttgaaaaggagtacaaactaaaagggatgattgcatgttactttcgtactttaacttgctacagtctttttttttttttttttaagttttaactaagcacgtattcctacataattctcactgtattcctgtgagttaggtactctatcccttagtttgaaatgaggaaactgaggctcagaagtcaacttcccttggggtcattcacatagtaagtagtggagttggatttgaactaaggtagtctagtctcccataattttccctcttaaccactataccaggatttctcatctctgtcctcctgacattttgggctggataattcttggtcttgggggctgccctgtgcgttgtaggacttttagcagcatccttggcctcttcctgctagatgccagtagcaccccctttctcagttatgaccgtctaaaatgtccccctggaaagaggtggtggcaaaattatccctggtgagaactatttagaaatagaaaaggatgatctttccatcatttcctcaaaacaataaaccagcagagcacataaaaggtctaaggacctagtgaaccggaataacatttttacgttagtcagttggaacaggggcctttaataattcaggataaaataaggccgggcgtggtggctcatgcctgtaatcccaccactttgggaggctgaggtgggcagatcactctaggccgaggtgggtggatcattcgaggttaggagttcgagaccagcctggccaacatggtgaaaccccatctctactaaaaataaaaattggctaggtatggtggcacatgcctatagtcccagctactcgagggggggcccggtacccaattcgccctatagtgagt

SEQ ID NO: 2796 - DNA, 785 bp, Homo sapiens
  misc_feature (17)..(17): n equals a,t,g, or c
  misc_feature (23)..(23): n equals a,t,g, or c
  misc_feature (737)..(737): n equals a,t,g, or c
  misc_feature (743)..(743): n equals a,t,g, or c
  misc_feature (765)..(766): n equals a,t,g, or c
  misc_feature (785)..(785): n equals a,t,g, or c
ggtcctcactttataancatccncagcctgtgagagcagagggcagggagatagtgtgagacaggagcccaggggagaaagacagaaactaagactcaaggagcaacgcaaagcaaagtcaaggagtcaagaccagagtagctgagcagaggccaagaagggtctgagagggctgtgcagcagcaatggccctaaggatgctctgggctggacaggccaaggggatcctaggaggctgggggatcatctgcttggtgatgtctctactcctccagcacccaggagtctacagcaagtgctacttccaagctcaagccccctgtcactatgaggggaaatattttaccctgggtgagtcttggctccgcaaggactgtttccattgcacctgtctgcatcctgttggcgtgggctgctgtgacacgtcccagcatcccatcgacttcccggctgggtgtgaggtacgtcaggaggcaggaacctgccagttctccttggtgcaaaaatctgaccctcggctgccctgcaaagggggagggcctgacccagaatggggctcagccaacacccctgttcctggggctcctgctccccactccagctaaactcaactgatcatccatctgctgactgctcactgctgctgccacttccagggaaaccactagcagctgccaatgtattctgaacaaataaattaatgctatagctgaaaaaaaaaaaaaaaaaaagggccngcccgntttaaaaaggatccccttcggnnggggccccaaagttttacn

SEQ ID NO: 2797 - DNA, 3185 bp, Homo sapiens
gaattcggcacgagcctgacttgaggttccatatatcgggaggtgggaacctgggggtatgcagttgcccatgaagattcatggaggggcctcgcgcagacagctgacgtccgctgtgtggcctcccctgctttgtgcatgccagcctccttgctaccatgtgtgttcatgcgcgcttgtgtgtgtgtgtatgcatgcgcacacatgtgtgtgtgtcttgctttctcatacctcattggctgcataaaatgtaggcctaaggatgaaggggaagatttacacccaaagcctggctgtgacagcttctgtccagaaaagctgtgtttgggctcagaattactcactacattcatgcaatacatatgcaagcagggagcagagagctttatcaccggggctacacaacagaagggaaaaacagttatgtggagagctggtgacctgacacgggaagcttgagggctgcggtggggaggtacagtctccccactggattgtgctatcagagaggcggctgacagccccagatccatcttgaaaaacccagaaacagccatgtggactggtctatggagtctgctcacttggatagcttgggagggggggggtgctgcgacttgctcaccccaaataggaggtataaaaccaccacttgttatcgagatcatgactgtgcctgggattaagaccagtggtgggcacctatgggagaaggtcagcgatgcctcccagctggggcagctcagggcctctccctgtagcacttcatgtgtaagtggcctgagaggccatccttggccctggagagtataattccccactgtgcagagcacacccccttccaaaaggaggccaagagccctggcctcactccttgctcagcgtgagcctgtttccactgaggacagagcccagccagggtagtgaacatgacagcttcttgccagacagtgttgagagggactcccaggctggcaggtaccctccattttgttaagggcaaaacaggacaaaaagggaggcatctggagaaagcaagacttttcttagctcgttcatcttcttccagccctaaacatcatagaagcccccaaaaggcacgaaaaaggagaaaaggctcctgctgcgttaagctagctcctacaagtcgcttcctctcttttgggaaacgaacaggaaatacgagaaagggcatggcagacctagaaagtggttggaggtggctgggggagccctgggcagagtccagcggtcaggcagtagtttcaggcagcacctgctcacagctgtctgtccatctccacctgacagggcagcgattgactgccattcactgcccattcctgcctgggcatgaggccaatgccaggagactgacagacctcatcttgggcctagttcaaggctgtgaatgagtatgactgatcctgttttgctgagtaaggaaatggttggagagctcgaaccacttgctcaaggtcccccacttgcagtttgcagagcaggaatctgagcctgagtctgccggaccctgggatcaggcacttcctacctcatgaggctgccttccattgagagatgcagcagggcagaccaaggagggaaccctttgcccctagcttctgctgtccacagttacctaaagactaagttttgtgggtcaagggagtctatgacagaatgcgacaccaaagcgtggaatggagttgaggtgcgatgcggcggcgccttccgctggaagcacggccactcacctatcagcacctcccactttccgttggcctgggtcacctcgtaggcgcagcgcatctcattcaggctcacacccccaaggatgaaaatgatgaggcgggggccactgcggtactcgcctggggccttgttcttatgccagtgcccatagcgggcgctgagaaagagagagagaaagagaatgtcagtcagtttatctgcactcacggcatcaagtgcttcataccccagtggtttgtttacttattaggtctgtacacttgtgccccaaacagtgtagatgcttagtgagtgctggctgaaatttcactgcaatgcaattttcaagtggattggttcccaggagaagagtcactatgaatgcctgtgctgctgtgaccttgtcactcttagaaacatgcaggcaacagacaggatcagttcagctctgacgtttgctgggtcaagttctgtagcatccccctgctagaggctcatgcagacgtctaccccaagtcacacatgcctctgagcttgcctgggacactctgctgtcagtgcacagtgatgacagtctaagatctgccttcaggctggcacatagatcccttgaaaacatgtactgagtgagtgcctcttggaggccagggcctccccagtaccacatcctaaggagacacaggccttgaccaagaggtcatcattgaatggggcaggtggggagaaggaagtgagcccaaatcctggtctgatgaagagctctgtgctatagggccaagcacagggaagccctggaaccctgtccgggcaccactggggaggcttctccatccctgagctgcctcctggaaattgcggcgaagccagggaggaagagtacttcagtggcaaggctgctcccagaggggcctccctctgaacctgggcttccttcaatagctctttacctttgactgagaaacaggaataaatgggttgttcccaggttaagaaaatgagaaaaatgagatgaaaggagcaagtcctttctggccactgcaatgcgtcgcctttcttcctgactcatgacagctttacagtcactttccaaaccaggaagacaccgtttggggcaccgtttgggccaacagagaatctcacagttgctttctttccttgtgcaatcatttgatatcccattctcatcacccagcctgactgtggcgctacttgggattttgtattttatgccatatttggcaaaaaacgttttacctctgctgccatgagaagggctgcacaatgacacagaggccaccacaggcctctggcccagctgaagccaaaagtgaacacagagagaagagacgcaaaagagaagacaggtggggaaagcaggagaggagggacagagatgtgcacatcctggggtgccaggtgtggcacagctgcagtgccagggtcgccctctcgag

SEQ ID NO: 2798 - DNA, 2249 bp, Homo sapiens
ggcacgagcaggtttggaacataggtacacgtgtgccacggtgctttgctgcacctatccaccagtcgtctaggtttgaagccccgcatgcgttggctatttgtcctaatgctctctctccccttgccccccacgccccgtcagggcccggcgtgtgatgttcccctccctgtgtcccatgtgttctcgctgttcaactcccacttaggagcgagaacatgcggtgtttggttttcgcttcctgtgtcagtttgctgagaatgaggccttccagcttcatccacgttcccgcagaggtcatgaactcatccttttttatggctgcgtagtaattccatgctgtatacgtgccacactttctttatccagcctatcattcatgggcattcgagttggttccaagtctttgctattgtaaatagtgctgcagtaaacatacgtgtccacgtgtcttcctagtaggaacttcttcctcttcagcccgctgagtagctggcactttaaggcaggtgccaacgcaccggcagcaagcttccttttttgcccgggaaaaactgaggtgcaggtagtataagccattgatcacggaacgcacaggagcagagctcgagtccaagcatcgtggctccacccgtcatgctggatgcatctttaggctccgctctaggtatgtgtatcctttacgggatcagccaccggcagttgccttgcgagcacgatgacaaacctctgccggctcttttgggtctcatccctgtatctatacgttgcatcccaacataaagaccggaatgttcctttcgctgacccagtctctcaccctttccaaactccagaaatcttgtctgtcctcggaagaactccccctgcttctttctctaaaggctgtcttcaggccgggcacagtgggaggatcgcttgagcccagaaggccgcagtgaggtgagatcgcgccattgcactgcagcccccggcggcagagccggagccccgtctcgaaacaaacaaacaaaaaccaaccaaccaaccaaccaaccaacaaacaaacacagacaaagaaagaaagagcccaggcaacctagtgaaaacctgttcgggctggggcgtacctgtaccccagctgttccggaggctgaggccaggaggatgggtggacgctgggaggtggatgctgcagtgagcagtgattgcaccactgcactccagcctgggtgacagagccagaccccgtcccaaataaataaacataaaaataaaggaaccagtttgtagaaagcgggagagggtcccattgaacttcaagccttcgagcaacagctgtggctggacaggttggaccagcaggctggagcagtcgccatcttggcagggatcattgaccctgatctatcgtcgggaggaggaagagccgatcttacgcagggagggcaggtggactatgtgtggactctggtgacctgtttgggtgccaggtgttactcccagggccacccgtaactgtgaatgtgcaggaaccctgacttgagaagggcctggccacgggggtcttaggcccctggggaatgagagtttggttcccggtacccagggaaaccaccagcatcggcagaggtgatagctgaggaggagcggggatttggacgagagacacaggatgagtaccggggggcagccccgtgatcaacaactgctgcaagaggggccgtttgttcgactcgctagtcttctgcggctctatgcggtactaaagagcagaagacagaagatacaaaaaccacaaaaagtagccgggcgtggtgctgcccgtcaataatcccagctactcgggaggctgagacaggagaatcgcttgaacccgggaggcggaagtttcagcgagccgagatcacgccgttgcagtccaacctgagcgtccgagcgagactctatctcagaaaataaagacagaatgaaagagcccggcgcggtggcttacgcctgtaatcccagcgctttgggaggccgaggcgggcggatcgcctgaggtcaggagctcgagaccagcctggccgacatggcgaaaccccctaaaaatacaaaaattagccgggcgtggtggcctgcgcctgtaatcccagctacccaggaggctgaggcaggagaatcgctggaacccgggaggtagaggctgcagtgagccgagatcgcgccactgcactccagcctgggcgacagagcgagagtttgtctgaaaaaaaaaaaaaaaaaaa

SEQ ID NO: 2799 - DNA, 1996 bp, Homo sapiens
  misc_feature (3)..(3): n equals a,t,g, or c
  misc_feature (5)..(6): n equals a,t,g, or c
  misc_feature (16)..(16): n equals a,t,g, or c
  misc_feature (28)..(28): n equals a,t,g, or c
  misc_feature (967)..(967): n equals a,t,g, or c
  misc_feature (1874)..(1874): n equals a,t,g, or c
tcnanngggaaatgcnccctcactaaanggaacaaaagctggagctccaccgcggtggcggccgctctagaactagtggatcccccgggctgcaggtttccaaacagaagctgtattccaaattctttcctaatgtggcatacaaagcctttaggatctggctcctgtgtgcctctcctgccgctgctgctgctgctgctgctcctgtttccgcttctgccatggccaccgccactgccgccgcctcctccttcttccctgcaccccttcgcgcctgccttccccgcgaccggcagcctgagctctaacaattctcaactactagcacctcttagactccaaaatgctttgcacctatttaaatgttttcccgtgctcttccctctacataaaatcatttctttccatcctgagtacccatggcaagctcctatcttccaatatttttacttaagcatcccctcttcttctctgcacccggagcatcttggacatagctttgtttccaccttgcattcacccactagacagtaagctttttcaagacagatactgtctcttcttcatctctatatctgtagmmcagggtttctcagcgtaagtactgaaggtattttggactggacaattctttgtgtgcagctgttttatgcatcatataggatgtttagcagaacccctggcctctacccgttagatagcagcacgcccccttccctcagatgcctccaaatattgccaaatgtccccttgtggacaaaattgtcccatttatttattgagagacggaggctggatgttgtcgcccaggctggagtgcagtagcgcgatctcagctcactgcaacctctgcctcccaggttcaagcaattcttatacctcagcctcctgagtagctgggattacaggtgtgtgccaccacacgcagctaattttgcatttttagtagagatggggttttgccatnttgcccaggctggtctcaaattcctggcctcaagtgatccacccacctcggcctcccaaagtcctgagattacaggtgtgagccactgtgctcagccaattgtccccatttaagaaccactaccctggaaaccagcagtaaccagaccctggtgggtgctgagaaaatgttgaattattcagatagttgattcacattgaattgtatacatcaaatgtaagaattatgaattacatttcaataaaacttttttaaaaaaagtattggtttactattagttattattagtggcattattatgaggtggtttccatttgttttcctcagtggccaccagtgcaactgattttgtcatatactgtactcattgatgccaaatatatatatcttattttatgctgacttcaaacctgggaagttgatttgtttatctcttcttaacttttwggaaatgcagacacaaaaagattcagcaaattgcttaaaatcgaggtaactagcaagcatatatcaagggatacatgactcggcttctgtctagtttcaaagcctgtactcattccatctgaccatgttgcttccataagccacatgccagccacataatgaatttcttgattagaatacaatgcatatacctaccaaagatagtatgtgcatatagcaaatatgagcaatttctaaataatgggagcattatttttgttcaaaatgctaaaaactggggccaggcgtggtggcacacgcctgtaatcccagcactttgggaggccaaggtgggmrgatcacctgaggtcaggagtttgagaccggcctggccagcatggtgaagccctgtctctactaaaaattcaaaagttagctgggcgtggtggcacacgcctgtaatcttagctactctggaggntgaggcaggaaaatcacttgaacccggaaggcagagattgcagagccaagattgcaccagtgcattccagcctgggtgacagagcaagactccatctcaaaaaaaaaaaaaaaaaactcgag

SEQ ID NO: 2800 - DNA, 2203 bp, Homo sapiens
ggcacgagcaagctggacctttgtcatttgaaggatctcctcctaatgccatctaagcttgagaggttcatatggctgcagcatggtttatcttgctgtttaaacattgtgtccattcaagctccattgtagacctttcttttaaagagagttcaccctgggatattaaataaaatggaatttggatggaaagttggcatcccagttcggaaccaatttttattgggcacagacttggggggagcagaaaaaaacaaacacaaagtctatgttgtaaatgataataaaaaaagaataagtaaaacaaatgaaaatgtttcgttttactaaggcttttttgcattcccatgacttcaaaatacttttgcattttatggcaatctataactgctttagtatagacagacaaagaacaaataaagttacataaatgcagagaataacagaagaaatatgtagaatgacagtggtcagttggtaaagattctattggaggttttggaggtttttgcataatttgtattagtccaaaaatattatgaaattaataataaattttaaagtgtatacgtttcttaatgtcttcaacttgccaattctgttgttagtcataaacttttatattcctccctatgtttatctttcccatctctccggcttgcttttgttattactgttgctgattctcaaaaccattagatcttaagtatattccactaccaaagtcattaattttaaggagaaaatgggaagttagaagccatgattttacttataataatccatttgtctcatactttcatctcaaaaatatgtatttaagtagaaagagagccagaaaaataaccgagagagttatattgtaattctggctctactgtatactagtagtgtgattttaagttggtaatttatcctctgtagcctcagcattgtcttctgaaaagtacgttcactcattcgggtggcgtgagatttaaaagaaatgactcctggtagagtagaatgaagtagaatgtagaatgcggtagcaatagaatgaagacatgagtattgatgatgtagcactggactgtgctatatgatagttaccagccacatgtggcttctttaaatttgagctaattagaattaaattaagttaaaaatttagctccttagtcatacgagccacatttcaaatgctcaaaaccatttattggctagtggctacaatattggacagtgcagaagaactattccattattgcagataatcctgttgaatagcacagacctagaatgacagctccgtgtagggcactgggaattgctgtttggggatggtatcaccttgagttggtctgtgacctgctgggagtaatgcagttctcaaagaactctaactctcctttaaccgcgtgcaaaattgtgaacctgggatgcgtgagggagtggttattttgtgctgaatggtatgtcagctacatcaccacagatgtgagatcagcagacttgcttattctgagtgccgtcagaatcgttaagtaccatatgtccagtgtcatctttggcacatttatctggcttcatctgagttccgaagtgaaatctcacagccgccttcataaatttagccatcaaagaccaaggtgatgatgacataccaagctttagaatcctcaagtagggtgggatattggtgctgggaatgacgaatgaagggacatctgagaatcatgctgcttttatggattagcagaaattcatcttacgtgaccaagagcagctgcataatggctagaaaacatttgccctttctgcttatgttttggttatcccaacacattctatgtgcaatgtctgagtttgaaagttctttttaaactataaaatcatttcccaaagttaggactgattatgaatatcatcaatgattgtttttaaatgtcattatggtaaagtcatagaatagtgaccatctgtgctgcctttgtctttgtataggtgcagtagtcccagcctttctttctctctctctctctctctctctgtgtgtgtgtgtgtgtgtgtgtgtgtgtgtgtgtgtgtgtgtgtgtgtaggatcactggagtatggtggtgaagaaagctgtcacagcacagaagttcagaaggaggtactgtgaaggtcccaaagcattgagcttagctagttctgaaagcactaaggttaactagtcaa

SEQ ID NO: 2801 - DNA, 847 bp, Homo sapiens; identical to SEQ ID NO: 2087

SEQ ID NO: 2802 - DNA, 3279 bp, Homo sapiens
ggcacgaggttttgaaaaggcagaaatggcagctgagtgtaaaatcttttacccttctgccgggggtttgtagaatgttctcagtttaaggctgtgagtgtcagtggtgcttggctgtcactggacctcaatgagtttaccatcaggtgtttaattcagcaccttggccaagcctccctttgttcagcaccttggccagtgccccactctgttcagcaccttggccagtacctcccctgggcaccgtaggctgaagactctgtagggagactgcattaatgagcctctgccttgtgctcatgcggaggatgggctggattgatctcctcttgcctgagttgggagctctcagagtgttccttcatttatttctggtggccttgagaacaaagaggtggatctttaggactctgggacagctgacatgtgtgaatatcctgggagacagcagaaagaaaagggaatgtaggttgaacaaaagacaattacagtttggggagaagactcttcaagtaccagagaggttggttgtcagacacagtccattctaaggggttcacagagacacatcccggagcctggggcacagctgaatgcagcaccttcccatcattcctgcatctcgggggcctgcagtcaccagctgggtgattgcttgcaattcacttacccttacttttgtaacctgagtttacatttatagcagtcgtaggagaggaagggattcaagaggaatttgagacaagggagagagccttaatgtagggctggtgttcatgtttgattggcttcagcactaaacttcccagatacccccaacaattctaacaaatggactgagaagaaaaattctaagcctgagctttgtgtgtcttttcttaagagctgcaaaggaccctgatgctgtggctgtaaaaaatcacaacccagacaaggtgtgttgggccacgaacagccaggccaaagccaccaccatggagtcttgtccatctctccagtgctgtgaaggttgtagaatgcatgccagttctgattccctgccaccttgctgttgtgacataaatgagggcctctgacttgggaaagctgggcacaaaaatcttcatgagcaatatttctttcttaatagaatgttttattattcaagtcaagttctagagtgtttacatactattatataatgtacagtgttattttctgtacttctgaataaatgtgcaatattggaaataatcctctgcctccagtatttttgttagttataaacatcgcttatttaaatatgtgtattacctactttgggatttggggtcactagctggtaatattacattgcggtaaaagaaagttagaaaatcaaagtgtccagcacatctcccaccctacaaggaaaacacacattgatattaggacatttccaatgtcagtcccagctgacctcacccagctggagtagctcgttcggctctcctgagagctgtggtcgctggcacctagttcctccaccacggataatggtccattcatctaagacagtgagaggagccaggcaggacctcccttgcattaaagtcatctgatctgtgtaaaagaagtcctgagctcagtggcctcaaggggcacatttggaaaaccagatttctcctgctgccacccccagatcgtcagagcaggtgcctcctttgtggatcacgataacactgatgtgcgttgatccagccatcagcatcttcaactataatagggacttccaccaaagcccagactttctggaccacagtgagaaagcaaagaaattttatctgaggatagcaggtaaacatgaggaatgtgagccccctttaattatcattcccagagaggaactgaaatgaaacagcagtcatgtctcactgcccccttgagctaaataattacctcctgaagccacttgctatatgggctctggactaactgatgccaagaagccataaaaatccatacgctggacaccaaaactcataccttataatccaaccctgtagaaccaatcactaaccaatgtcatctctgtaaaccagtgagaattcctgtattagccactcctgatcacctttgccttttttttttttttttttgagacacagtcttgctctgtcccccaggctggtgtgcggtggcgtgaccttggctcactgcaacctccacctcctgggttcaagctattctcctgcctcagcctcctgagtagctggggttataggcatgtgccaccatgcccggctaaattctgtatttttagtagagacagggtttcaccatgttggccaggctggtctcagactcctgacctcaaatgatccacccacctcggcctcccaaagtgctgggattacaggcatgaaccactgtgcctgccccctttgcctttaagaacctactactaacaggccaagcagagcacttcccaaagcaacctggaagtgcgtcccggccacggtcctcaaccttgggccaaataacctctctatgttaattttgtttcagtttctttccttaggtcaaggacagcaacaggtagcaggaagccctccctcgcttcttctgctcccagttgccttctgttccggctccttcccctaagcctcctggaactgctttcgagcacgagaaaggcataaccgtcatgtatactcctctcatgaactaaacccttgcttgtgaacatcacatgtagacaatataaagaattattctagcctgggtaacacagtgaggccccgtctccaccaaaaataaaaataaaaaaattagctggatgtggtgtcccacacctgtagtcccagctccgcaggcattgaggtggataatctgagccctggggggaggcttcagtgagccgggtctcaccactgcactccagtctgagtaacagagtaagactctgtctccaaaaaataaaaataataaataataattattaactagtaacagttggttacctactaaaggggtaaacaggaaaacaggaatagcaaatgaaagaaacagctgtggcttccaggtgatgggtgaacaagggtggaaataagcatctggggggctgcctgctggctgaactccagggatctgggcagagtgtgtgggagtcttgggaatattcaggattcccccaaccttagtgctggggaaacaggccagaggcaggcaggcctagcagctctggaggggctgccgttggagccgagcaactccctggaggctgccctgagaccctcgtcctggaagtgatctctcacc

SEQ ID NO: 2803 - DNA, 1768 bp, Homo sapiens
gaattcggcacgagaaaagaggaagagagagtggcaatggtaccaagactagctttcattcttttcgttcttgccagggattacaatgtcacaagcctggggcaggatcttaattggaagtatgaagctaaggattatagaaaaacaggtgaactgaagaatattggagagtgtggccgatcttataagttcctctcaagaaatcaagactggaatacaaggtattcacaccctaacaggcctgctaagtactcaggaatagatgagatgtgcaaggcccaggagtctggactctcaccgagcaagcagctgaacaggctttcaacattaactgccctcaaggtatctcaacctgtgaaactagccctgttctccaggagtccaagaagagagatacgagtgggacgctaacagtactccaagaaagattgaggggcttctacagcaaaaaatgtatttgtctggattctcagaatgtagcaaaggagattgaaggcagtagagcagccctgcatctaacaagagccctaagatgtagagtggaaatcgttggtcttaagacagttcctcagattaccccacaaccaatatgatgttgagagtgcaatcaagagtctgkatatattcctaggacccacccagaaccatgaaatcagaatcactggaaatatatgtttcttaacaaagtacaataagagagtcttatgatccatccaaactgaaaaaggaaaccaggcagatttggttgactcttgttttcctgtttctattcccctgaacagatgaagatcaagaggcattccctacaacctcaacagaaactcttattattaaagaagaccactctacatgtgtgcatgcgcacacacacacacatacataccccactaagaattagaagaacctccattacccccatcaattgccttcactctacatgtagacaacatgtgagaagcaaaagagagaaccatgagatcacagtccttaggacatgtccagtgcttgtgctaagacattaattctcttcctttcaaataaggaaatggaggggtcttttcccttccccaaaccaaagaaaagagatttcaaaaatatcacttgtcaagactacaagtgcaagactacacgactcaattgccagttgctaagagggcctgggacattctgccagtgttgagatctatgaggaagaaatggtgctataggttcagccagatagagatctcccacaggatgtgagagaactgtgcagcgttccatgcaagtttcagcatgttgacacttgcttcctaagaccatgaagtggcactcagtgtcaggcagagggatgggaactatgagaaatcatgcaagtggcatcacttctccactcttgccaatcacaaccctcaacactagaggagttatacattgatataggaagataatctgggttccaagacagagcaaacctccttgagccctgccttcctgccctttcccctcccagggattgaaggagagtgaaagagcatcctgcccactccaagtatctcaagccaaggcctacctggtactagtgggagaaaggaagatgacatttaagtgggagtgtgaaaggtgttttaaactgaatttacattaattgaaactggcaggaaaagccacagaagctgccagtgggttgttaaggatagaaaaaaagtattcgttaaaataagtttaaaaaaaaaaaaaaaaaaactcgagggggggcccggtacccaattcgccctatagtagtcgt

SEQ ID NO: 2804 - DNA, 2343 bp, Homo sapiens
ggcacgaggctcaagtaatcctcctgcctcagcctcccgagtagcttggattacagggatgcatcaccatgcccatctctcctgctatgacttcttgatgctacttttcctgcttctccacccactgcttcccccaccacccactgccagtcttcctccatctccccttatctgcctgttcttacacactgttccctggaatctctccttggcctcttctcactccacacattctctcagggccttgccttttacttcagccatcgtctatactttcactctagaccactcctctgagatttcccaacttttacatccagatggctgctcagcacctccacctggatgtcccacaggcaccctaaatccgaccagcccaaaactaaactcatgatcattccaaacctgctctaatgactcttccatccacacagttgctaaagccagaaatcagttcttcccttttctcacctggtatatcaatcaaccagggattaagtaagtcctcattaactctatttgtctgttcctttccatcaccattatcaccattctgacttaggcctgagctgtcctgagttattgctcccctgcattattttgattaccttctcatagaggtctgaccctctgatctgtactctccaccagggtttctcaaattggcactactgacattttggaccagataatgctttattatgggagctgctaagtgccttgcaggatggttagcagcattctcagcctctacccactagatgccaatagtctcccacccattgtgacaatcagaaatttctctagatattgctaatatcccttctggggggcaaagtcacccctggttatgaaccactgctctacattgactaccatttgcataaacaaatctgataatattgctatagaaaaaagctcaaaccctctgacttggctgagcctccctgcagtctcatctcccaccttcccatctccagtcttaactccagagatcctgagcccctagtaggcccttgaacaaactgggccctcccacacctctgtgcacctcacctctgcttggaagccttcccccatctgatactctcataaattgctcattctttaagtctcaactcagggatcccttccttcaggaaagcactcatactgcctatctgtacctcatatatatccccaaatggaaatgttcttattggaatgaaactatttctttgcacatgaatctcccctctataaactccttaagatgaggggagtgacgcattcatgactgtattccgtgtctctaatacagtgactagcacatggtagacattcaatacatgtatattgaataaatcaaacattaagacttcttgtgacagttgtaaaccccaaatggtcatttttaccccgattctctatggttactaatagtaaaaactccaggaaaccacctggagagttgccctcttgcttcaggcactagtgaggagagaagtctggaagccatagcccattggtcctggacaagaaggagagtaaacacgtggaagagtgggtggtggagctgcacagcagcaggcgagcaaatatgcagagtctggccagaggacaagaggtcagccaggcccagagctagcctggaagtctatgccctgaggagatgttcaagagtctggtggagtttggagacataaggacactaagcaccagcctcctaagaggactccctgcccactgtcctctctcctgctgccattctccacagtgcagccaaagcaatctttcttaaagacatatcagatttgcttagagtccttcacttgctccctatgattttcaagataaagttgaatttgtgacctggctcctgtctactgtcttttctcatctcccccgactctttctcattagtacagctgatgccagcctgaacaatacagtctcctgaacacgtcctggtatttgttcagcagctctttccttaggcctggagtctccatctgcacacctcatattatccatttggcaaagtttcattagttcttcaaggcccctcctctgggcttccacagcactcatacgccacctgctgcagcactagttgctgatgtgtctccctatctagactgtgaccaccctgggaacaggattgtctcttttctttgttctctgggcctagcacagtgctaggcttacagtagttaaataaaatcttgaacatatgaatcaaggaacgatctgtcacacacctgctgatccaatcacccttaaagccagatagctaacttaataaaacccaacctgatcattcacttcccagctcaaagaaattcagtgatctcctcgaaaaaa

SEQ ID NO: 2805 - DNA, 644 bp, Homo sapiens
  misc_feature (529)..(529): n equals a,t,g, or c
  misc_feature (561)..(561): n equals a,t,g, or c
  misc_feature (582)..(582): n equals a,t,g, or c
  misc_feature (593)..(593): n equals a,t,g, or c
  misc_feature (615)..(615): n equals a,t,g, or c
  misc_feature (621)..(621): n equals a,t,g, or c
ttttaaatatctatatacttttaccataaacattttcatgctatgaaagttgttattaatttgtccatattcctacctaatttataaatcactggggctaaaggatatattattcatggtaggcaaacagttgcatcatcacacctaaattttagtaattattaaaagtccaacatgggtgttctttggtacaccttctggtacacattcactcttctggaatgttctcgtagtagcaatgactcaaggaccttagtgcttatctgcttgtctcttctaggatttgactttgtcagagtccttaacattaaactcgcagttggggaaagtacattacatatgctctccctccctttttctctccgcctttcccctgctctccccttctcacctttccttcttttaatgaacaagcccctcagtgatgtgcaatatttcaatctacattttgctggctaggacttaagtcatatgctacacacatcactcttgcatacaaccctttcagacaaaaggtctggattaaagnaggcagcaatttttttaaaatggaaaggtggngatgactaaatgaggacagcnataaccaaccnaataaactaaaaatcccagcanctggancaaggggtagaggggctgggata

SEQ ID NO: 2806 - DNA, 676 bp, Homo sapiens
  misc_feature (624)..(624): n equals a,t,g, or c
  misc_feature (626)..(626): n equals a,t,g, or c
  misc_feature (644)..(644): n equals a,t,g, or c
  misc_feature (661)..(661): n equals a,t,g, or c
gaaacaagtaaaatatctaggctagcagagggcgaagagtgagattatttctatgtgcatcatttatggctgaaaaatagaaaaatgacgcaagtgatagcctcagcaaaacatctgcatgaagtaaaagaggtggctgtttagtgaatccccataaaaagagaggggaaaaaaggtctgtaacagtgaaattatcctaactcaagggatgctcgtagcatggtgcctggcacctggtgatcttctgctgcttgtgattataactctcccaagaaaggaagtcacaggaagcatgtccactgtatgccagtgtgaagcccagccagccatgctcccaaagggccactttacccaccacagtcccaaagcagccaggaaggctcaagaaggaacaaggaaggccaggtgggtggccttggaggactctgctccctttcatccatccccaggctgggggttaattttgcagctgcacccccagccaatgaattgktctcaaagtgcatggaaacactgctgttggaaaaactgtgaagaaccatwagagggcaagaaataaaaatgctgaaagaagccagaccccaaaagccaccatattataggattccatttacaggaaacatncngaagagaaaatctatacngaccgagagtagattgncaggggctgaaggaa

SEQ ID NO: 2807 - DNA, 572 bp, Homo sapiens
  misc_feature (443)..(443): n equals a,t,g, or c
  misc_feature (474)..(474): n equals a,t,g, or c
  misc_feature (509)..(509): n equals a,t,g, or c
  misc_feature (556)..(557): n equals a,t,g, or c
ggccaccctcagaggctctgctctctgcaaagccctctgagcccttcaaagcctggagagacacggctgcttggggacatggctgctaatggcatcaactgcagtgagtcctggggtacgtgctttattccttccttccaggaggagggagccacacattgtaatagtttttaggaatttgaacctccaatgaagagggaaggaagatgtgtcctccacatgcacccctcctcccctcccagcagactttctttctttctttttttaagacagagtcttgctctgttgcccaggctggagtgcagtggcgtgatcttggctcaacgcaacctccgcctcctgggttcaagggattctcctgcctcagcctcctgctgccctcccagcagcctttctaggagatggagatggcgtgaggtccccgagggtctatggggccttgnctgggtgktgctctgctccctttctgcggantggactgctcttaaaggctcaagcccaccttttgntgcaaaacaacttgggcaccacaggaacggaatcaatttggccgaanngagcttacccaaggg

SEQ ID NO: 2808 - DNA, 479 bp, Homo sapiens
ggcacgagctttgctggtagtccccgcctaactgtcagagagcttcagtagatgggccccagaggatgtgcacttgcccacagcctcctcccactgctttgccagcatgtgtggacctcaccacgctattgccgccagtgcacacgtgaacctcgccactgctgccctgcccctgccagtgcaggtgtacagtacatgtgtgcatatggatgccaccaccccacatttgctggtgtgtacacaccctcccacaccactgttgccaccagcatatgcacacagacaccaccacatcaatgctgctggagtgagcacacgcatgtggtctctaccaccccactactgccggcatacatgcacatgagcatggaccctgctgccaccacccaaatgaagtgcttttgccggcaccccatcagagcatttttaccagtggagtgggaacacctcagcccctccaacacagcaggtgcttaacc

SEQ ID NO: 2809 - DNA, 1505 bp, Homo sapiens
gtccccatgctattctcatgatagtgaacatatctcatgagatctggtggttttataaaggtaaagttcccctgcatatgctgacttgcctgctgccatgtaagacgtgccttgcacctccttcaccttcctctgtgactgtgaggcctccccagccatgtgaaactgtgagtccattaaaactcttcttctttataaattacccagtcttgcatatgtctttattaacagtgagaaaatggactaatacattaggtcatgagggtggagctctcattaatgggattagtgccttatgaaagagaccccagatagctctcaagctctctttctgctatgtgaagatgcaacaagaagttagccatctgcaacctggaaaaaggccttcaccagaacctgactgtgctggcgccatgacctccagaacaatgagaagtaaatgtctattatttataagcccacccagtctgtggtactttgktgcagcagttcaaactaagacagcaacaaatataatttaaaaaaatatttcaggcaaaagccctcaatggattctaagattaatgggtgcaggctgggtgtggtggctcatgcctgtaatcccagcactttaggaggccaaggtgggcagatcacttgaagtcaggagtttgagaccagcctggccaacatggtgaaacctcatctctactaaaaatacaaaaattagctggscgtggtggcatgtgcctgtaatctcagctactttactttggaggctgaggcaggagamccgcttggaccccggaggtggagattgtagtgagccaagatcatgccactgcacttcagcctgggcaacagagtgagactctgtcttaaaaaaaaaattaaattaaactaatgggtacagattggataaggaatgggacttgatatagtttgagatcctycccacagaaaacaatgggaaaagagtaactttacagtggatagaccttgtagatgccaccttaatcaagcaatcgaagttaacatcatcagtaatggggcaaattgaaatcatgcaccacccgataagatgcagtgagaagaacatggcatcacttctgtgatattcctacctcaagttcataacttgaatctaatcattaggaaacatcagacaaacccaaaccaagagacactctacaaaatcatgacctgtgatcctcaaaatttacaaggtcatgaacagcaaggaaagactgaagataaatgcactgtatgatactggattgggtctttttgtgacaaaggatatttgggacaaatggcacaacataaataaattgtagtaaagtgtttatatttttatggttgcattgtggttgtttaggtgaacattattgtaggatttacacataagaatattcatgggtgatggaatatcctgtcggcaatttaccatcaaatgcttcaggaaacaaaactgttcgcactattcttggaacctttctataaacttgaaattatttccaaaaaaa

SEQ ID NO: 2810 - DNA, 514 bp, Homo sapiens
  misc_feature (508)..(509): n equals a,t,g, or c
ggtacaattgatcccgtcacctggggtacagtacccaataggtagtttttcaacccttcccccctctagtaatcccccgtgtctattgttcccatctttatgttcatgagtacccagtgtttagctcctacttataagtgagaacatgcagtgtttggttttctgttcctgcagaaatttatccacttaggataaaagcctctagctgcatccatgttactgcaaaggacacgatttcttcttcttttcttttcttttgtttcttctttctttctttcccttccttccttctctcttttctttctctttctctctctctctcttttctgcatccatgttgctgcaaaggacatgatttcttcttttttctctcttcctttctctttcctttctttytktctttccttccttcttccctccttttctttcttttactttttcttcttttggctttctttcttcttctkgagcaaargtcttgctctkgtgcccaagsccggaatgcaannagtgg

SEQ ID NO: 2811 - DNA, 3817 bp, Homo sapiens
  misc_feature (1)..(1): n equals a,t,g, or c
nggcgcggcggcagtcggctctatgttcgcggtcttaacctctcctctggccgagtccttgcaagaagtgaattacccgaccctgcaaaacacttactattttggagtttaaagtatgtcatcatggcaaagtttcggagaaggacttgcatcattttggcactttttattctatttattttctctctgatgatgggtttaaaaatgctgagaccaaatacagctacttttggagctccttttggacttgaccttcttccagaacttcatcaacgaactattcatttggggaaaaattttgatttccaaaagagtgacagaatcaacagtgaaacaaataccaagaatttaaaaagtgttgaaatcactatgaaaccttccaaagcctctgaacttaacttggatgaactaccacctctgaacaattatctacatgtattttattacagttggtatggaaatccacaatttgatggtaaatatatacattggaatcatccagtgttagagcattgggaccctagaatagccaagaattatccacaagggagacacaaccctccagatgacattggctccagcttttatcctgaattgggaagttacagttctcgggatccttctgtcatagaaactcacatgagacaaatgcgctcagcttcaattggtgtactagccctctcttggtacccacctgatgtaaatgatgaaaatggagaacctactgataacttggtacccactattttggataaagctcataaatataacctaaaggttacttttcacatagaaccatatagcaatcgagatgatcaaaacatgtacaaaaatgtcaagtatattatagacaaatatggaaatcatccggccttttacaggtacaagacgaagactggcaatgctcttcctatgttttatgtctatgattcctatattaccaagcctgaaaaatgggccaatctgttaaccacctcagggtctcggagtattcgcaattctccttatgatggactgtttattgcccttctggtagaagaaaaacataagtatgatattcttcaaagtggttttgatggaatttacacatattttgccacaaatggctttacttatggctcatcacatcagaattgggctagcctaaaattattttgtgataaatacaacttaatatttatcccaagtgtgggcccaggatacatagataccagcatccgtccatggaacacgcaaaacactcggaaccgaatcaatgggaagtattatgaaattggtctgagtgccgcacttcagacacgccccagcttaatttctatcacctcttttaatgagtggcatgaaggaactcagattgaaaaagctgttcccaaaagaaccagtaatacagtgtacctagattaccgtcctcataaaccaggtctttacctagaactgactcgcaagtggtctgaaaaatacagtaaggaaagagcaacttatgcattagatcgccagctgcctgtttcttaatgcattgattaaagtttaatagttatcaaaatcacctaatttttaaaaatagctttcgttttgagttctggaaagaaaactgtcaaaatcagtatatactattagttatatttaaaaatatttttttaaattctttacagataatattatacttgttacccttcacaataccacatgagaaaatatctgagacaaaatgtatacaaatatattccttatggcataatttattgcatttctgactgaaatcaaaattctgatttgatggcaattgaattttcattttacaatagataaatgcttgtgttacctaaagcacttagcacacagttaaattatatttacatcctagacccaaataaataggattgtgtgtatatttgggatatctattgaagaaaaaaagaaaaccccttaaagataatgtacatgcttcatgtcatgtctttaaaataatttaatcaactttattgtcttagtatttagactctggataactctacaataatgaggaaattcttaagaataacaaaatcactgtaccttcctctcaattttgctgtgaacctgaaatggctttaaattaatactcttattttttatttaatttaattacataaattaaaccttaccatgaccaaattgtgttaggaaggcctgctatctacagcacagtgtgtcatttgcagatttgtggttacctataccacgctaggtgttttgacatgtttagtgtttctgctttacagtgctgaattccatattttagaagctatgaaagtccttttatgaaaaagttactgattgcttctcagttattaggaaaacagttgtttcacaattattatgtagatatgatgcccaaatatcatttttagtatatcttgtcgatctttaagttgttactattgtgttattcatgtctttaaatcagataccaaatattttttaggaaagaaaaatgttattactgtcattaggttgtcttttaatactttaagttattttgacgaaaagtaatagagaaaatttacttagcattttagattctagagacatggaaatgaaaattattttatgtctagagtaggtcctgaagtttggctttacattaagtttagcactgtatcagaatgaagaaactaatattttacataaaaactaatactttcaattttttatatagtaatatccccattttgtaaatgttagacttttatcatacctgtaagttaaaatacttgttatcaataacttgtcatattgtgacaaattgatcacttgtgtacgaaaaataaatctccttaaaaactaaataaaatgcactgtattcttacagttaatgtttataactatagtaaaaaattaatatatatcctattacataaatgttatttcttaggtgttccattaagaagagcaatagaataatgctaaaaaataatgcctataaatcttcagagtataaagacatccattcagaaacaaaaattagcactaaattttttataaaatagaccagatgacaaaatttattttatttttaaacagtggttttgacacaaattatgttattgaaaagcattattaatgtttaatttatttaaaattttggaatttgccatttctcagacaatgatcaggccttaggaaattaatacagtagtagtaatcattttctaggggaaaataaaagaataaatcactatactgatattttgatataagcaagcacttacatggtaatcactatatagatccaacctgtggattttcttcttatgtccatttaactagaatatattattttaggtataatttacaaatgtcacacctaataatcttttataatataccatatttcattaaagttttgttagagaagtatctaccacagaggagtttttgtcattgtgtacgttgtgtatttgaacccaccatgacagaaagtaaattttaggaaatagttatgagattaagggaaaatctataaaaacaaggttagcatattctcaacacagataccaccactttctttttcccattatagacatggtgaatccacacagcatacttcatctctgagctttgttgtgattcctcaacacattaccctaaccagccagcagtaacagatttcagagtaagataaagcagattctgtcttcattgcaaaaagttattctcaatggaagaatggcatctgatctcataattactagtttatattaatatagtttttttctccctttttaataaaattaattacagtccatccctccagtgtctgtgggggggattgggt

SEQ ID NO: 2812 - DNA, 887 bp, Homo sapiens
  misc_feature (881)..(881): n equals a,t,g, or c
cgactcactataggcgctacgaggtcgacggtatcgataagcttgatatcgaattccaaaaacctgatactacttcaagagtttctgctcagaagaaaatgagagttatcataataggaagctgtggcggtccatgccaactgtgctgtgtcacatacagcgatgagagtggctttcatacttttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgttaaaaaaggaattcctgcagcccgggggatccactagttctagagcggccgaccncttcgg

SEQ ID NO: 2813 - DNA, 613 bp, Homo sapiens
  misc_feature (602)..(603): n equals a,t,g, or c
  misc_feature (606)..(608): n equals a,t,g, or c
ggcacgaggtcatcccttatgtatagtagttaaaggcataaaactgtgacttttagatattccacagaaccagacttatttgatgtggataataaccaatgatttagcattttgtttgcttttgttttattttatccgggttcattttttactcttcccatgtacatgaaacaggtggtggcgtgtagagatcagctgatccttgttttatggttaattgaactactttgtatccagggtttctgcaaatccaaaagtgatttttcatctaggatctattcctaacagtctactccaatcccactttagttttccacaattttaaatcttaatagtgagaattcaaatgaaagtcatttcatttgactattctgatgacatgattgtggcagaataaattgggtcttaaaatgccctagaaaatggtaaatgattaaaaataatattttaaaattcaaccaaagaaatggcccattggccaggtgtggtggctcacacctgtaatcccagcacttttggaggctgaggcgggtggatcacctgagctcacgagtttgagaccagcctacccaacatggtaaaaccccatctctacaaaaaannaannnaaaaa

SEQ ID NO: 2814 - DNA, 1351 bp, Homo sapiens
  misc_feature (544)..(544): n equals a,t,g, or c
  misc_feature (774)..(774): n equals a,t,g, or c
cttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcytcggcctcccaaagtgctgggattacaggcgtgagccaccgtgcctgccccagaatggtttttaaagccacagttgagargccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagarctagaagcacagttcaaagttctggnttctggactctgcagtccaggtytcccttytcccacttgcctaccctcaatgccacactgtttttgaagtggcccataacttgaaggraaagtttaaagacagttcaatttaatcatcagratgcattcttttttttttcggaracggaktttcactcttgctgcccasgctggagtgcaatggtgcaatgatctcggctcactgcaacctatgcctcctgggttcaagngattatccagcctcagcctcccgagtagctgggattatgggcgcccaccaccatgcccagctaatttttgtatttttttttttagtagagatggggtttcgccaggttggccaggctgktcttgtgaaytcctggcytcaggtgatytgcccacytcatcytccaaaagtgctgggattacaggcatgagccactgcgcctggcytcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatgtaaaaaaaaaaaa

SEQ ID NO: 2815 - DNA, 832 bp, Homo sapiens
  misc_feature (821)..(821): n equals a,t,g, or c
  misc_feature (825)..(825): n equals a,t,g, or c
ggcacgagctccactcggtttctctctttgcaggagcaccggcagcaccagtgtgtgaggggagcaggcagcggtcctagccagttccttgatcctgccagaccacccagcccctggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacgtgacatgcatgacttctttgtgggacttatgggcaagaggagcgtccagccagactctcctacggatgtgaatcaagagaacgtccccagctttggcatcctcaagtatcccccgagagcagaataggtactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttttgcatatgaaaaaaaaaaaaaaaaaaaaaaaaaanaaanaaaaaaa

SEQ ID NO: 2816 - DNA, 1272 bp, Homo sapiens
  misc_feature (1264)..(1264): n equals a,t,g, or c
aggctgctacactaataggatgtagcaaagggcggaggaggagatccagaagcaaacacaagcaatgcaagaactccacagagtggagctggagagagagaaagcgcggataagagaggagtatgaagagaaaatcagaaagctggaagataaagtggagcaggaaaagagaaagaagcaaatggagaaagaaactagcagaacaggaggctcactatgctgtaaggcagcaaagggcaagaacggaagtggagagtaaggatgggatacttgaattaatcatgacagcgttacagattgcttcctttattttgttacgtctgttcgcggaagattaaacttaatgaaaatctgtttgtattttctgcatattctctggcaaccttgccccatacttacttatttagcatagtcgagtgctctagtttctgtctctcaggcactcgtaactaaggaccaccattggccattggtagatgtttgattgacttaacaagagagggacaaattttcaatttgtgaaactccaaagcagaaagtattggtgcttgctaccttgtgaattcttccttagacatgcagagaaaatgtatgcaagagaccaaaaagatggctccaagctatgtcatgttacctgtaataaaatcttttcttctagattctttctatgttggcagataatctccccttgtagcttccactcacttattcttgcattcagagtcacaatgatcatcttacccatgtggtttttgagaaagaaagatcaattctttgtttgcagtaggtaatcttagagatggagatgattgtagaattattcctagatgagtgtcaatttatttaattccattgtcatataaggagtcaaattgtttcttatcatttgttcattgaagaacagagacctgtctggaaaatcgatctctacaaattcaattaaataatgatccccaaatgsykmaaaagtgaaatacagcaattcaacagataatagagcaatgtttagtatattcagctgtatctgtagaaactctttgacgaacctcaatttaaccaatttgatgaatacccagttctcttcttttctagagaaagatagttgcaacctcacctccctcactcaacactttgaatacttattgtttggcaggtcatccacacacttctgcccccactgcattgaattttttgcttatgttgtttataataaaacttttcaattatctcataaaaaaaaaaaaaaaaaaagggggggcccggnacccaatt

SEQ ID NO: 2817 - DNA, 601 bp, Homo sapiens
  misc_feature (115)..(115): n equals a,t,g, or c
  misc_feature (184)..(184): n equals a,t,g, or c
  misc_feature (539)..(539): n equals a,t,g, or c
agtaggggagactgagactgaccggtagccaggcaggcggacgacgcacgcccggacagactgagcaggcgccggagaaccactcacaggttccccccgcctttccctttgaaanctaggcttttgcctttcccgtggcgcccgagagagaatgctggactctgccgacttcagcgcaactaangatttctcaagctaggggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagncacctgagctgtcgcgaactctcgctttgatttcatcccgagagccaccgagaagaaaaaaa

SEQ ID NO: 2818 - DNA, 914 bp, Homo sapiens
ggcacgagtgaaaatctactctatcagctgctgtggttgccaccattctcaggaccctcgccatgaaagcccttatgctgctcaccctgtctgttctgctctgctgggtctcagctgacattcgctgtcactcctgctacaaggtccctgtgctgggctgtgtggaccggcagtcctgccgcctggagccaggacagcaatgcctgacaacacatgcataccttggtaagatgtgggttttctccaatctgcgctgtggcacaccagaagagccctgtcaggaggccttcaaccaaaccaaccgtaagctgggtctgacatataacaccacctgctgcaacaaggacaactgcaacagcgcaggaccccggcccactccagccctgggccttgtcttccttacctccttggctggccttggcctctggctgctgcactgagactcattccattggctgcccctcctcccacctgccttggcctgagcctctctccctgtgtctctgtatcccctggctttacagaatcgtctctccctagctcccatttctttaattaaacactgttccgagtggtctcctcatccatccttcccacctcacacccttcactctcctttttctgggtcccttcccacttccttccaggacctccattggctcctagaagggctccccactttgcttcctatactctgctgtcccctacttgaggagggattgggatctgggcctgaaatggggcttctgtgttgtccccagtgaaggctcccacaaggacctgatgacctcactgtacagagctgactccccaaatccaggctcccatatgtaccccatcccccatactcacctctttccattttgagtaataaatgtctgagtctgaaaaaaaaaaaaaaaaaaaaaaaaaaa

SEQ ID NO: 2819 - DNA, 1593 bp, Homo sapiens
gcggacgcgtgggctgtgctccctgcagtcaggactctgggaccgcaggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcaggcgtgcaaatctgtctcgcctgcaggaagcgccgaaaacgctgcatgcktcamgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatcaaaaaaaaaaaaaaaaaaaaaaaaaaaactcgaggtcgacggtatcgataagcttgatatc

SEQ ID NO: 2820 - DNA, 1814 bp, Homo sapiens
  misc_feature (1764)..(1764): n equals a,t,g, or c
  misc_feature (1775)..(1775): n equals a,t,g, or c
  misc_feature (1781)..(1781): n equals a,t,g, or c
caagctttgtacttagatcttttacttagatctgctttttgtcttattctttttagtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaawtacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagcaaatgctgacttcttttctttctagtcttaacactccctttctaatncatttccactnttgtantgttctcaacattacttggtagtgacaaacttt

SEQ ID NO: 2821 - DNA, 705 bp, Homo sapiens
  misc_feature (349)..(349): n equals a,t,g, or c
  misc_feature (409)..(409): n equals a,t,g, or c
ggcacgaggccatctgggctcattcagcaggaaataatggaaaaagctgcaatatccaggtgtttactacaatctggaggcaagatctttcctcagtatgtgctgatgtttgggttgcttgtggaatcacagacactcctagaggagaatgctgttcaaggaacagaacgtactcttggattaaatatagcaccttttattaaccagtttcaggtacctatacgtgtatttttggacctatcctcattgccctgtatacctttaagcaagccagtggaactcttaagactagatttaatgactccgtatttgaacacctctaacagagaagtaaaggtatacgtttgtnaaatctgggaagacttgactgctattccattttgggtatcatatgtaccttgatgaagangattaggttgggatacttcaagtgaagcctcccactggaaacaagctgcagttgttttagataatcccatccaggttgaaatgggagaggaacttgtactcagcattcagcatcacaaaagcaatgtcagcatcacagtaaagcaatgaagagcagttttccaatgaaaactgtgtaaatagagcatcaacaagtacaaaattcttgtcttaattagtgggggtatataaaaattccttgtaatggtcaaatattttttaaaattgacattaataaagcatattttaaaagtttct

SEQ ID NO: 2822 - DNA, 1307 bp, Homo sapiens
  misc_feature (395)..(395): n equals a,t,g, or c
  misc_feature (696)..(696): n equals a,t,g, or c
ggcacgagcggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcanggctgcagttgggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgngggtgtcttcgattgggggctttttttttttttttgcacttctgaggctagatatgtctggctgaagatttgatgtgggtcctccttaagctatgcgtcctgtaataataggtactgtactgggctctgtgtaagtgtcgttggggtaggacctatattttaatactgtccctaacaattcattttactagcgagaaatctttgatttcattttatcctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaaaaaaaaaaaaaaaaaaaaaaaaaa

SEQ ID NO: 2823 - DNA, 2318 bp, Homo sapiens
cagacctcggacgagagcgccccggggagctcggagcgcgtgcacgcgtggcakacggagaaggccagtgcccagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccagaagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggagggaaacgtgtattgtggtctcaagacttgccccaaattaacctgtgccttcccagtctctgttccagattcctgctgccgggtatgcagaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtgtgtgtgtgtgtgtgtgtgtgtgtgtgtggtaaaggggggaaggtgttatgcggctgctccctccgtcccagaggtggcagtgattccataatgtggagactagtaactagatcctaaggcaaagaggtgtttctccttctggatgattcatcccaaagccttcccacccaggtgttctctgaaagcttagccttaagagaacacgcagagagtttccctagatatactcctgcctccaggtgctgggacacacctttgcaaaatgctgtgggaagcaggagctggggagctgtgttaagtcaaagtagaaaccctccagtgtttggtgttgtgtagagaataggacatagggtaaagaggccaagctgcctgtagttagtagagaagaatggatgtggttcttcttgtgtatttatttgtatcataaacacttggaacaacaaagaccataagcatcatttagcagttgtagccattttctagttaactcatgtaaacaagtaagagtaacataacagtattaccctttcactgttctcacaggacatgtacctaattatggtacttatttatgtagtcactgtatttctggatttttaaattaataaaaaagttaattttgaaaaatcaaaaaaaaaaaaaaaaaagtcgaccggcmgcgaatttagtagtagtagtagtagtagtaggc

SEQ ID NO: 2824 - DNA, 601 bp, Homo sapiens
ggaattcggcacgagtgcacatgtgagcatgtcacttccctgcttaaatttctccagtggattcccagggacttcaggatcaagtcctagttgttcagcatggcatccaagactctttatgatctggcccttgcttacctctcagccttagctctcccaactcttgcacagtcactgctcttcagccatagtggatcactcaccattcccagatgtaccaggctctcgcacacctctgcacctttgcacgtgctgtttgctgtgcgtggaatgcccttcactgtcaccaccctgctcatccactctactaatgcctcttcattcttttatactcagctttctttaaagttcttctaagctgagttaggtgtctgtcctttatgatcccgcagtattccatgaatacgtatattctcacatttattgtactgtattataattgttgaaaacttgtctgtcccatttagaatgtgagctccttgagagcagaacggtgtcttcattatctctgtatccccaaggctttgcacagtgccttgctcatagtaggttttcaataaatgattattaaataaataaaaaaaaaaaaaaaaaactcgag

SEQ ID NO: 2825 - DNA, 2422 bp, Homo sapiens
  misc_feature (388)..(388): n equals a,t,g, or c
aggcccttctggaacacagcagggcctacaacgaggggcctttgcaatgggctgtgaggatgggggtggtgggaagaattggccacgttggagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggcacntgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaackcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggtaaaaaaaaaaaaaaaaaaaaaaaaaaaaaaaaaaactcga

SEQ ID NO: 2826 - DNA, 770 bp, Homo sapiens
  misc_feature (690)..(690): n equals a,t,g, or c
  misc_feature (762)..(762): n equals a,t,g, or c
ggtagggtcgggkcgaccyrcgcgtccggctcttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcamctctatctttctttctctctctctcaaactttccttaaagttctcattgcctttgcactgcttctgtgaacagtctttgtctcctccccacctttggnggaaagtgcggggcagtcctggtcaagacactcatgccctggcaatgtggcctgcagagaatgttgttgtanccaccagt

SEQ ID NO: 2827 - DNA, 1402 bp, Homo sapiens
agggacgtcttgcctgaggagatgcccatttctgtcctggrttaccctcactgcgtggtgcatgagctgccagagctgacggcggagagtttggaagcaggtgacagtaaccaattttgctggaggaacctcttttcttgtatcaatctgcttcggatcttgaacaagctgacaaagtggaagcattcaaggacaatgatgctggtggtgttcaagtcagcccccatcttgaagcgggccctaaaggtgaaacaagccatgatgcagctctatgtgctgaagctgctcaaggtacagaccaaatacttggggcggcagtggcgaaagagcaacatgaagaccatgtctgccatctaccagaaggtgcggcatcggctgaacgacgactgggcatacggcaatgatcttgatgcccggccttgggacttccaggcagaggagtgtgcccttcgtgccaacattgaacgcttcaacgcccggcgctatgaccgggcccacagcaaccctgacttcctgccagtggacaactgcctgcagagtgtcctgggccaacgggtggacctccctgaggactttcagatgaactatgacctctggttagaaagggaggtcttctccaagcccatttcctgggaagagctgctgcagtgaggctgttggttaggggactgaaatggagagaaaagatgatctgaaggtacctgtgggactgtcctagttcattgctgcagtgctcccatcccccaccaggtggcagcacagccccactgtgtcttccgcagtctgtcctgggcttgggtgagcccagcttgacctccccttggttcccagggtcctgctccgaagcagtcatctctgcctgagatccattcttcctttamttcccccamcctcctctcttggatatggttggttttggctcatttcacaatcagcccaaggytgggaaagctggaatgggatgggaacccctccgccgtgcatctraatttcaggggtcatgctgatgcctctcgagacatacaaatccttgcctttgtcagcttgcaaaggaggagagtttaggattagggccagggccagaaagtcggtatcttggttgtgctctggggtgggggtggggtgtttctgatgttattccagcctcctgctacattatatccagaagtaattgcggaggctccttcagctgcctcagcactttgattttggacagggacaaggtaggaagagaagcttcccttaaccagaggggccatttttccttttggctttcgagggcctgtaaatatctatatataattctgtgtgtattctgtgtcatgttggggtttttaatgtgattgtgtattctgtttacattaaaaagaagcaaaaataataaaaaaaaaaaaaaaaaact

SEQ ID NO: 2828 - DNA, 1572 bp, Homo sapiens
  misc_feature (334)..(334): n equals a,t,g, or c
  misc_feature (475)..(475): n equals a,t,g, or c
  misc_feature (1146)..(1146): n equals a,t,g, or c
gaattcggcacgagttcccctggcctcaaaagaggaattaacacttttggaggaagggtaagtagaggggtagaatttaaagatactaagtaaaattggagtggaataaggtataaatgmgtaatgccttataraagagattccaagcttttcaagactttggtgraagactgggttgggggaatatgaaatggtgccactttctcttgattgtgttcctatctccattcattttctgtctttttcagggttgcttcttttttcccatctctaaatgagagttcttcccgtctctaaatgagaattctkcccaagctctggtcagttccttttnctctctcctctcttttgctacaatgggtaaataagtttagcaagacttagcacacgttgtcaatatacaaaaaaatcagcaagaattctatattctaataatgaaaaattggatacgaaaagtaaaaatagagcagtttanaatatcaccaaggagaaggaaatactgaaatataaatctaataaaatttatgcaagatctctatgctgaaaagtacgaaagactcataaaagttatcagtgaaggcacaaataagtggaaagatatattgtgttcatggactggaagatgcaatatatttaagatgtyagttmaaaaagatctacggatkcaatgcaatctcaattaaaattccataagaattttttatagatatccatargctartctcaaattttacatgaaaagggcaagagcccagtatagccaaaataactttgaaataagaataaagttagaggacttacattgcctaattttaatacatactatgaatcttaactataatataacctaactataacaatcaaggcagggtaggactggagaaaagatgcatagatagataaatgagacagagcagaaagttcagaaataggcgtgcagaaatatgsccaattgatttttgacaatagtgtgaaggaaattcagtggaggaagaacaaatttttataataaattgtggtggaaaaatttaacgtttgcatatatatgtatggaacttcaatctatattctttatgtgaaaaattcaaaatgaattataagtctaattttaaaatatgaaactataaagattttaaataaaacatnagagaaaaaatattttatgcccttaggttaggcaaagagatcttagataagaacaacacaccaaaactatgatctataraaaagraaactgggccaggcacagtggctcatgcctatcataccccgtacgttgggatgccgaggtgggcggattgcctgagktcaggagtttgagatcacccggccaacatggcgaaaccccgtctctatgaaaaatgcaaaaattwgccaggcgtggtggtgggctcctgtaatcccagctactcgagaggccgaggaaggacaatcgcttgaatccaggaggcagaggttgcagtgagcagagatcgtgccattgcactccagcctgggcaacagagccagactccatctcaaaaaaaaaaaaaaaaaaaaaactcgagggggggcccggtacccaattcgccg

SEQ ID NO: 2829 - DNA, 1201 bp, Homo sapiens
ggacatttgtaaccctataaacactagtaaattaaaaacagaaggacctttatgtcctaacatatctgtgttgtgaaaggctgccctgtgaaatacgggatttcttaaacatattttaaaaatcataggtgtcaatattttttagaaatccatttaaattttctcttgttattttacaatgcctatttatttatatagtggctctgctgattttgatgtatatcctaaagtttatattttctttaaaggatgttttatacaactttatgtaaaatgtttcagtatcttcacattctctccctgtccttttgttttgctcttatatggtggtctgagtcttttctctggctttcaaacctagtaagactaagacactaaagtaactttgcccgaggtttgggtaatgcctkcyaaakcacatcctaagctctcgtgcatacaggggcctcctttgagctctgtgcttttgagatcccatacacctaaattccagtactccaaatcagtactgctcagttttagtgactaagtttaaaaatgtattttaatarcaagttagtttagtgccctcttgcttctttctcgactgcttgtatacatgtatattcctttaaatgaatcttggaatttatttagaaatattaaattatactaatgaaactgtatattgttgkgaattcataagtgaatttggaaagaatttgtctttatgaaactaaatcctttttattcaagaatcatatgtgtctttatatttattccagtctacatttatatcactgagtaaatatatagaaatgtggatacatacagctgtagttacagatacaaatatagatataacctgttaaatctatatctatcccatataacatatatacatgtaatatgtgtgtgtttatatatatatgtttatgtcattaaagagctcccttaatatttttcttttatttcccttataatttgaggttgagcttgaattttccttgtataaacaagcaaatatttatactagttttaatactgatgtttagacattgtatcttattttagcgctgaatattttcacaattattataaatattatctaatactaataatgtacctgttaaaaatatttaaaattttacctttgaattattttattgttgaattaaaattcctttaatatgataaaaaaaaaaaaaaaaaaaaactcgta

SEQ ID NO: 2830 - DNA, 1049 bp, Homo sapiens
ggcacaggaaaaagccatctaaggtgctaagttaaaagaaaaaaaaaaggccttataaggtactcaggatctacacgaggttgttaattcatgttttgctttaattggttactctgtttcctatttcctcggtttccaatacttgtttgtagaaaacatcagttttgtgtgtatttgctcttggtcctaaagttaaggacactatacgcagagttaattgaccttcatttgtgtgccagcattctggggtgacataatgcctgcaagtgtcatattcttaatatgtgagggggttctatatggagtacagggttagttgctaaataacctctgtacccctttttctctgtctcgatgtatgcatctcatctcctgtagattgcctatttgtatgtattcctagaaaaggccttcgataggacgtctgtagggktattcccttctaaagggaatggttataccctctgacctatcaattccatttctataaatttatcccatagatatactcacaaatgtgtaaaatgaagtatatttgaagtaaattattaaagcmttaagagcaagctaaatgttcatcagcaggaaatggagtcaatatatcttcgtctgtctgtataatggaacaatatgtattattatgaacagtttttgagcaaataaaaataagctgaagtttaaaaagttgagttaaaaaagcaaggtgtaaaacagtatgcgtagtatctgtgtacgtttgtagatactgtacacacatgttagagggcaatttggataaagtattctgtgctcaattaacatattttccctttgtcttcctggctctactggcttattaccagtagcagttactcgggagttacccagctactcaggaggctgaggcaggagaatcgcttgaacccaggaggtggaggttgcagtgagctgagatcgcgcctgggtgacagaacaagactccgtctcaagaaaaaaaaatgcttatgttctgtataaaatcttcaawaaaatgacgataccagtaaaaaaaaaaaaaaaaaacctccgta

SEQ ID NO: 2831 - DNA, 1489 bp, Homo sapiens
gaattcggcacgagtgcccagctcctgctgtaattagctccacgtgtacccccttcattccctccctcccaccgagccatccctgacccaggaactttccgcagactcgccgccatctgggagtgaagcaacatggatgcagtcagccaagtccccatggaagtcgtgcttcccaagcacatcctggatatctgggttattgtcctcatcatcctggccaccattgtcatcatgacctcgttgttgctgtgcccagccactgcagtaatcatctatcgcatgcggactcatccgatccttagtggggctgtttgagagcctcccaagagggccgggtgagggatgaggacaggcatcctatccccagcctcttcctgtcttcagaaaagcagcaggagggactttggggcatggacctgagttctggttttgattctgccacgagccagctgtgtgaatttggtcaagggacctaactctctgagttccaggttccttatctttcaaatggggatggtgatccctgccctttctacctcatagggatgtgagaaccacctgacttagtggatgtgaaagctgtttgtgatcagtaaagctaccacagatataagggtgttatgctgaatcctgagaagctttcaagaaccagagaacctgattgctgatgatggccttaaaggtggtgagggagatactgggggcagagcagactttgccagtgcccctcaggtcaaaccaagccaagagcaccctgtccccattccaaggggccagcagcactttggcccaaagtattttctttaaggtgccattccttcatgttttctcagtttggagggtgatgggtagagctttccagaaccttctccattccagaatctctgcccctgtgtaatctgaaggaaggctgtgccatctttgggcactgccaagggagttggggtgatgggcttctttctgcactggagtctcacatctgttagctttgacactcaagcaatgttggaaaatgcagggtgactgagttccctgcccagctttcgggatctctggcccccatccccttgtgtgtgtccctctgcccagctcctgctgtaattagctccacgtgtacccccttcactccctcccaccagctctgcagccagcctatggcaattatattttaagaggtgttcccaggacttttgggacctactaaaacaatgatggttattttagatgtgatgatttatatttatgtagagatatttctggaccactcaagctcttcgataccaaaatcaggagcatcttgggatttattaaattatgtaagaagatagcacagatatcgggatattattgtgtgaaaatgctgcttttactttgatgtgatctcattgatgtacacaaccaagttccaataaagtgctagaatgtgaaaaaaaaaaaaaaaaaactgcgagggggggacccgtaaccctaatcgaccttaatgagtgta

SEQ ID NO: 2832 - DNA, 1126 bp, Homo sapiens
  misc_feature (21)..(21): n equals a,t,g, or c
  misc_feature (35)..(35): n equals a,t,g, or c
  misc_feature (49)..(49): n equals a,t,g, or c
  misc_feature (99)..(99): n equals a,t,g, or c
  misc_feature (1012)..(1012): n equals a,t,g, or c
tccggcttcgtaatgtggtgngaaattgtaacggnataacaatttcacncaggaaccagctatgcccatgattacgccaagttcgaaattaaccctcantaaaggaccaaaagtgaagttccaccgcggtgccggcccgctctagaaactagtggatcccccgggctgcaggaattcggcacgagccggcccgtaccgccaggcgatcgcgctgatggcggcgctggcagcagcggccaagaaggtgtggagcgcgcggcggctgctggtgctgctgttcacgccgctcgcgctgctgccggtggtcttcgccctcccgcccaaggaaggccgctgcttgtttgtcatcctgctcatggcggtgtactggtgcacggaggccctgccgctctcagtgacggcgctgctgcccatcgtcctgttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacaggaatagaacccaatactttcctctctgaggaaaggctgaaacttcaagctccccttgtgataagacttggtcagataactgagtctggtcaatggaatatgagtggaaatgatgtgtgcaacttccgggttctgtccttcctgccgggtggaatgtgaatatgatggcacctgggacccaaagacaggagccacatcttgagagatagatggcagatctgcccctgtggctttggatcatttacctcagtgaacacnacaagcattatccatgaaaccataggttttgtgtgctagttctagtttttaaaatatgaattaaattaaatacgtatctgttaaaacttaaaaaaaaaaaaaaaaaaactcgag

SEQ ID NO: 2833 - DNA, 1047 bp, Homo sapiens
  misc_feature (301)..(301): n equals a,t,g, or c
ggcacaggggactacaggcacccacgaccatacccagctaatttttgtatttttttgtagagatggggtttcacgatgtcgcccaggctggtcttgaactcctgggcttgagcgatcttcccatctttccatcttggcctcctaaagtgctgggactgcaggcatgagccaccatgcccagccaagattcttattgattaccatgttgcttcaagaagccaagccagtttccaatattccccatttgctggagtcttggtactttgggtagaagcaactggtaaattgttaattggaacanttggtggtgtagataaccacgtatggccaaacctagagcatctaggctcacaattactatcctgacttgataacaagtgttctgatattaacctgaaaatgggaataatgccaaatctgtgtaacttaacatctatatacacagtggggagaactgaagttattaaacctggaatctctgtgatcaaggctaacagtagttatctaagaagcaaaggacctacaattcttagacttggagtcatattctttaaggacgtgttctgaaactatatcaagcatctggtttccacgtatttctccctcagaaattatgaagtacaagtaaaaatgaaggtacagggtaagacacatgctgctttcttgctcttgagtggagacagttttccagccatcttaaccccttwacacaaaacaatttgtgttttatagcaaataagtgactcaacataatttcaatatgatgtttatccaccagtactttcctttcagcttctagtcccataartggtttgtgaagtcatcggttacattagccaagataggcctagacttgaagtctagaatgtttttcccactatatgccaaagtagaatgtgggtatctcagggtcatttttgttgttcaatttcccacctgtacagttgttatgattcactttccttatgtgtctaataaatcttgttccatgaaatgatcaaaaaaaaaaaaaaaaaaactcgagggggggcccggtacccaaatcgc

SEQ ID NO: 2834 - DNA, 1660 bp, Homo sapiens
  misc_feature (1)..(1): n equals a,t,g, or c
ncttctcatgggaaagaaacacatcctgcctttgaggatcctacagcctgtgacaaaaacagtcataaaaatggacaattgccttattacacaaggagctcttaagtggcaatacaagcaatggaagtggctgtccagaggagggaacttctagtcctaggtctttaaggatgaataggagtttgccagagtgagaaagggaattgaactttcctgggagtggccttttaaaaagcaatgagatatggccaggcctggcttgtttggggaagagtcaaaatctagggtggcaagagtatgggaagcacactgaggagcagagagaaatggggtaggtaggaaggtagggttttgaccacaaagagctgtgcatgctaaactgggccacaggtgccagcagggttgtttgaggaagggaagagcaagacaagctttggtttaggaagagagctgtggcagcataaaggcctgaaagaggagacagagctgtcacccaaaatggacttgagagctccctgtggtttactctgtggctagaaaacgctgccggccagatggatcacaaatgtctatggtagcttagaagctctgctcttgaagaggatcctgggatctgcccaacacccttcccaacctccatttccccatccccacctccattgccccatcccccctctccccctaggcaggtggatctgagccttatcccaccaccaatgcccctgctagcctctccccacccagcccagagcctactcagcctgccatctcaagagccccaccgagggtcactggcttcctgggaggagtcaccaggctgccagctttccctctgcctccccaaggaacctgagacctccctctgctcatcaccctgggcccaatcctgaatccagcccccatcaaccaagacagcaaaagggccaggtctgtcccttataattttgagccttctccctcaagtttggaagccctgactttaagaaatgccaaatgcaaggaccattaagaaaattctccccgaaatgaggctcctctaacaaatgatgattaaaacgctctctccttgagcagtcacattctagaaacaggacattccatgaggcaggaagagttcagttaatttgctcctgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagagggaaaaaaaaggtgggggaaaagagccccagggtgaccttcaggaaaggccaggaccaggatgatctaacctttcccttcaccagaaacaaagctattgcccagactgaaccctaaagtcaagcagtcacccactgcctttgctgggagcagaagcccatagcaacaa

SEQ ID NO: 2835 - DNA, 1332 bp, Homo sapiens
aattcggcacgaggcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaataattactgcttaataggcttcaagtaagaagacagatgttttctaattaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctcatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaaaaaaaaaaaaaaaaaaaaaaaaaaaaaaaaaaaaaaaaaaaaaaaaaaa

SEQ ID NO: 2836 - DNA, 1191 bp, Homo sapiens
gaattcggcacgagcggaggccgaagagttgagtccgttgctaagcaacgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcattttyctttatgatgttctttgctcttgtggtaataattaaaaaatggtccatcccttgtcctctgacattaaattatgtagagaaaggcttccagatttcaaaygttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgggtctcattctgtcgcacaggttggcgtgcagtggtgtgatctcagctcattgcaacctctgcctcccggactcaagcaatcctcccacctcagcctccagagtagctgagactacagaaaaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatcaaaaaaaaaaaaatcaagggggccg

SEQ ID NO: 2837 - DNA, 1648 bp, Homo sapiens
  misc_feature (1)..(1): n equals a,t,g, or c
ngatacgccagctcgaaattaaccctcactaaagggaacaaaagctggagctccaccgcggtggcggccgctctagaactagtggatcccccgggctgcaggaattcggcacgagtgaagagccagagtcctccaaggtgaagctggactgaatatttctgtccataagactattagaatcccccaaagtgggataccagtgaggacctcaccagcagctgctgtctctccaatgcagctccacagggcctgtgagcagggctggctatgagatcctgccctgaagagcagtactgggctgctctgctaggcacctgcatgttctgcaaagccatctgcaaccatcagagccagcgcacctgtgcagcctcctgcggtgagttctgggacctgagcccaggggacagtgtgatcacccccaacgcctgtccccagagcaccctctggccccacagtcaggtggctgaggagaggatggcaggaggagatgtacagtgtggcacctcttatccctccaccttcctgctctggccacactgcctcctttcagtgtcgaacatgccatgktcttccctgcctcgggttctttgcacatgttgttcccgctgcctggaatgcatgctctctatcatcttcctcagctycctyctacccaactttcaggtctcggcccaaacatcgggggtctcctctgaccacacagtagtactgggccctyctttgkactgctagtgttactttcttttgaaacttttaattacagaacttaccacacatatacatagagaggactgcacaatgatgccctcctcatccattaccagcttcacaaatcatttaaattctgccttgtactttcccaaccagttgttttggcttgtgtattttaaagcaaagccaagacctcatatcattttacctgcarrwtactgggccataaagatctgtaaaacataccccaaatatcctatcactgccagcaataatttattaacatcatctaatattcaggccatatccaattttccctgattgtcttgaaaactatccattgcttgctgttctttttcataatctgtctttttccttgatagaacttaccacaatttgctgttttgttcttttgtgtgtatgtgtttcacatctactcagccactggactgggwgctccctgaggggaggaaccatgtctgacttgaacctagcacagtgcctgacacatagtaagtccttcatgaatacttgctgaggggaactcagagaggctgagtgacttacccaagatcacacagcttaaaagtgaagatgtcagggtttraacccrggactctgactcctaaatcataccctgaaccgttacccattaatgaattagaacattcattgattcatcccacaaacatagatggagtgctccagccccatggaaataggaatctggtgtggcccttcaaggacagtatcatctaatgggagaaatgattgtgtgtcaaggtagaaagccatagttggggccgggcgtggtggctcatgcctgtaatcccagcacttcaggaggccaaggcgggcggatcacctgaggtcgaaagttcgagaccatcctgaccaacaaggagaaaccctgtctctactaaaaaaaaaaaaaaaa

SEQ ID NO: 2838 - DNA, 919 bp, Homo sapiens
  misc_feature (380)..(380): n equals a,t,g, or c
  misc_feature (432)..(432): n equals a,t,g, or c
gatcgtttttgccattgcagtgaccaacaggactgtggacctcagtaaaggctttccctacatcagcatctgcrgatccttcccccctcaragctgcatcttcagccaggtgctcaatatgggagctgctctggccgcgtggatctgcattgtccgttaccaccagctccgggactggggcgtcagaaggtggcctaaccagctgatcctatggacgggtcttctgtgtgccctgggcacytccgtggtaggcaatttaccaggtgagacccagtcggcgcccagggtctgtwmccggccggcstytggaaytacaactcccagcatgccccgtggccataggcttwawgtctcgggggctggttcccgcccgcccttcntgggacttgtatttttctctggccattggcctggaccggctggatcctttgntctctgagtggggcattacgagcgaggctgtttgtatgtaggattcgttgattccaggacgttgggataattttctgccagcccctctccccagcttatttaatgatgaaattactggtccaggcgcagtggctcatgcctgtaattccagcactttgggaggcggaggcaggcggatcgcctgaggtgaggagtttgagaccagcctggccaaccaacatggtgaaaccccgtctctcctaaaatatgcaaaaattagccgggcatggtggcaggcgacttaatcccagctacgtgggaggcagaggcgggagaatcatttgaacctgggaggtggaggttgcagtgagccgagatcgagccattgcactcaaacctgggggataagagtgagacttctctcaaaaaaaaaaaaaaaaaaaaaaaaaaaaaaaaaaaactcgtagggggggkyccggtacccaacgcgccctatagtggatgcgtg

SEQ ID NO: 2839 - DNA, 540 bp, Homo sapiens
cctaagcgctaggattacaagcatgagccacggcagccagcccttcttactactgctgtcacttcatattctgatcttagctgggtctttcctgctgttcagcccttacactgccaagccatccttttcttcatctttcattgttttccccagagcagaaatgtaactcatatgtacttctttcaagatcctatcacgcctcttctgcccttcatcactgtgatcgagctcatctcaaggtgcctgtatctcaaaactcttatcagttcttacgtacgctcacctctactttgccttagagaaggaagtacttaccttcctttccagagcaattgtctcctcctctacactcttaacccacggtgttgctcattctctcacgttatttcattctttttctaaattcacactaccttttttctcagtttctacaaacctatgaatgtagaaacctacctaacctaaaaaaaaaaaaaaaaaaaaaaaaaaaaaaaaaaaaaaaaaaaaaaaaaaaaaaaaaaaaaaaaaaaaaaaaaaaaa

SEQ ID NO: 2840 - DNA, 1128 bp, Homo sapiens
gagaaactggctctctggacttcagaacattttgtacatcatgtcttataaggaagccattaaggtcactccactgccatgtatgcaactgctgtgtggctcgatatgatcaacactgcctgtggactggacggtgcataggttttggcaaccatcactattacatattcttcttgtttttcctttccatggtatgtggctggattatatatggatctttcatctatttgtccagtcattgtgccacaacattcaaagaagatggattatggacttacctcaatcagattgtggcctgttccccttgggttttatatatcttgatgctagcaactttccatttctcatggtcaacatttttattattaaatcaactctttcagattgcctttctgggcctgacctcccatgagagaatcagcctgcagaagcagagcaagcatatgaaacagacgttgtccctcaggaagacaccatacaatcttggattcatgcagaacctggcagatttctttcagtgtggctgctttggcttggtgaagccctgtgtggtagattggacatcacagtacaccatggtctttcacccagccagggagaaggttcttcgctcagtatgaagaaaagcaacccaaaactctcaatctgatttgtttttgtttatgtcgatgccctgtagtttgaaagtgaagtaaagatttagaattcacctaagtccaaaggaaaacacgtggtttttaaagccattaggtaaaaaaagttctcaataaaggcattacaattttttaggtttagaaagatggacttttctgataaatcttggcagacatctaaaaaaaaaaccatatttttcacaagaaaatgcaagttactttttttggaaataatactcactgattatggataaaatggaatattttcagatactatattggctgtttcaaaatagtactattctttaaacttgtaatttttgctaagttatttgtctttgttgtatctataaatatgtaaaaaatatttaaatagatgtacctgttttgctttcacacttaataaaaaatttttttttgtagttgaaaaaaaaaaaaaaaaaaaaaaaaaaaaaaaaaaaaaaaaaaaactcga

SEQ ID NO: 2841 - DNA, 1959 bp, Homo sapiens
ggcacgaggtttcactctctaaatgaacaaagtgggagatcactgtcatggccaaagttacatggccaagacaaactatggcctgggagtcccaggttctcctgtgtgggcactttcctggcatatgctaaatgatgggaaagtctgggtctcatgtttctgtgtggtcctcacctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtacgactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttggtgctaataaacctaatctacagaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2842 - DNA, 814 bp, Homo sapiens
  misc_feature (285)..(285): n equals a,t,g, or c
  misc_feature (554)..(554): n equals a,t,g, or c
gaattcggcacgagcaaaggatggctccgtctccattttgggttctrataatgccactacttgtmacattggggtcctgttgcacacaggttatggggccacctgcttgacacattgtratggaaccgacaccaaagctggggtccccttgatcatgaactccataaagtctttttccgactgcgctcaatgtggaagcctggaagtatacctcgtgggaggcttcagtgatgtgggaggcagttgtcacaaaaactcactcattaacttcttagtgaatttgancaggcaagaaggwtgacattcacttagtgatactatgattatgtgtgacagaattaaatgaccaggaagaaaacgaataacactttctaawaatatatggcatgctgtcaacttaagactgcaaagatttacagagcctcctttcttttttttgtttgagacagagtctcctctgtkgcccaggctggggtkgcagtgagccgagatggtgccattgsamtccagcccaagcaacaagrgcaaaactcctatctcaaaaaaaaaaaagnaaaaaaaaagaatgtaaactacaagatggttcaaaagaaattacacggaattcagcatgggagaaacaaaaaacaagagtgggaaaagacatcaaacatgtttttactaatcgaagttctaaaaggagagacgagaatacagcacagataatatatgaagagaatggctggaaatctttcagaactgttgaaggatatctatccacagattcaaaaacccaataaaatctcaagcagtattaaaaaaaaaaaaaaaactc

SEQ ID NO: 2843 - DNA, 1282 bp, Homo sapiens
  misc_feature (153)..(153): n equals a,t,g, or c
  misc_feature (1220)..(1220): n equals a,t,g, or c
  misc_feature (1222)..(1222): n equals a,t,g, or c
  misc_feature (1232)..(1232): n equals a,t,g, or c
  misc_feature (1246)..(1246): n equals a,t,g, or c
  misc_feature (1282)..(1282): n equals a,t,g, or c
actcgtgccgaattcggcacgagccattctgagtttggtcccttcccaaaagtaggggttttgtgtggaaaatctgagcaaacctctgttgactgttctggggtggagtgaagggagaargggctcagctaaagaacatggggagattagggnaacaatgccttttatttcttgcttttaaagcaatttcaggagttttcttcctcttttggcgtcctgctgactccacagagcggaacacccaaagctgggactttccacctctctaatgctcagtgaagagcgggccaggggggtgtggaaaagaaagggtcctggaggagcccaaattacgaatggctagagactggcattggcaagcgaggaggcttcgtcacagtgtagtcttccggttgtccgagggtactgtcccaggggctggggggtrttccgtcttctgcagatcaactcccgcaggctaaatgtggacatcgcggtatcatgcttgataaacggaccaataatcaagtggagattcattagaaccacataacccatactaggttgatttctcaagtataagscctggtctgttgcccagsctggagtgcactgacaccatcatggttcactgcagcctcaaactcctgagcccaagtgatycctcccactcagcctcacaagtagctaagactagaggtgtgcaccatcamacccagctaatttttaaagttttttttgtararatggggtcccactctacaaaatatwtaagtataaggcckggtctgttgcccargctgggsaacccttggactaaggcaatcctccagcctcagcctcctaaagtgctgggattacaggcgtgagccaccgcacccacctctaggatctctactattgaggaaaaattggaggcatcaaactccaagggcaaaacatgaagactcgctggcccaccatggatggaggttttctctcttaaaattcccacagcaccgcatggaactgcctctcctgggacctcagcgtttccttctttgctctaagcaatagcctctgccactggagattctgagatggccgatttccttttggatatttaagttttgaaatcatgctcatttggcataggaatgtttcacttcagtctcctttaaacaaaaggacacacaaccacgattgcccctccctcccgaagggtcactggacttcatgcatcagtaatgtttccaaaaatntnttaagtaccnacatgcagtggccngcttttcatttttccaagtgaagccatcagaaaaan

SEQ ID NO: 2844 - DNA, 1081 bp, Homo sapiens
  misc_feature (4)..(4): n equals a,t,g, or c
  misc_feature (7)..(7): n equals a,t,g, or c
  misc_feature (1033)..(1033): n equals a,t,g, or c
  misc_feature (1080)..(1080): n equals a,t,g, or c
acanatnttttacttaaattttattttatcttatttttaggtgcttttaatctcaaaattctgaaaagcgaatagcacgtgttttcagaaacaaatgtgaaagcagtcaaattaagtagatactatttagaaatgtaaaatactctccagatctaccattaatagaaaataaactaaaccttatattttatttttgccaaaatattttattataaaatatgaccaaaatatttaaaatgcacaatgcttttaacttaaatgtgctaaccctgtttctgtctgttttgtgctgtaccttttctgattcmgaattatagaaaacttgataaatacttgattttaaccaatgagactacaggcagatgggactaagtgtttatgggacaattatgtactatttaacttaaatatattttgtttaataggaaatatataataatagcattttatgtaataaaatatgggcaacgattatcttggaaattaaagagtcaaagcaaagaaatgaagggctggtaaaatgaattttgtaatatcctcaggatacttttatcttaaaagtatgttgttaaagattttgtaaattgtatttcaacaattttaaatgtgttgagcaagttgcagtgcaaacactgtcattatgtagagagtttatatgcacataataacctgtacctataaatcgtgcaataaccatatgcgactattttgccatggagaaatctgacagcattgcaaacaatagtattgtttgatgtagttaaccttaagttatttttcagtaatttcttcacaaatcaagattcaaacagctttaaacacttccaatgagataaaatatttactattatgcttattagaacaaaaggtgtttaaggatgaactaaatattttaattgagcatttatatggataatcatacattatgtaagcccatatgtatttacatccagagtcataatattttaaataaacaatcatgcagaaacttttttagggggtatactattgttttaatatcgttgccaatttngctgacttaaaatatgtgacattttaaaatcaggattttccatattng

SEQ ID NO: 2845 - DNA, 1208 bp, Homo sapiens
taatcgctactatagggaaagctggtcgctgcaggtaccggtccggaattccgggtcgacccacgcgtccgagcgaaatggcgcctccggcccccggcccggcctccggcggctccggggaggtagacgagctgttcgacgtaaagaacgccttctacatcggcagctaccagcagtgcataaacgaggcgcasgggtgaagctrtcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcktggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccrgagacgctggtcaacctcatcgtcctgtcccagcacctkggcaagccccctgaggtgacaaaccgatacctgtcccagctgaaggatgcccacaggtcccatcccttcatcaaggagtaccaggccaaggagaacgactttgacaggctggtgctacagtacgctcccagcgctgaggctggcccagagctgtcaggaccatgaagccaggacagaggccaggagccagccctgcagccctccccacccggcatccacctgcatccctctggggcaggagcccacccccagcacccccatctgttaataaatatctcaactccarggtgttccacctgaaaaaaaaaaaaaaaaaaaaaaaaaaaaaaaaaaaaaaaaaaaa

SEQ ID NO: 2846 - DNA, 2153 bp, Homo sapiens
  misc_feature (101)..(101): n equals a,t,g, or c
  misc_feature (1670)..(1670): n equals a,t,g, or c
  misc_feature (2134)..(2135): n equals a,t,g, or c
caggcctcagggcctctggtggctctggcccagacagtatttgcagttcttgtgctatgggtgggagtcttcttcctcaagtttcggcagctgtgctgtgnctggatgggctgctcctcccagggctcaagggctgtggtccgctcagggtctcatttccccaggccaagttcaaggcagcagccctttgtgaggcgctcttggccctgggctggagggagaactttaagcttttttgctcacagggacgtggtatgggccctgggtgcaggtgcccacattctgctaatgagagctttgtctgatcagtcctgggtccatcagtttgtccatgtgtccggctgccagcccgtcccttgggatccttcccctggggtgtagccttgttcattagtatatactcattccttcatgctttcctcagcagaacacttccacttctgaggtgagcttttgccccrtgcccttcctccacaggtgttgcctttttataaagacctgatagcagaataaattggtgtttccctgttgacccagcaccatttctgtgggcctagaatatggccctcaacccttagagtggggcagtgagggcttgaggagtgacccttcctttctcatggttttagtcattttggctgccagcccttaatggcacagatctgctgcttctaacagatggccaggaggtgacaccgatttcagccattgccaaggttagcaccctctcctttgagcctagggccacactgttcattgtcactttaggcaagtgcctgtttggctttaaaggtaagcctgccagctgtgagaagccttggtaactgatggactcatttcctggtccttaaagatgcagcctcttaagggctccttgatggatgccatctctcctagcccccagccctggtgccactggtgggcaggttcccattctttggggctgggagggacagcttgcctgtttctggtcacaaattacagtcttctctcctgtaccattctgtggcttcagcatgggggcagtagcctttcattagtgtagatagtcattccctggtagggtggagggtaagacatagggtctggaactgtttgggaccttttggggatgtcctgtgcctcccagattcctmgattctgggaggagaggctgccgcattctgctgctcctcacagcgagcaaagctgcacccacttacattcagtattttcctggcactacaaagagtgggaaggcctgggatttgctgctgctcccttagagcagggcccctyttttcagcactttggacacctggagacccagccctgttatttaatggtagtgggcaagtgtgtgtgcatactgtctgccactgctttctccctgccccatgccagagagccctgtccctgccaggcccagccttcttagccccaacttgggaacaaagtgcaacatgggatcatgggttggggtgctcaggtgagccctctctatagtgcttccctgggccaagctgacaccagcccctgagggtggggtgggacgggtggtgcttaaaagaggaaggggaccagtgtagcaacttgccagggaccccacccctccctctctgggcctgtgcagtgagcatggggattcccatcaaggggcctggcacctgtgctagttacgtagccgctgntcacgcgctcactcctgaccacatgcacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgaggcctgcgccggtgctcccgccgcagttgcgtttgctttggaccttgcgtgcgggggagggggtgctcggtccgagcccgctcctttctgtacacctagcgctgcccgccccgcttgtgtctgaggtcgtgtatgtcaaaaataaagccgctagaaacggaaaaaaaaaaaaaaaaaaaaaaaaaaaaaaaaaactcgagggggggcccgtacccaattaacccnntatgatctataaagcgtc

SEQ ID NO: 2847 - DNA, 1566 bp, Homo sapiens
  misc_feature (22)..(22): n equals a,t,g, or c
  misc_feature (24)..(24): n equals a,t,g, or c
ctagaagagcaagcccgccagnantgatgaaaactgattttcctggagaccttggcagtcagcgacaagctattccaacaactaagagatcaggactccagtagcagtgagttctgcaccttctggtgacagtgagggtgatgaagaggagacgacacaagatgaagtctcttcccacacatcagaggaagatggaggggtggtcaaagtggagaaagagttagaaaatacagaacagcctgttggtgggaacgaagkgttagagcacgaggtcacagggaatttgaattctgaccccttgcttgaactctgccagtgtcccctctgccagctagactgcgggaccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaamtgctggaagcccagactcccagtgtasgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacarccagcttctgggcaagatggcctttgaagagcagaacagcagytytctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtgggcccctgtgtggcccatgaagttgtgaagtcaaataaattaattttatctttaaaaaaaaaaaaaaaaaayyggggggtttttttggggg

SEQ ID NO: 2848 - DNA, 928 bp, Homo sapiens
  misc_feature (917)..(917): n equals a,t,g, or c
gcagagctggacagcgcctgctgcccgcctcccgatggccctgccccagatgtgtgacgggagccacttggcctccaccctccgctattgcatgacagtcagcggcacagtggttctggtggccgggacgctctgcttcgcttggtggagcgaaggggatgcaaccgcccagcctggccagctggccccamccacggagtatccggtgcctgagggccccagccccctgctcargtccgtcagcttcgtctgctgcggtgcaggtggcctgctgctgctcattggcctgctgtggtccgtcaaggccagcatcccagggccacctcgatgggacccytatcacctctccagagacctgtactacctcactgtggagtcctcagagaaggagagctgcaggacccccaaagtggttgacatccccacttacgaggaagccgtgagcttcccagtggccgaggggcccccaacaccacctgcataccctacggaggaagccctggagccaagtggatcgagggatgccctgctcagcacccagcccgcctggcctccacccagctatgagagcatcagccttgctcttgatgccgtttctgcrgagacgacaccgagtgccacacgctcctgctcaggcctggttcagactgcacggggaggaagttaaaggctcctagcaggtcctgaatccagagacaaaaatgcygtgccttctccagagtcttatgcagtgcctgggacacagtaggcactcagcaaacgttcgttgttgaaggctgttctatttatctattgctgtataacaaaccaccccagaatttagtggcttaaaataaatcccattttattatgtcaaaaaaaaaaaaaaaaaactcgtagggggggckccggtacccaatcgccctgatgagtgagtngtattgttccg

SEQ ID NO: 2849 - DNA, 1477 bp, Homo sapiens
  misc_feature (37)..(37): n equals a,t,g, or c
  misc_feature (53)..(53): n equals a,t,g, or c
  misc_feature (556)..(556): n equals a,t,g, or c
  misc_feature (1460)..(1460): n equals a,t,g, or c
aattcggtcagtagccgccctcctaggcgtctggagnaaactaggcaattttnccgggtagagtggaggaacctgtagttttcctctccccgggccagaaagtagccaaaacgaaagagcgccmgcscaggcaatactagcccctctggagcacggagctccttccccaaagacatgaagctattggagaactcgagctttgaagccatcaactcacagctgactgtggagaccggagatgcccacatcattggcaggattgagagctactcatgtaagatggcaggagacgacaaacacatgttcaagcagttctgccaggagggccagccccacgtgctggaggcaytttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctggtggntgaatgcagtcaactgcagtctgttctcagctgtgcgggaggacttcaaggatctgaaaccacagctgtggaacgcggtggacgaggagatctgcctggctgaatgtgacatctacagctataacccagacttggactcagatcccttcggggaggatggtagcctctggtccttcaactacttcttctacaacaagcggctcaagcgaatcgtcttctttagctgccgttccatcagtggctccacctacacaccctcagaggcaggcaacgagctggacatggagctgggggaggaggaggtggaggaagaaagcagaagcaggggcagtggggccgaggagaccagcaccatggaggaggacagggtcccagtgatctgtatttgatgaggaggagccgaggccccagcttcatccagcttcaaccaatgcctggacctgtccacctgagaggcccctggggcctccccagctgctggccagaccctggcgctgccacagtcctggcactgcccaaggccatacctgcctagccctttggctccatcctgtggatgcccactcacccctcagactcctgctgcccatgctgtggccggacttgtcagcagggggcctggtgggaggagcgactgccctgcccaaatgaactgccacagcagggacagctggaccgcagagtttatttttgtatttctactgggcctgcacactccagcccaaagggtctgtgcggaggccccacgagcaggccccagcagtcaccggctctggtcttgggccggccccggtgcccacctgtacccccacctcgcccatttggccgcgtgcactgagtgtcactttgctgcagctcgtttctttccaataaaagtttctgtgacttaaaaaaaaaaaaaaanaaaaaawaaaaaaaaaa

SEQ ID NO: 2850 - DNA, 1203 bp, Homo sapiens
  misc_feature (1165)..(1165): n equals a,t,g, or c
gtggactctggctgtccttgggtggtttccatgagcgtggccaagactgggagcagactcagaaaatctacaattgtcacgtgctgctgaacagaaaggggcagtagtggccacttacaggaagacacatctgtgtgacgtagagattccagggcaggggctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactcagtgcatgtcccagccccattctcccaagcatgggagtgggcgtaggagtggaggagggggaaggaaaaaggaattacttcacttacacctatgatgccctttgcccaagccngaagaaagcaaaggggaaaaggggctgcagggtacatt

SEQ ID NO: 2851 - DNA, 1725 bp, Homo sapiens
agcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcctggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaaaaaaaa

SEQ ID NO: 2852 - DNA, 803 bp, Homo sapiens
ggcagagctaggccaggcagagcctagctcttgccagggcagcaggaagccacacagtgtgttgaagccggagcaggagagggggccctgactcccatgtgtccttgcaggcaggagcagttcgtggacttgtacaaggagtttgagccaagcctggtcaacagcaccgtctacatcatggccatggccatccagatggcacctttcgccatcaattacaaagtaaggcctgggccctgccmaaacattcactgtctgcccacccagccccaccccatgaagccatctgtccctcatccccacagggcccgcccttcatggagagcctgcccgagaacaagcccctggtgtggagtctggcagtttcactcctggccatcattggcctgctcctcggctcctcgcccgacttcaacagccagtttggcctcgtggacatccctgtggagttcaagctggtcattgcccaggtcctgctcctggacttctgcctggcgctcctggccgaccgcgtcctgcagttcttcctggggaccccgaagctgaaagtgccttcctgagatggcagtgctggtacccactgcccaccctggctgccgctgggcgggaaccccaacagggccccgggagggaaccctgcccccaaccccccacagcaaggctgtacagtctcgcccttggaagactgagctgggacccccacagccatccgctggcttggccagcagaaccagccccaagccagcacctttggtaaataaagcagcatctgagattttaaaaaaaaaaaaaaaaaactcgag

SEQ ID NO: 2853 - DNA, 1922 bp, Homo sapiens
  misc_feature (1022)..(1022): n equals a,t,g, or c
gtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccagtcaagggcaagcgtcggggccgagggccnaaaggggacaaggcctctgatccggaagcaggtgtggcccggggcatagacttccaccatgtgtctgctgtgctcaactttgatcttcccccaacccctgaggcctacatccatcgagctggcaggacagcacgcgctaacaacccaggcatagtcttaacctttgtgcttcccacggagcagttccacttaggcaagattgaggagcttctcagtggagagaacaggggccccattctgctcccctaccagttccggatggaggagatcgagggcttccgctatcgctgcagggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtrcgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgccccaaaaaaaaaaaaaaaaaaaaaaactcgagggggggcccgtacccaattcgccctataa

SEQ ID NO: 2854 - DNA, 1951 bp, Homo sapiens
  misc_feature (1892)..(1892): n equals a,t,g, or c
  misc_feature (1930)..(1930): n equals a,t,g, or c
  misc_feature (1934)..(1934): n equals a,t,g, or c
tcgtccccagagcgggctgagccccaggcgsagggtggcgggggagcctgggggagccgccgccacctccacgggcctctctgagctcggacaccagcgccctgtcctatgactctgtcaagtacacgctggtggtagatgagcatgcacagctggagctggtgagcctgcgccgtgcttcggagactacagtgacgagagtgactctgccaccgtctatgacaactgtgcctccgtctcctcgccctatgagtcggccatcggagaggaatatgaggaggccccgcggccccagccccctgcctgcctctccgaggaactccacgcctgatgaacccgacgtccatttctccaagaaattcctgaacgtyttcatgagtggccgctcccgctcctccagtgctgagtccttcgggctgttctcctgcatcatcaacggggaggagcaggagcagacccaccgggccatattcaggtttgtgcctcgacacgaagacgaacttgagctggaagtggatgaccctctgctagtggagctccaggctgaagactactggtacgaggcctacaacatgcgcactggtgcccggggtgtctttcctgcctattacgccatcgaggtcaccaaggagcccgagcacatggcagccctggccaaaaacagtgactgggtggaccagttccgggtgaagttcctgggctcagtccaggttccctatcacaagggcaatgacgtcctctgtgctgctatgcaaaagattgccaccacccgccggctcaccgtgcactttaacccgccctccagctgtgtcctggagatcagcgtgcggggtgtgaagataggcgtcaaggccgatgactcccaggaggccaaggggaataaatgtagccactttttccagttaaaaaacatctctttctgcggatatcatccaaagaacaacaagtactttgggttcatcaccaagcaccccgccgaccaccggtttgcctgccacgtctttgtgtctgaagactccaccaaagccctggcagagtccgtggggagagcattccagcagttctacaagcagtttgtggagtacacctgccccacagaagatatctacctggagtagctgtgcagccccgccctctgcgtcccccagccctcaggccagtgccaggacagctggctgctgacaggatgtggcactgcttgaggaggggcacctgccaccgccagaggacaaggaagtggggcgctggcccagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccttacctcccctgccagggctcgggcgctgtggctcctgccttgatgaagcccgtgtcctgccttgatgaagcctgtgccacctgcaagtgcccgccctgcccctgccccaacccccaccgaagagccctgagctcaggctgagcccagccacctcccaaggactttccagtgaggaaatggcaacacgtggaggtgaagtccctgttctcagctccgtcatctgcggggcttctgggtggctcctgccactgacctcaccggcatgctggcctgtggcaggcctaggacctcaggcggggaggaggagctgccgcaaggccctgtcccagcagaagagggaggcttcctgactgacacaggccagccccatcttggtcctgtcaccctggccccaactattaaagtgccatttcctgtcaaaaaaaaaaaaaaaaaatcggggggggcccggaanccaatttcccccaaaaaggggggttataaaaattcccnggcngtgtttttaaaaattcg

SEQ ID NO: 2855 - DNA, 298 bp, Homo sapiens
ggcacgaggtcacggtcactagctgatccctcaggtctgctgcaaacacagcatggaggacacagatgactctttggtgttggtctttttgtctgcagtgaatgttcaacagtttgcccaggaactgggggatcatatatgtcttagtggacaggggtctgaagtacactggaatttactgagaaacttgtttgtaaaaactatagttaataattattgcattttcttacaaaaatatattttggaaaattgtatactgtcaattaaagtgtttttgtgtaaaaaaaaaaaaaaaaaa

SEQ ID NO: 2856 - DNA, 314 bp, Homo sapiens
atctgcgtcggctgagtcaggtacacttccgccatatggtaagcatcataggtaataatctggttaaggctgcgcaaagtagcgtaacccggtgctgttggatactgcgcgcraggggtgtggtaatactcccaggcctgacgcattcttcgttcggcgcatcggactccttcattggtgccagtggcataaatggcgtattctccgctgctaatatcgctggttctggcgtttraacccgcttcaacgtatggcagggcatcaatagatttcacatgttttcccaaccattacggaatatcgaaccaatattg

SEQ ID NO: 2857 - DNA, 2066 bp, Homo sapiens
ggcacgaggcggcggagggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcatttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacattgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggaatgcaactcccatgtaaatcgagggaagattgtgctttgtttgtttcggaactttatcaagaattgttcagcgcttcgaaatattccttcatcaatgacaacgcagcttctggtatttgagtcaacaaggcaacacatgtttatcagctttgcatttgcagttgtcacagtcacattgattgtacttgtatacgcacacaaatacactcatttagcctttatctcaaaatgttaaatataaggaaaaaagcgtcaacaataaatattcttgagtataaaaaaaaaaaaaaaaaaaaaaaaaaa

SEQ ID NO: 2858 - DNA, 416 bp, Homo sapiens
  misc_feature (395)..(395): n equals a,t,g, or c
gaattcggcacgaggtaataggagccctcgtacctcttgtgttccttacaaacattctcatcagtagctctacgcgttgactgggtggtttgaratggctggtatacacagggctttcttggtgttctgtctctggggcttarctttgtgtgtggttggagggccctggtgagattggaagtaccagagagtgctgtgtcaggggcagaggggcctgtcgctggagctggagggtgcctgcctttgtgtctgactcartctcctgtctgccttgccccctcagggtctcgccagcccagcctctgtgggaatctaaaaggartggatgtggacgtktgaccaagcacatctcagcttttaatacctgggctatttatagacctttggggggaatngcttgtggaacaacaagggtt

SEQ ID NO: 2859 - DNA, 807 bp, Homo sapiens
  misc_feature (803)..(803): n equals a,t,g, or c
tttttttttttgagacggagtctcgctctttcacccaggccagactgaagtggcgcagtctcggatcactgaaaagctcagcctcacgggatcacgaccattctcctgcctcagcctcccgagtggctgggactaaaggcgcccgccaccgacgcccggactaattttttgtatttatagtagagacggggtttcaccgtgttagccaagatggtctcgatctcttgaactcgtgatccgcccgcgtcagcctcccaaagtgctgggattacaggcgtgagccacagcgcccggcctgtaaagatttcttgagcaaatgaatgagtaaatgaaaggagtgctcaaatttcttttattctaaaaaatgttccccttttttagaaaatgctctgtagcttttgtaggtctttcctgcactcaaacatccactccttaccctttccaatctcccttttcttctcaacccatagaatgtacttccatgtctaccattccaccagaactactctaaccaaggctacccaggatatccttatttctttcaacttctttgacatgctcagtcgcatttggcactgttaatgtcttcctcctctttgaaacacctcctttgcatggcactatcctggttttcttccttcatttcaggagaaacttcattctccttactgaattctttcttcctcccctatccatcatctagatgttgttgtttctcagtgcagtgttcaatcctagaccccttttcatgtaactcaatgcgttttccttgggagaattaattcccttccctggtgtcactntgcc

SEQ ID NO: 2860 - DNA, 1617 bp, Homo sapiens
  misc_feature (1578)..(1578): n equals a,t,g, or c
  misc_feature (1586)..(1586): n equals a,t,g, or c
  misc_feature (1605)..(1605): n equals a,t,g, or c
tcgacccacgcgtccgggaaacctgatactgcaacctgcaatgtaggatgtttgtatggcatttaaaggtaatggtgatgtttattattctatactttgcatactgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataaataaatattttgagaaaagtgacctaaaacagctggaaatcttaggtgcatctgtctgcagacctccttaagcaggctgtatcttacaattcccttactgcactgggtaagtgttaacttagtttttgttttgccctttgctttaaatattctccaaattaccatttatgcaacatggttagggttaatactgcatggtattcatttacttgtttcatgaactttccagtactgtacaaggtcaacaaagtaatgcctgtggtatcctcatctctcacttttttactctgtggttttagcacagtaaggtactgcaaagaccttccttccaaatgtctccttgactttattccttgggccaattcagtatcctcaacatcctaagattttgttgttttatcactgacctgtggttggcctgttttattctaatttccagaaaagttcaatcccagtatttgcaatatcaaataactctaaaaccgatgttgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggcttcagcaagtggcctatttttattagggttttgaaaggttgtgtgtgtgtgtgcgtgccgtgtgtgtggttttcttttttaaatggatagtagagtggtggctggataagggtacctgtaatgggggtttggncagcaagnctgaaatttatacttttgnaaataaaactac

SEQ ID NO: 2861 - DNA, 546 bp, Homo sapiens
tcgacscacgcgtccgaaaatactttttaagaaagaaaatgacagaagcaacccaagtgtctactgatggataattaaattatagtatataaatacaatggggccgggtgcagtggctcagccttccaaagtgctgggattacaggcatgagccacaacatccagccccttttctcttttcttacccttctttcctattttcttttccattttctttccctcccttcttctttctttcctaactattaaggagtagattgaattcaaggtctttatgtgtgtcagtttttgttttccaacaaatatttcttaaaaaccaaccattgaaacgtaatggtaaccactggcccctgtctccacctccacacctaagaagccccaaatccagatgtgtccattaaaatcagtccagatcttctttaccaagccactagatgtcatattaatttcacagcagaatagggaagcccatgccggagctgaaaacctgcaacaacaaaaaagcatctaaatactgcaaaaaaaaaaaaaaaaaaaagggcggcc

SEQ ID NO: 2862 - DNA, 1594 bp, Homo sapiens
ggtggattatctataaattttggaataaatgacttttctattttttttcttattttccagaatactttgcattaaaaatttagatcttcttacatggaagaggtcaaatccagttatagcaaaacacctttactgcagaggccatataaccaaaaagtccaaaggcccagcccagtggaccatttacttcagtgatgttcagtacaaaatttcactgccattaaagactttggaaagtcccttttaagttgtaacaggatttgactattagtgtggatttcgataacccttctttagttaatgtaataaatgctctttgaagctggaaatatactggtttcttgcacccttgtagttttctctgggctttatgcaaaagatgtattttctgaatgtcttagtatgttgctgtctttttacctgcctggggttgccttcagatgtgggtgaggacttgtttacaaaaagtcctagaagaccttaagttaaaattagctctccaattttcaagtgttttcttttggcagaataagttttgggtcctatgagaggtaaataggttggktgcctctcttgctatagcccatctagagcagaacaaaaactttgtttttgagggggatggagttactttttaccttgtcccctaattgaatatatttaggacttttggttttagaaatctcagagttctatagttggaatagtgtcacagagatagtgttaggtttcttaggcaacaaaattggagtgttacctattgcccatctgggcatggctttgatgagttctatataaataatgagtgtagcctaattttctgtcatgtgctacctagcatatacatttctgacagtcaggtggattatcttgaaattttagacaaactttctgcctccttggaaagctctacatctccttgtgattggagtgtgggtttcaagattccagaargtgggtgtmttcattttctattttcaatgcactctaaagatgacctgcttacaggttctctgaggcagacctcagttgctcttgtgatatgtaactttgctttgataaggaataaacaattacatatccagataatgatacagaattgtcaaaatgtttaatcattaagccactacaaatagacattttcgtggaataaactgattttgaaatgtctttcaatttatattgaaatatctgaaggcacctctaaaatttgggtgatgacacagaggtatagattataagatttaattatgaatgggtggtatactgtgaagactacggaagtgagcagaaagatatgtttggcttttttggtttttagttagagattttaaaaaggtctgtgaaggtcaagttgatcattggttttgattgcatcccacaggtttctataaactggcttaaaaatggcatactccattttctggtgtattcattgtaactttaggaagtatttgaaatggtcacattaaagtctaggaatgtcaaattgtattttaatgcgttagttctttttctttttctttttttttggagacagcctgggcaacaagagcaaaactctgtctcaaaaaaaaaaaaaaagggcggccgc

SEQ ID NO: 2863 - DNA, 797 bp, Homo sapiens
gggtcgacccacgcgtccgcaggtttgctgtcttaaaggtttctaactgatcttgagattgtcccacctttccatatccctgcaaaagctgagtggtatagtttggctctgtgtccctacccaaatctcatctggaactgtactcccataattctcacgtgttgtgggagggacccagtaggaaataatttgaatcatgggggtggtttcccccataccattgccatggtagtgaataagtctcatgagatctgatgggtttatcaggactttctgctttggcatcttcctcatttttctcttactctcactgtgtaagaagtgtcttttgcctcctgccatgattctgaggcctcccagccatgtggaactgtaagtccaattaaacctctttttttccccagtctcaggtatgtctttatcaggagtgtgaaaatggactaatacaagttttgtcagttttttttttttttttttttttttttgaggcaggagaatcacttgaactcaggaggtggaggttacaatgaaccaagatcatgccactgccccctccagcctgggtgacagagggagactccatctcaaaaaaaaaaataaaaacattaccgggcatggtagcttgcacctgcagtcccagctacttgggagactgaggtgagaggatcacctgagtgtaggaggtgaaagcctcaccgaactatgactgaaccactgcactccagcgtgggcacttggcaccagagcaagattctgtctcaaaaaaaaaaaaaaaaaaaaaaaaagggcggccgctc

SEQ ID NO: 2864 - DNA, 1713 bp, Homo sapiens
gtgatgatcaatgctccaaagaattggattaatatttttacacaatattgttgtagtcagtaactgtttctatttccaggcatttttagatgaattcactaactggtcaagaataaatcccaacaaggccaggattcccatggcaggagatacccaaggtgtggtcgggactgtctctaagccttgtttcacagcatatgaaatgaaaatcggtgcaattacttttcaggttgctactggagatatagccactgaacaggtagatgttattgtaaactcaacwkcaaggacattkaatyggraatcmggtgygtcaagagctattttagaaggtgctggacaagctgtggaaagtgaatgtgctgtactagctgcacagcctcacagagattttataattacaccaggtggatgcttaaagtgcaaaataataattcatgttcctgggggaaaagatgtcaggaaaacggtcaccagtgttctagaagagtgtgaacagaggaagtacacatcggtttcccttccagccattggaacaggaaatgccggaaaaaaccctatcacagttgctgataacataatcgatgctattgtagacttctcatcacaacattccaccccatcattaaaaacagttaaagttgtcatttttcaacctgagctgctaaatatattctacgacagcatgaaaaaaagagacctctctgcatcactgaactttcagtccacattctccatgactacatgtaatcttcctgaacactggactgacatgaatcatcagctgttttgcatggtccagctagagccaggacaatcagaatataataccataaaggacaagttcacccgaacttgttcttcctacgcaatagagaagattgagaggatacagaatgcatttctctggcagagctaccaggtaaagaaaaggcaaatggatatcaagaatgaccataagaataatgagagactcctcttycatgggacagatgcagactcagtgccatatgtcaatcagcacggctttaatagaagttgtgctgggaaaaatgctgtatcctatggaaaaggaacctattttgctgtggatgccagttattctgccaaggacacctactccaagccagacagcaatgggagaaagcacatgtacgttgtgcgagtacttactggagtcttcacaaagggacgtgcaggattagtcacccctccacccaagaatcctcacaatcccacagatctctttgactcagtgacaaacaatacacgatctccaaagctatttgtggtattctttgataatcaggcttacccagaatatctcataactttcacggcttaaaaatatttttatcatcaaagagrtgrtttaagtcatctgtaagaacaacatgcaatctttgtctttgcttctggcctgtgtaagcagatgaaagtttcccttttaggtgccaaaatgctgaaaattacctttttaaagtgctctattgctgcgatttgtagcatacctttttttctcagcaaattgatgggtggaagctgagaaatgtatggtaaakgtcasagagctacaaccattcacagacaccaaatctctaggagaataaaaagcacattattctttttctatcagaaaaaaacmagagcatcaccttaaaacccaagatgacattggtcttcttggaacaatggttaagacatcgaaatggg

SEQ ID NO: 2865 - DNA, 3077 bp, Homo sapiens
ccacgcgtccggggagtgttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagctgcctgcgctcctggttccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcccctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaattaaaaaaaaaaaaaaaaaaaa

SEQ ID NO: 2866 - DNA, 2204 bp, Homo sapiens
ccacgcgtccgctttcccccacattttccaagctctgggcagctggagtaactgtgtgtacagacttttctatgtgcgtgtgtgggtgcatgtatgagtgtgtgtgtgtgtttgtgtgtctgtgtatttataggggaatgagagtgccctgggtgtgcactttagatattcctctgtacatcctgtgtgtgcttacatggacacattctgtgtacttatactgtgtgtatacacatgtgcagcccatatgtccatacataggtgtgtgtgtatactatgtgtgtactttgtccacttatggatgtgtgtgtgtaccattgagtccatatctaggagagagagagaatgtgtgtgtgtgtgtgtccatgtatggatgtgtggatattctatgtctgtatttagagtgcaggtatatggatgttcatgtgctgtgtgtgtgtgtgcgcacacacactctgcctctttgtgtgtgtgcatgtgtataccttgtgtgcccatgtatcgggggtgtgtgtaccctgcttgtctatgtatgggggagcacatgtagcctgtgagtcttattctgctgggcagtgtgtggagtggtggggaggctgagcatgaaaggccacttgtgccagttggaggagggtgggccgctgctgcctgctgcctcaggacttggtgggcctgtgggaggccgggctccacccaccagccttccctgttctcggtccccagtttaagaggcgagttcaggagtccacgcaggtgctacgggagctggagacctccctgaggaccaaccacattgggtgagtgagggctcagatcttcctctctgggcctaggaaggctctgcttccaggcagctcctggagcttccccttcctactccccctgccccctgcacaaggctgtgcttgtggaccacctcctggaggtgtccaggacagcttcccctccccttcctgcccatgctctgactggcaccttgaggcatggctgggctgtgggacccacctgagtctcccagaatcctttggtatcattgggtctttgggggttgaaagggcaccccaggggtccttgctgtccctgttctgtgcccatgtggggcaggacctcctttctggctggagctcagggagccctgtgcccacaggtgggtgcaggagttcctcaatgaagagaaccgtggcctggatgtgctgctcgagtacctggcctttgcccagtgctctgtcacgtaagccccctgctcccagccctcatgccgctcctcagagctttgatccccgtctccctgcatctcacccactcccctggccagtttcaagccaggcagccgagcctaccctggaaccctccacttggccttgagcgatgctccttccagaaggcctgcccccgacagggaggggtggctctcttccaccactatgttcagcacagtgccaagaacacagcctcctcctcctgctccttagtctcacctgcaggtctgtctctccttgcgtttcctctgcccccttttaagtggcccctgcagtgttggcctccagccccattgcatcctgtccccaggtatgacatggagagcacagacaacggggttccaactcagagaaaaacaagcccctggagcagtctgtggaagacctcagcaagggtccaccctcctccgtgcccaaaagccgccacctgaccatcaagtatgtgggccacaaagtggggtggtgggagaacagagaattcagcccccacactgctgcatctagccagcccaccccgggcccttggggttggcgagaggggtagccatgcattaggggtccgagtaagggactcatacagagtttgggacaccagtatgttaagaagccatcaggggtggggctgggtgctgtggctcatgcctgtaatcccagcactttgggagactgaggtgggcagatcatttgaggacatgagtttgagaccagcctggctaacatggtaaaccccatctctactaaatacaaaaatagccgggttggtggtgcacgccttaatcctagctactcaggaagctgaggtgggagaatcgctggagcccaggggatggaggttgcagtgagctgagatcgcaccactgcactgcagcctgggtgacagagtgagacccttctcaaaaaaaaaaaaaaaaaaaaaaaaaaaaaaaaaaaaaaaaaaaaaaaaaa

SEQ ID NO: 2867 - DNA, 2672 bp, Homo sapiens
  misc_feature (16)..(16): n equals a,t,g, or c
  misc_feature (28)..(28): n equals a,t,g, or c
  misc_feature (47)..(47): n equals a,t,g, or c
  misc_feature (52)..(52): n equals a,t,g, or c
  misc_feature (93)..(93): n equals a,t,g, or c
cccaaagttcggaaantaaaccttcaantaaagggaaacaaaaagcnggagnttcccaccgcgggtgggcggcccgttctagaattaagtggnatccccccggggctgccaggaatttccgagccggggccgcgccgccgctgcccgccgccgcgsgcggattytgcttctcagaagatgcactattatagatactctaacgccaaggtcagctgctggtacaagtacctccttttcagctacaacatcatcttctgrttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcggttgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgattttttttttttttttacacaattctctgtagactaggagaagaatgcttgtgtttttcggaagtgtgatgcttctctttgactgccaaactcttttatggaatatatctttatattaaaaaaaaaaaaaaacaaaaaaaaaaaa

SEQ ID NO: 2868 - DNA, 1198 bp, Homo sapiens
ccacgcgtccgcggacgcgtgggttttttttagctcagttaaattcagcatttaatgcaggtgagttcctgggtcgttttccaactagtctggaacagtctggttctgactcaaactggtataaagcattattttaggttttctctttgccagtttttaagcagttataaccatgtaaatcaagatgtgaggacatctatatgaagtatagtaaagaagtggtgtcagcagatcaatatgtgtgtcctgggtgtgctgctctcttaagtgagactttgtgagactatactttaaatgcattattaccattgcttacattttgggggattttcttcctcctcaaaacttccatttctattgtaatattcttaatgacaatctttttttttttttagcagtgtatgtttgaaacagccaaagatggcgatgaaccaagtgtaaattgatctaagcagcccatgcagtttgtgttgaatcaacaaacagtgtattgttgaagtgaaattattttctgaaatgacttgttagaccagttttgaggacatactcaaaagtagagtaataatggctcctgggatggagaaatatgagatgaacctggaacattctattatggtgccacaaaggaaatctaaaaaaaaaaaaaaaaaaaaaagtggttggctaggagcagtggcacacgcctgtgattccagcactttgggaggccgaagtgggcaggagttcaagaccagcctggccaacatagtgaaaccctgtctctactaaaaatacaaaaattagccgggtgtggtggcgggcgcctgtaatcccagcttttcaagaggctgaggcagaagaatcgcttgaacccgggagatggaggttgcagtgagctgagatcgtgccactgcactccagcctgggcgttgcagtgagactccgtctcaacaacaacaaaaaggtggatacatgtcaaaagggcacaggagccacttgaaggattatacttgctaaatctgtgtcaattatcaaaataaactggtagcaacgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2869 - DNA, 1605 bp, Homo sapiens
ccacgcgtccgaatttcttcagtttggctaagggaatttttttaaaactaattcagaacttatgattcctttttcatctcagaagttaaccctatggaaaatgtggcaatgtttctgagatttgcaaaatattgtgatagtatctatgtcttattgctcaagatctaaactcttatgtttgggagtaggggtttgctgtgtatgtgtgtatttttttttaacatcttggcctcacagtgtaaagtgataagctcaggaggaatgttgtgctgcagaacgcctacattactagattacttacggcaacactttctttaatgaggatctctgtgaaaccatctttttttccacttacagtttcaataagaggagatcagtatgaaattaagtaggagagaacaatatgagagagagagagaagagttcagcattcctcttcaagctagctaatatttttaaaatgtcgacactgttccaggaactctgctttttaggcaaagattctgccctggtcttcgtcctctccacacccccagcatctcgtgggctgacacatcaacagggtttgagaaagagacacaaaaggtcagacgcatgacacagcaggaacccaggaggacgtccctgcagcctgctctcttctaatagatctcccccagcccccagttcccagcctctgaccccagtcccacctttataatgtccctttctctctattttctctccggtaccacttttccctccatttagccctcctcctcatcccctcctgttatcacagctgagctctacaactgagctgagcaatatatacaaaactcaagcctggtttaggcaggcctgacccctgggataggtcagggcggtggttccttgggagaattcctgcttgatgagatggaaggtccaagtcaatagcctcatggtccccccaagtctgacagtctgctattctacacacctgtccacaggctgcagacttataaaggtaaatgttcaggtattagaaaatattcaaagaattctcaatgttcaaaattctgaaaagcaaatctatgctgaatgtgtggtggaggcattctaaaagataaaaaatgatggctacaaaaagccaagtataaaaagaaacacgtacatatacacacacatacacctacacatgtacattcgaagaggcagaggagagacagagaaaataattaagacagcattagttcctaaatagccttttctataaactccatgacaacaaaggacaatgagtaaactgcagtatctaaagatttaaatctcagaatacctgccagatgccaggcatggtggttcacacctataatcccagcactttgggaggccaaggcgggtgaatggcttgagttcaggagttcgagaacagcttgggcaacatggcgaaaccctgtctctacaaaaaatacaaaaattagctgagcatggtagcgcacacctgtagtcacagctacttgagaggctgaggcaggagggtcacctatgcccaggaagtcaaggctgcagtgagctgtgatcacaccactgcactccagcctgggtgacagagcaagaccttgtctcaaaaaaaaaaaaaaa

SEQ ID NO: 2870 - DNA, 1951 bp, Homo sapiens
gcgtccgcttatctgaaattgtaacctgcctcctctctttggaactctcagtccctctgatgttgttctttctgtaatttacttatttattctgtttattgtgattatctattttgccccactctacactagaatcacactccacgaggtcagggattagtgtttatttcgtttattgacagatgccaggcatttagaatagtgcctggcacataataaaggcttattaaatagatgttgaataaatgaatcacctctttatagtgcctgtgccctaaactagatgatatcttgtctttgtaactttatagcacactgtgtagctctagtgatgcgtacatgtatgctggttgtatcttccaactttgctccttctttcctttaatatataaggtctatttaggaattgtcatctagcatttggatcagtgtccagtgatgttacatagtaggatttatcaaattttagaaagagaaaggaatttaccacactatcaaagaagtttaattactatgtcttattttttggtggaatcatatttaatgaaagagaatgtgaaattgctttgtcttatagttcagaaaccagttttcaaaacttccttcatgtagtaaatggaatcttctagtgaatgtcatgaaatttccaaattgtttttttttaattttttttaaaattgtggtaagtacatataacataaaatttgccaccttaactctttttaagtgtacacttcattggcattaagtacattctcaccgttgcataagtgtcaccaccgtccagttccagaatatttttaccttgcaaacctgaaattctgtacccattaaacagtaactcctcattcctccccaacccttagcaatcaaagttttactttctgtacctatgaatttgatattctaggtacttttatataagtgaaatcatacagtgtttgtcctttttcactggcttattcactcaccataatgtctgtaagacattatgttgtagcacatatcagaatttccttcctttttaaaggtgaataatattttattgtatgtattgtggacatactttcttttcattacctaaaaaccttcctcatcctacataaaatatctgcagtgtgctgtctagtatggatgaaccataaatctaccttctccaagattttctcccagttttttactattttaaaaagtgctgccgggcgcggtggctcatgcctgtaatcccagcactttgggaggccaaggcaggtggatctcgagatcaggagatcgagaccagcctcgccaatatggtgaaaccccatctctactaaaaacacacacaaaaaaaaaagtgctataatacatttgcttgtaaaaatatcctcatcacttatccacatatataagccaggcttctaaaaatggcatttctcacctgtagtcccagctactcaggacgctgaggcaggagaagtgcttgaacccaggaggcagaggttgcagcaagctgagatcgcaccactgcactctagcctggtcgatagagcgagactccatctcaaaaaaatgaataaataaataaaaacagtatttctgggacaaaggtatacagacccaaattttatagcagttgttttcattcatttacctatagatattttaaaagcacctgctaggccgggcacggtggctcacgcctgtaatctcagcactttggtaggccgaggcgggcggatcacgaggtcaagagatcaagaccatcctggccaacgtggtgaaaccctgtctctactaaaaatacaaaaattagctgggcatggtggtgcgcgcctgtagtcccagctactcaggaggctgagaatcgcttgaacctgggaggtagaggttgcagtgagctgagatcacaccactgctctccagcctggcaacagagcgagactctgtcttaaaaaaaaaaaaaaaaaaa

SEQ ID NO: 2871 - DNA, 3431 bp, Homo sapiens
gcgtccgaaattaataagctcctaacataaatttgatgtcatttgcagatgagaaaatggggcttgatgaagttgattgcttcaatgatgcaaccagtcctgcttgaactcctctctgtctggaggaaggaaggcagagactctagaaacatacatgattcccacagcatgtatgtgctgaggaagagactgagtgggtcttggcttcaggcaggtctgtactctactgtgatatcagcagcactcatccttgaatctccaagagcttgtcttccttcaaaaggctgattcagacacagagtctagacttgtttctcttttcttaaaagtacacatcaggaagaaaacctaaggcctcttgtaaaaacatcactgacatgcttcctggtgatttctcagcagctatttgtcccccagatatattttttcactgccatttcacccaatgttaattgaaatgctaaactaaatgtttagccatccttgcatgcatggataattaataaactgattataaaattatagtgatgagggattactaagccatgataaattacaatcattatttcagtcttgactataaagattattataaggatgatagaggtttcttatggatttttagtcatttacacataatgaagtaaaaatgtctttttcaattttcaaatatgtcaccgaagccaaaattggatcttgtcatttttaagttttgtatatgcttgatttctgttgtatttgtttcagattgtgtttgcttcatgaaaaggatgttttcttttttcaggtagtgaggggtttaactacattttatttctcccaaaagcttattaatcttggcaataaaaattctatatttctccagcaaaatctaagatgcttacctcaaagcagcttttgaagttatttctatcagtattgttctgattatgctgtgaggagcctgaggaattcctcagagacacctgaggacaggggcaaggaaaaatatcagagtagactgggatgggggaggatggagatggctcttgcagtcgtgaggaactcacctctggttgagttgagcagttccacttttgatctgtgttgcatgttggacttttacataaggttttatttgaagaaagatccatgtggtaccatgaatattaataatattaactaataataatattaactaataatcaaaaggacttgaaatccaatgattaaatacctaaattttataaatgagggaactgagcttcagagagagtaaataacttgtttaacataacacagctagtaaaaatttgcctgaattaattattcctaaaaattaaaaggctatgatcaacttaaccaatatttatcaaatgcctacaaaggaaaaggcactatgccaggcctccagggaataaagaaaataacaacgtcacacttcaagtaaatggcagaatcaaggcatgaatctgaatcttcttaccccaactagagtgcactttccactatagcagtatgccccgaatttggtttatgaacacctagtctttcaggatgatcttccacttgaaaaattcaattgaagttttgcattgcattttaaagggtatgagaagtcctatagtaaagaaatgtgcttagactacagttccaaaatttattaccatggaatactattcatgtcatatgtatttatatcccaaagaatgcaatttgagaaattctgcactatcatagctctctttattagatttgaaactgaaatctagcagagtcttcttttaaaacctacatttccatggtttacatgtaactgtggcttgagaaatgttaatctcagtgataagtgttagactggatatactctttatatacacatacacatattgtatgtggatgttacagaaaatactatgtccaaataagcataaattaaatgcagtataccaactgttaacacagtattgtgtttgctttaaagttggctcacacctgtttaatatttgtcatgaaaatctcaatgcagtttttattccttctaaacatttaatgccagcattataattcactggaaatgttgaattaattttagtaaaataaggactgattaatacctctagtccaattttcagataaatgactttctgcaaaaggaaaatcaatttgtttttcttataaaacacacacaccttgctgcattttgttttggtcagaatgttaaatataaaaaataataaatagcaaaatttcccccaaaaattcatttcaggtacaccgaacaaaaataatgccataaaccttggaagagaacctgttctcgcaagaccaatttttcaggatcaaaagtgtttatataagctcacaaattttggatcttttccaagactaaatctccaacacttctgaggttggcccatcactaatatttacaatatatttgacatttcatgggatggactcacaggcctttatgataggcagcttcctaatatgacagagtgccagaacaatttgctgtgtgtgcgaaaggcagtaagatggcactggcattttgcaacaggaaggaaatgatctgtaggtaccttgagcctgttgtatcttgtcagttttgttagttgagaaatgtcattggggacccattagtacataggcagccgtgacgcccacctgagaagcactccttgccaagtgatttgagacctgtgtttgggcaaggttccttttcatagtattacattgcattacagaaaacttacagaaacaggccctcacgcatgctgattcttaaccctttataagacctagcatgatgccttacatttattaggccattataataagatttttcaacaggctcatgcccttaccaattggtacatgtaaaataaagtgtattctgaactcttttatcacacatccctctaataccccatttatcactgtgtttaattttatttttttccaaagtctggtcattcctaacaatgcttctgatgactgcataattattacactttcattgccaaggacagaaatagggtaaagccacagatgctttttctcctgccaaattaggattatcctccaaaatctgtattattacttggcctcttttaagagacccatttctttggattgtgagggttcacacctgtaatatgcatgctcaaggttctgtaatcttgaaagttgttttgtgagatcaagcataggaaactctattaggtatgacaaagatgggtaagatatggatcctgctctcggagagcttcaatctaattgtagattcaagacaaacacatatacatggggcaccacttaccaaaccccaatgaaagcactattgtagaagtggttcagatgcttgtattgaccaaaaaaaaaaaaaaaaaaaaaaaaaaaaaaaaaaaaaaaaaaaaaaaaaaaaaaaaaaaaaaaaaaaaaaaaaa

SEQ ID NO: 2872 - DNA, 2187 bp, Homo sapiens
gcgtccgacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggcttttgggaggctttaatcaccaacccatcaacatcaagcctcccccaggccggttcaaataaatgtatttaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2873 - DNA, 851 bp, Homo sapiens
ggcacgagaacaaattgatagtgagcattaagggtttccaagttggatttgtaactcctcatcattccttgtatgacaactttctgaatatatgtcactatgtagtaaaattaaacactccaaactcatctttctgttgttagaagttttcagcggtacttccatgcaactttaaatctcactgctctctatggttgatgtcaaatgaccttcagtaatgactgagaattgaatacaaatagattacaaagccaaaatttgatgttaaatgactcaggaaattttagttgtattttcaattcaagtacttagtagcctacgtttgcttggcctctggttctttatggaaaataggctttgtagtggcattgtggagcaaaggagactgttacaccttaattaactttttttactgatgcaaataatttgaggatagagaggagggaagtagtgaaagctatgacctaaaacattgggaccaaatagaggctcacagatatttggattattttatgtgcttattattaaataaggaaagcattttgtgatatgtggaagacgctatgtgaagttttacctatcttctcaaagaccttttcttttgtattttcttttggtgtttcttaaagccaaacaaagaaatgttcttaaggagacagggtgggtttttctgtgggcctttgttggtttttctgtkggccatcgccctctaatggaattgatctctggctgtttgatttttttcatattgtatttttaaaatttgttgtacagtgccctgtgagcaccaagtaccactagatgaataaaacgtattatatctaaaaaaaaaaaaaaaaaaaaaactcgag

SEQ ID NO: 2874 - DNA, 1139 bp, Homo sapiens
ggcacgaggaaaagtggttgcctttatgatagaaattcaagaatcacagggaagacatgcgactacctaaaatgcatctctttctcttggttaaattttggaatctttggacagggcaacttcttttaatcacaaaattgttttaacttttaaaatgaaaaatttctgacaacacattattcctaaatttataagaaaatgtaaatatataaaatcacagaaagggatgccaggagagccaagtggcactggttttggaaatagtaaagaaggaaggttagacaggggaataaaaaagaagcaaaaagattcaagtcaatctacacctttaaaataagaaaaaaataaaataagcctagataaacttgagagttctgttataatagccaggatacagaattaacccaagtttccatcagtggacaaatggattaaaaaatggacgaatagataaagaaaatgtatatgcacaatgttactttattttcttttactctgctttgagttcggggcaaatggttgattctcataattaattactaaacaatttccctttttaataatttatcttttaaaagcccccttaagctgtttttcccttagtcagatcttcactggggcttaataaccagttaaaaacactgatttgaaactgttctcttctataggcagcacccccacccagttacattgacattaagtaaatgcatagattaaaaactgttaaaattaggccttgctctgatggctaagggtgatcaaaggcaagtaaggagaaaaataaactgacagtcttcgaatgctgagagaatactttaaaactttttgggccaggtgtggtgtctctcacctgtaatccccagcactttggggaggccgaagcaggcagatcacctgaaggtcaggagtttgagactagcctggccaacatggcgaaactcatctctactaaaaatacaaaaattagccaggcgtggtggcgagtgcctttaatcccagctgcttgggaagctaaggcaggagaatcgcttgaacccagtaagtggatgttgcagtgaactgagatcgcaccactacacttcagccagggccacaagagctccatctcaagttaaaaaaaaaaaaaaaaaaaaaaaaaa

SEQ ID NO: 2875 - DNA, 2041 bp, Homo sapiens
  misc_feature (581)..(581): n equals a,t,g, or c
  misc_feature (1578)..(1578): n equals a,t,g, or c
ggataatgaaactttttatatctgaattgcacaaatccccaccaagtaatttcagcataaagcaaaccaaatggcagacgaaatgatgttagtaccttgtagtttacttcataatacataacctctaatccatgtccatcttcttgtttctgcttttaattctgccatttcctcttaaaatttagggtttaacaaagacaacagggctgtttgccaaatcgcagctattaattcacagcatagaaaagtcaaagctatagcaaaaaattgctaatctgcacaactttaaaaaatagttcagtacatttttgttataaaattcatttacaggaggttattcacatgtacttgtcaaatttactcctgataattcacaaaaacatacaactcaacaaactgtgcacaataaatccaaggcaaattatatacaaagaaacaaaacaagcttttaagtagcacatattcatttgaaataactaatattgaaagaagacagggaactttcttttaatgccatggcaaagacgaagcgaagagccacacttcacaccttgtaaaaagaatagccctgttcaacaacnctgcgctgacagccacatcaggaggggccacggtgaacataggaaatggctttggcaaatacttgtaccaactggaacgagtgaagtttcaaaagtaatgtgaggtacaactgcattccgctgtgaaaggccgtcacaggacacaggctcgtctgttagaaaggatgatctagttctaccattaattcttgcagaatcagatctgctgagtggtgaaccaacaggtgaacacaacgtaagaacaggcatcaaacttcactggaaataatattgttcagtgtgtggcggcaaaatatgcattttagagaaaacttatttctcaaatcatgtgttaatagtattaacatgagcagcgtgagagacatcctgaccccaacgtttttgccatgcctccctttagaagcttaggagtttgtacattccctaagtggtcagcactacaagtgtctgctaaaatgggcacttcatcaagataacaggaaagcaaacttaaagtaacgagatttcttcccaaaggcacatggaagaagctgatagagcccttgacccagacagaatgggacccatccctacccgtcctgaactgtcgcacactgcatggccaaagacaaactctccacccccacagaggaagcagtggctgactctggggacaaagcactccaggaagtcacctgctccctgggtttcaggagtattcagttgaccgtctggacaccagtgagggagacacaggtaatgaaatcaaatgctcaaacttttggcaaccgaaagttgttttttaaagctctttataatctgctcaagtagaatttctaacacaaaacccttttttgcttaaaaagcagatgacaaaggaaatgtcaaataatgcacatgaatcttcagctattttcctacccccaaatgagatatggggctgcacagcattcactacagatccctagtttttacaactgtcaactgtacattctcatgtttaggatactccaggttnctgcgtggatatttggaaaactggacaaaatcaggcagcccacccctcccttgtcccgagcttcctcgatctccattcaccatgaccaattttttcccccacaaaagcactatcacctctaatagtagctggaaacacctatcagatattctaaacagcatgtatttttaccaggtagatgatttctgaagatcacaggaagtctaccactctcttcccagttctgaactcctctggttacgcttcattttaaatcgggtgcttctttcccgcccaaaatattctatttggcctgccccagtggttcccaagctgcctggtgatcagaatcccttgggaaatgttgaacacacagcttcccaggctttctggaaaactasttagatctgtctgacaatctgtaagctgaggcgattcttccacagctgacccagcgctaatctassatttggcaaccaaatga

SEQ ID NO: 2876 - DNA, 733 bp, Homo sapiens
  misc_feature (303)..(303): n equals a,t,g, or c
  misc_feature (483)..(483): n equals a,t,g, or c
  misc_feature (490)..(490): n equals a,t,g, or c
  misc_feature (492)..(492): n equals a,t,g, or c
  misc_feature (499)..(499): n equals a,t,g, or c
  misc_feature (582)..(582): n equals a,t,g, or c
  misc_feature (606)..(606): n equals a,t,g, or c
  misc_feature (608)..(608): n equals a,t,g, or c
ggcacgagctcaacctcaggaagtcagtccctgggagccatgaagtgcagcaatgacaggcccatctggagaagacatgacggctgggtctgcaggacccagctgaactcaggagcagatttggggatggcaatcagatgctgttcttctacctcaaatgccttgatccttattctcttcacctggacagttcttcttcatcatccaagatccagctccttcctgccttcttttaagaagccttcatggacctctcccctgggttatgccatcatagccactccatgcaattctctctcatancacttatcttgctacattgaactgtctgtctctctaacagagtgtgagcccgccttgaagctggaagtgaggctccaggctggtggcattgtcctgggctgaactgtctcctgaaattcccatgttgaagccctaacccctagtaccacagaatgagactgtatttggaggtagggtctncactttntnttttttnagttaaaataaggtcattacgatggcccttggtcccacctggctggtgtccttatgagaagagatgaggacacagcacacgcncagagagaagaccacgtgaagacncngggagaagatggagagaggcatcagagggagccagcactgctgacacctccgtctcacatttctagcctctcgaattgcaaggaaataaagttttgctgtctaagccaaaaaaaaaaaaaaaaaa

SEQ ID NO: 2877 - DNA, 2722 bp, Homo sapiens
aaattagtcaaacattttattatagagtatatatttatatcaaaagcacaaaaacgtttattctgaaaaccaggaagattgtgatgttacagaagaagattcaataattccagtccatttctagggtactaagtgtctgatcacctcagcgaaaacaagatacaaatgaggccaaggtcacaggtctggccaccctgagtcccttcgcactatttggtttctcaagttgagacacgtattcccagtcccagttagccaccttccaagtgtttgctactagccttaatgggtacttagccaaagactacacccaaatataaccaaagcttatgttaagtcataagattaatccttcaataataaggatagcataattggctttgttacctaattctacataaacaaaatcatcaaatatcctggcataactgaaatgacttacagaggaagtagtaaagcttggaagtattctatggtaactgagctgaaaaaggggaaatgccaaatgttgtaaatgccatcattaccaataagagtcaccaaattctcagaaataggtaattggcagctcaaggcagttagcactacaagatttctcttgcctttaaaaaaaaaatcatttttaagactccttttttaaaaggctacatcaaaaaataaaccaaaataacaaaaattaaaaggcaacatgagtaaaataactcacaaatttaaaaatcagattattattcctgtttgttcttacaagccattagtattcttttaaaacttactccctgagagatcccagactatgttaagagtgagcttgaagttattcttatttaaaaagaaaatctatattagctcatcacatttgatattattataactcttaaagtcagcagggtaaaatcaaattctaaggaatatagttttgagaataatttgagggtaaatgtaatgtatatatcaaatttgtattatagtcaaggatttaactgatggtgccgaaagtcaagtatttaagagttaagacttttaaaaattgtaccccccaacttatttagtaaagtacattaccaactactgatttattgcttttaatgtgatgaaacaccaaatttgacagctaaagtagcagtgggatacaagtatgtttttatctttaatcatttttgtagaataggacatgtacatatccatataaaaagagactgtagcagatgcctcccagaatcaaccagttcttgtaaacattgcatttgtgcagattttcatacttgattccaaaattgagaacaataagattaaaagcaaatttagtagccacaaaaagtccagtttgacttcctgcaacatatggtaccactcttctcttcagaacaaaacaaaacaaaaaacctagcagcacattaaaaaaaatttacaaaacatttcagtactctttccctcccatcaaaaaccgaacaaaaataaagtgcagcacccataaaagtgtcaagaaaatagccaagttcttcctttcttgtaacaaaatagcacttggcctcagcagtcttaaccaaattatacagtgtccatcattttgggttcatcatcttctttatgtaccaccgagtttaagctgcagagagctgtactgatagaatactgaagataatctggattctgtggtaaggattctaataaacctatagatccaacaccagaatggggaacatgattctgaactgtcataggttgaaaactttgtgattgagaataaagtcttactcttgacttgaaagcttcaagttcatttttgaatgcttcaaaataaccttcttcctctgctttggctttctggaaaaataaacgaaaacaccctcttggatccacattacagtttttggccatttccataataaactgcattacaacagcttgatgtgctatttgttccattaaagcccctttcttctcagcttccaggtgaaaacaccataaaataagatatttagcagtttcttcacatacaaggtatggatggtcagacaaaaatctctggctatcatcccatcgactcaacataccaaaatgtctgattttttgctcatatttttgcataaatgattctgattttatcttcatcttctgtgtcttttcttttatcttgattaataaaactcttattaaaaacatccttgctaatggcatccgtgctccacagacacatcttctctctttgtactagagcttcttctttctgtcgccactcttcttcccgttgcctcagttctgatactgctgtttgtgctttggcatgctcctgatccaaggactcagaattatgcagtgctaagctaccaagtttctgttgagcttcagcaagattccatttgcacgccacagagctcttcacaaactctttctgcttttggcaagccaattcaattccatggctatacatctgggcgccgccgcctggcagctgcgggcagcggggagaactggggaacacgtcgaagtcactctcttcctcagcctcaccctcggcccgagggaggctccagggtcccggaggcggccacggttgttccatgtccggctgctccgggtcctacaaccgcccttggccctacaactgccactgccaacagacttggcgtgaatggaacctgctgcgccgagccagaagcccagccgggggtccgggccgttacccagaatccctctactggccgcgacgccgccggacgcg

SEQ ID NO: 2878 - DNA, 513 bp, Homo sapiens
ggcacgagattttttaaaaaatcttaatttttttctctgttttagggattatcttaattaaaacttagaaaataatgacttttggtttaggccagggcctttgttttcttttttgctaccaggtacttgttgcctttagactgaccaaccagatccctgcactggggtatatatcccatctatcttcccacataccatacttggctctctttggatagactctgatattaagtacttgtttctcttctacttgaaagtatctatatttcatggaggatggtgcttcttaacgttctggttgcagggctctaggcctgaagggcttttttggctagtgaagatgggtttcatcatgtttttcaagtcacactttcttcggtggtggtcttgttgccatacccagctgagcttatatctaaccagccctactttcagagagttggcattcaggtgtcttcatataaagttcagttatgctggagtaacagagaacaaaaaaaaaaaaaaaaaaaa

SEQ ID NO: 2879 - DNA, 824 bp, Homo sapiens
gaattcggcacgaggagaaatttttcatttttgatttttaaaccattagagcagtagctgagcctttcaagtttctcagtcaagaattaggctatgagtagggacagttttcttctctgttttatttttatttttgttcccttagtgacattgcaggaatgctgctgaaatctacaggaagttttttagaatttggcttacaggagagctgtgctgaattttggactagtgcggatgacagcagtgcttccgacgaaatcaggttggagttgtgcttcctttccccttccacttcttatctcgtagtttccttcctcatggtgagatcctagaaggagccttgttcaaaccaaattgtgttggcctggaagaatttgggcagtagatgtaaagggatttatttataactgccttgtcttttcatgtgatttcttagttatggttttatgtgaaattttctttgaaggggaacttagaatttatttagtgtgataaaaatagtgccaactggctgggcgcggtygctcacgcctgtaatcccagtactttgggaggccgaggtgggtgaatcaccaggtcaggagttcaagaccagcctggccaagatggtgaaacctcgtctctactaaaaatacaaaaaaaacagctgggcgtggtggcacgcacccgtgatcccagctattcaggaggctgaggcagaaaatttcttgaacccaggaggcagaggttgcagtgagccaagatcatgccactgcactccagcctgggtgacagagcaagactccgtctcaaaaaaaaaaaaaaaaaaaaaaaaaaaaactcga

SEQ ID NO: 2880 - DNA, 1095 bp, Homo sapiens
gcttggtggtgctatttgcttcttcaaattctcgttatttaaaatatttctttcttgtaccgttgattctgggatcagcctggatgtgtcaaacactgcctgccaggcttagagctcagtgcatttcttcccttttattcctgctgatgggattgctggccatgaccggtgagaggaatcaaggaacccattactatgagttctcaggattcatcttcaaatctcaaatgatgtggtcaattaaaccaaattaaaaacaagctcttgttaaaagcaagttaaaaacaagctcttgaccttgagaagaaatgattggtattaggaagactgttgagctgatactgcccttcattcattctctaccctggtgcttggatacaggagcaaagtaagaaaataatcacagctttattgagggctctatgagcaaggcttggtgaggatggaagagaatggagctatcagttgatgagaacctactaggtgttgagctccttacattcattgcctatttaaaactttctaacaacttcatgtgtaagcgttgtcccgatttaaaaaaaaaaatagatgtggaaactgaacctggagaaggtgtgtaatttgtccaaggttgcacaggcaaaggggcaaaattcagctttaaacccaggactgtttccacagctccaagtyccctttattcatgggatttgtaagatggagcccctgccactgtagcatttataacttactttggagaataagattcctgaaagtacgtttaataaaaaaaaaagatgtccagctatgtacggcagctcacgcctgtaatcccagcactttgagaggcaaaggggggaggatagcttgaggctaagagtttaagactaacctgggcaacatggcaagaccctgtctctaaaaaacaaaattagccagttgtggtggcatgcacctgtagtccaagctactcaggaggctaaggtgagagggtcgcttgagcccaggagtttgaggctgcagtgagccatgatggcgccactgcactccagtgcagagtgcaggctacagaatgagaccccatcacaaaaaaaaaaaaaaaaaaaactcgag

SEQ ID NO: 2881 - DNA, 2508 bp, Homo sapiens
  misc_feature (1074)..(1074): n equals a,t,g, or c
ggcacgagcagcgcgcacttaccaccatgcagatccaggtcgcggggctgctgcagtttgccgtgcccctcttctccactgcagaggaagacctgcttgcaatccagctcctgctgaactcctcagagtccagccttcaccagctgaccgccatggtggactgccgagggctgcacaaggattatctggacgctcttgctggcatctgctacgacggcctccagggcttgctgtaccttggcctcttctccttcctggccgccctcgccttctccaccatgatctgtgcagggccaagggcctggaagcacttcaccaccagaaacagagactacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccctgtctccgagtacatgaaccaagccatgctctttggtaggaacccacgctacgagaacgtgccactaatcgggagagcctcccctccgcctacgtactctcccagcatgagagccacctacctgtctgtggcggatgagcacctgaggcactacgggaatcagtttccagcctaacagactttcgggggttcctgcctcctttttccgttctggtttttaattagtgcaaatacaagctgcgtttctttaatagaaaccaaaggcatctggagcccgagaggcctcctgctgtggcagaggagcagctgggattcccgaccaaagccccagggggtgcagaagactcaccacgcgggccagcctctctcttttgccctgctctccacaccagaaatgcccccaggtgcttggctgcctcagaggtaccatccctgagctggctgcctggccctgctcacccctacgcctcgcccttgccaggaggggagtggcagtgaggagggggccaggtcaggcaccaccatcaagagagctgtgtgttctctctggtcccacaacgatgactctgcctctttgggtncaggccccaggcccaaagagcccagacgacccctctgtcctcgttccctgtcctcgttccctgcaggtaacatgagaagggctgatcaggagatgctctttaagaagttcgcacccctgctgacaccagaacagcccaaatcagagttcccagggccagacaggctcttcctgggccacagaggggaggcatcaggaaagctctgcagtggggggctggtggctccggggctgggggatcacaggctggtgaaccccggtgggaacagaggtgaaagcctgccacattccgcctgtctccctaaccctccattgcctcgcctctattccagaatcaatgctgcagaatgtgttagctgcagataggcatggtctcaggtatgaacagacactttgaaacgactttaggtctttcttttctccagtgttttaaacatgttgattatccaaagaattgaaactcctagcacatccagtttttacaacagatttgcagctcattccttaccctggttaggtcactacttttgcagattttgctggcactgatctggagatctgcagatctggaggagacgggaaggagtcgattcttaaataaggatcagtgaggcatcctgtcccaagctactgtttggtggggatctgggttcatctcacccacagagggaggatctttaagaggagaaaaaagccaagagggaaagccagagttccctgttctaggggactagccaaatgcctacatcagctgtcccctccctgttgtctccaagtaagtttgccagaaaaggttttagcaaagtgctacaactgtgtctttataggaggataggcctctgccctgccccacccccaccacctgtccccacccagtgtcccaggccacaggagcttattggccaggagggaataatgtcccccaatactgcctgttgagggaccagagttggggtctttggtgcttccaacctcctgccaacctggagttcacaacaccagagccccacggcctcgcacactgaagcaggggcgtgcggtgactcggtgcttctgttttggaagaaccacctgtcatcaaaacatggacagcagggtgttctcagctcccagcgaagcctccacaacagaatggggccacagggcagccgggactccctgtctcacctacattaacccatgcatactgtatgccataaactcactttggtatatccgcgtcacatgcagagaggaactctgcgacgtcaaagtgttgcttcttaaagtttcattattggcaactagagggttgtttttaatgcatggaaactaaacagattcctcggggagttcctgaaggaaccaggtgggcaaacctttgcttatatacatgcggcctcacctggaagagaaataaaccacttgtactaaaaaaaaaaaaaaaaaaaaaaaa

SEQ ID NO: 2882 - DNA, 490 bp, Homo sapiens
aattcggcacgagaaaagcttagagaaggaaatagtaagtagatgaccagggctactactgagttcccctcccctaaatttagcacgttgcttgtcctggtattatctttactgagagctcacatacttattccaaaggagcctcttcagtctagctgcttactgaaaacactatattgggcctgttcatgtaatagtgatttcattcgttgcattcttagggaagtttccggtaaaatatggagatttagtaaaaccttataattatatttggggtcaaaactagtttggaatattttaatagtgtaacttaaaattaacaaaggaaagtttccccccgcctcctccacccagtgtttgtgctttaccataacattattaagactggtaaagtgtaatgacatatcaaattgcaaagtctagcaaatactgtagcaaaccctaaaacactccccaccgcccccccaaaaaaaaaaaaaaaaaactcgag

SEQ ID NO: 2883 - DNA, 1369 bp, Homo sapiens
  misc_feature (3)..(3): n equals a,t,g, or c
agncagacgtagaacgtagtggatccccaggggtgcaggaattcggcacgagatttgatacccagtgccatattgtccctaagaaaggttgcacaaatttacactcccaccaagagtgtgggagagccatttgccacatagactcaccagtattttttttttaatttttgatccatttggaagttatttgggaacttgggtgtttttccccaaaagcaaaggcaattgcctcaacaccagttatcaaaggatccctacagatctattttccctgtagatctgaaatgctgtcttcattgtatcttttgctgatgcccccgtacaaatttacaggtgagctccatcctcctgtagcagccacctgcctactgacagtcctactcgggtgtctgataggtgtctcaagtgatggatggatatgacagtagagtccttgatttactgtcccatggcccctgctcatcttctctttcttgattgatggtgccatcatctacccagttactttgaccaaagcaatgggagtcatcctggattccttkctttytctccacttctaagccatcagtatactggcactgtgttaaagccatatttcaaaccagaccacttgtcaccattcctgtcacttctacctcttttatcccaacatcacctcttgggtagaccattgcaaactggaagtgcatttccagaatattcttgttggtatagaaccctctgtctacatagtagctagagcagttttttttttttttagatgttaaacagatacatcgctctgctaactaaaaccctttaaagtgttttccatctcaattagaatagaattcatagtcctcaccagccactgcaaggtttatataatctagcccctgcctatcttccttgcctcttctctgttacccacaacctgctttttgtttcatgatgtgtgaactcatttcaaccttagggtcctgctcttgcctcttcctttgcctagaatgcttttcccttgtcctaaatcatctgtgttatgctagtttttargtctcaactcatgtcaccccgttgscctttatctcattgtctggctttattttctctaaaacacttggcactatgtaratgttctatttatttacttattttaagggtagaatctttatctgttttgcttggtgccaattattcaacatgttgaatagtgcctggcacctagcaggcactggagcctatttctggaatttcatgttgcaccattgccctctctgtttgttctccattactaaattcctttcaagccaaccccatggcctccatgactttttcaaaaaaaaaaaaaaaaaaaaaaaaaaaaaaaaaaaaaaaaaaaaaaaaaactcga

SEQ ID NO: 2884 - DNA, 1705 bp, Homo sapiens
  misc_feature (724)..(724): n equals a,t,g, or c
aattcggcakagggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgyggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggnctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatggcttaaccctgactttgggatctgcctgcatcggtgttggccactgtccccatttacattttccccactctgtctgcctgcatctcctctgttgcgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacaggraaaaaaaaaaaag

SEQ ID NO: 2885 - DNA, 582 bp, Homo sapiens
ggacggaatggtgcaaccctcctwamttttctkgkgctgttgacaacagagggagggagggaaaacatttttygtgggagaatcctacytctgcagsggagcccttaagcgatkgattttgaatctkgaccctttaccaactaattttgaaggaagataccttggaaatatttggcattcagtgggttactgaaacagcattagtgaattcatctagagaactctttcatttattcaggcaacaactgtacaacttggaaaccttgttacagtccagttgtgattttgggaargtatcaactctacactgcaaagcagacaatattaggcagcagtgtgtactatttctccattatgttaaagttttcatcttcaggtatctgaaagtacagaatgctgagagtcatgttcctgtccatccttatgaggctttggaggctcagcttccctcagtgttgattgatgagcttcatggattactcttgtatattggacacctatctgaacttcccagtgttaatataggagcatttgtaaatcaaaaccagattaaggtttgactggtttcatttgatttttaag

SEQ ID NO: 2886 - DNA, 1167 bp, Homo sapiens
  misc_feature (1)..(1): n equals a,t,g, or c
  misc_feature (6)..(6): n equals a,t,g, or c
nggagntccaccgcggtggcggccgctctagaactagtggatcccccgggctgcaggaattcggcacgaggccaccaaccgtggcatcacgcgaatccggggcaccagctaccagagccctcacggcatccccatagacctgctggacaggcgccatgtcactctccagggcccggttgaggaaggagaagctctcgatgtccagcatgtggacctcgtcgatgaacagcactccagggatgatctccgccttgccctcctcgcgccactcagccaccttggcattgatctgctcacggacttctgacttgatctcccctgtgtcacctgagaagagcgccaggaagccctgggtgcgagagttgatgacgtcgatctcgtgcagggacacggtgtgcaccacctccttgcgtttctggagctccccatctgggcactgcacgaacttggtctgggagcccatagcgtcgtagttcgcgggcgcgtgtgaaggagcggcccagcttggagatcttgcccgtcgccttgtcgatggtgatcacgtccccggcctggaccttgtccttggtcagggamtcaatcatcttggtgcccaggtcgtagatggtctccatctctgtggtcttgagggtcagtttgcccaccttggagcccgtccctgttgctggtcgatcaatctggatctccaccacctccccttcgatgatctccgtctcctccttgatgcgaacgccgatggaccgccggaaggcctgcgtcagcgcctcggtcttgctcatctccagggagaagatttcactgccggcgatggctgtgaatggcgtgtcagggcccagggcctgcgccatgcccatggcgatggccgtcttccccgtgcccggctggccagcaataaggactgcccgaccggcaatcttcccttcccggatcatctccagcaccacgccagccgcccgccgtgccgccagctgacccaccatgccttgcgaagcctgccgaggctccaaggcatcgtccagccccagtccccggatgtgggagtgggcaccgattcgctcaatccttgttacatcacggatctccgggactttggttgtggctgtaacggttgccatgatgctcaccaactgccagagtctagcggaaaacctctgccgaattcctgca

SEQ ID NO: 2887 - DNA, 3989 bp, Homo sapiens
  misc_feature (17)..(17): n equals a,t,g, or c
ggcacaggccgcagggnacctatgggcgcatataggttgtaatgaaactgtagtctcagttggaagcctagacatgaaatgggtcagtgagcaaggctctattcctagtctccagccatgcctgtggaacctgarcccrctctcagcacattggacccaggcagatgyaaaaaattcacagaactatgatttggactcaagggtttgtagatttcctccttcattctaatttcagtgtctaaaattcttgcatccrtgaacgagctgggcatttgatgagacagggcygaatactgcagttttcctcctagaaatcatctggggcattttctttgaactgatgggaacaataaggcataactgtttgcacaaacttgggataartgattttgggataacgatctaccagaatggggatatttcacccttggttctgagatgcaaaccaaagaatatcatgaccagctttcaggcctcctgaagtatatctctcacattgtcctgttctcatgctgaggagcctgagatccctgtgtggggattagacagtggactgttatgggtgtaggtgaattggcttattttgtctgtccctgtctgaatgtattgcaggaaytaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagrgcctgaagtcttgcaggactcactggatagatgttattcaactccttcagttgtgttgaactgtgtgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgckgtttactcattggaggamcaktaccttggcttkkctcttgacgtggasaaattgaaaagaaggggaaggggaaraaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttayrtattggagcaacagygtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaamgaagraaagaagaaggggaagaaaagaaggggaagaagatcaaaacccaccatgccccaggctcaacggcgtgctgatggaagtggaagagcstgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttastaakccgagagatgtcattcctgcaggcaggacctataggcamgtgaagatttgaatgaaagtacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcrgacattttaatttgaaccacgtatctctgggtagctacaaaattcctcagggatttcattttgcaggcatgtctctgagcttctatacctgctcaaggtcaktgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctagrctcctttggttagagaagccacagtccttcagcctccaattggtgtcagtacttaggaagaccacagctagatggacaaacagcattgggaggccttagccctgctcctctcrattccatcctgtagagaacaggagtcaggagccgctggcaggagacagcatgtcacccaggactctgccggtgcagaatatgaacaaygccatgttcttgcagaaaacgcttagcctgagtttcataggaggtaatcaccagacaactgcagaatgtrgarcactgagcaggacagctgacctgtctccttcacatagtccatrtcaccacaaatcacacaacaaaaaggagargagatattttgggttcaaaaaaagtaaaaagataatgtagctgcatttctttagttattttgarccccaaatatttcctcatctttttgttgttgtcatkgatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctyagcccatctgcgggcagagaaggtctagtttgtccatcascattatcatgatatcaggactggttacttggttaaggaggggtctaggagatctgtcccttttagagacaccttacttataatgaagtatttgggagggtggttttcaaaattagaaatgtcctgtattccratgatcatcctgtaaacattttatcatttattaatcatccctgcctgtgtctattattatattcatatctctacgctggaaactttctgcctcaatgtttactgtgcctttgtttttgctagtgtgtgttgttgaaaaaaaaaacattctctgcctgagttttaatttttgtccaaagttattttaatctatacaattaaaagcttttgcctatcaaaaaaaaaaaaaaaaaaaaaaaaaaaaaaaaagcggacgcgtgggc

SEQ ID NO: 2888 - DNA, 567 bp, Homo sapiens
ggcacgagagcatttcctacctagtgaagaaggggacagccactgagtccagcagagagatcccaatgtccacactccctcgaaggaacatggaatccattgggctgggtatggcccgcacagggggcatggtggtcatcacggtgctgctctctgtcgcccatgttcctgctggtgctgggcttcatcattgccctggcactgggctcccgcaagtaaggaggtctgcccggagcagcagcttctccaggaagcccagggcaccatccagctccccagcccacctgctcccaggccccaggcctgtggctcccttggtgccctcgctcctcctctgccctcctctcccctagagccctctcctccctctgtccctctccttgcccccagtgcctcaccttccaacactccattattcctctcaccccactcctgtcagagttgactttcctcccattttaccactttaaacacccccataacaattcccccatccttcagtgaactaagtccctataataaaggctgagcctgcatctgccaaaaaaaaaaaaaaaaaaaaaaaaa

SEQ ID NO: 2889 - DNA, 1148 bp, Homo sapiens
taggaacgtagtggatccccagggatgcaggaattcggcacgaggttaattggttccagagattcaaagccagagttgctgtcagttcattggtagagatgccatcactgggcaagtgttctgaaaacatcttatctgaataacagcagtcctggagaacatctagggatctagcaaagcgagagatacatgaaggacataaaaacgtttttagaaagtccttggaaacagttctcatttcagacatgtaagcatgagctaggatgaaaagtgatttcatcctggtatctgcaattttcacattcattaggtttcaacatataaactttcaggggacacagacattcagactatagcaccaagctgtagaagctacatagttgtagaccagggtcagcaacccaagaagcctgacttccaagctgtgcttttaacttccccaccatgttgcacctaaagctttggagttttcctgtgattagtgtttttggtgttgttttattttttttcttacaggaactcttgcaagaagaaaggactatgagttcaactttagagggagccatggggactaaacaaaattctgaggccccctcaaccatctaaatggacttccttctgggccaggacactcgaaaattaaacctgaaagactggttcaggccatgatgggaagtgggagtcgaacatgcctcatcataccctccagcattaacatcaacacagaccttaaggctgataagaagcatttacaatcyattctctctgaagtcttctacctggaggcttcatctgcatgataaaactttggtctccacaacctcttacaacccaggcattcctttctatcgataattactctttcaaccaattgccaatcagaaaattgttatatctacctataatctagaagcccccacatcaagttgttttgcctttctggacaggaccaatgtatatcttaaatgtatttgattgatctctcatgtctccctaaaatgtataaaaccacgctgttccccgaccacctggagcacatgttctcagggtctcctgagggctgtgtcacaggccatgttcacttacatttggctcagaataaatctcttcaaatattttaaaaaaaaaaaaaaaaaaaaaaaactcga

SEQ ID NO: 2890 - DNA, 1131 bp, Homo sapiens
ggcacgaggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggragtcattgggctcctattcggtggttttaagccattgacagttactggtccacaagcctttcctacatcactttgaacgtactcaagagagcgctcaacaaggratttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgaattcttctgtcagaaaaaaaaaaagaaaaaaaaaaaaaaaaaaaaaaaaaaaaaaaaaaaaaaaaaaaaaaaaa

SEQ ID NO: 2891 - DNA, 327 bp, Homo sapiens
  misc_feature (266)..(266): n equals a,t,g, or c
  misc_feature (273)..(273): n equals a,t,g, or c
  misc_feature (279)..(279): n equals a,t,g, or c
  misc_feature (286)..(286): n equals a,t,g, or c
  misc_feature (305)..(305): n equals a,t,g, or c
gaatcccaaacttgcttgaattcctacctcttgacctttgaaaaatgggaacacgctgctcttgcattactggcagctgcaatgcagcatttacctggactatctctgcatcttgttcttgtgtttctggagtcactgggaagctgtgcaaccccacaccccagagcagcaccagcagcaaaaaaaaaaaaaaaaaaaaaagaattcgagaccagcctggacaatatagtggaaccctgtctctactaaaaattacaaaacttagnccagccnggtggncaggtanccgtaagttcccagctaanccgagaaggttgaaggccgaag

SEQ ID NO: 2892 - DNA, 299 bp, Homo sapiens
gaattctttttttttttttttttttttgacagagtctcactgtgtctcccaggctggagtgcagcagtacaatctcggctctctgcaacatcttccttccaggttcaagcgattctcatgcctcagccccacaagtagctgggattacaggcatgcatcaccacaccctgctaatttttgtatttttagtagagacggcgtttcaccatcttggccagactggtctcaaactcctggcctcaagtgattcgtctgcctcagcctcccaaaaaaaaaaaaaaaaaaaaaaaaagaattcc

SEQ ID NO: 2893 - DNA, 338 bp, Homo sapiens
  misc_feature (332)..(333): n equals a,t,g, or c
  misc_feature (335)..(335): n equals a,t,g, or c
gaattcttctttttttttttttttttttytgagacaggggtcttcctctgttgctcaggctaaagtgcagtggtgcaatcatagctcactgtggcctctacttcctggtctcaagtgatcatcytccctcagcytcctaagtacctaggagtcatgcaccaacatgcccagctaagtattttatttttggtagagataaggtcttgctgtgttgcccaggctagtctcaaattcctggcctcaagcaatccttctgccttggcctcccaaattgttgggtttkacaggcattagcckttatgcttggsccccaggtcctttttttttaaaanntnaaa

SEQ ID NO: 2894 - DNA, 473 bp, Homo sapiens
  misc_feature (1)..(1): n equals a,t,g, or c
  misc_feature (345)..(345): n equals a,t,g, or c
  misc_feature (351)..(351): n equals a,t,g, or c
  misc_feature (378)..(378): n equals a,t,g, or c
  misc_feature (397)..(397): n equals a,t,g, or c
natgagtttggccacgtgatgcaccagctctgctcccaggtgggtgcgggcccgggcaggggcaggggcaggggcaggggcaggggctgcctgtggtcagcgaggcccaagcctggggcttcggcttccggctctctctgcacccgtccggtggctccttcatccaatgccacccaaagatggtgactccctgtcatgcccgtttcctggggctgccccagcaaaacaccacagaccaggggcttacacaaggtgcgtgtatttcctcatggtcctagaggctggagtcggaggtcacagtgtcagcagggttggctccctcgaagtccctccttggcttgtggncgccancaacttcccgcatctcatgtggtcgtncttctgtgttggttcccanttcgtcttcttaaaagggaacccaatcaatgccggattaagggcccgccaaaaaacttaattgaacgtaattaact

SEQ ID NO: 2895 - DNA, 878 bp, Homo sapiens
gcaacagatgaattttgggtgacacaaacattcagaccatagcagtcactatctaacaacaggtggatgggacgtttgtctaaaccgaattgtacttcggtaacaggatcatataaggacaaatttaaccaatgtcttttttagtttttagtttcttttgttttggttttagcaactctagattttctagagactatcaacattacctttctttgctctccagcccccatgcccagaaaagaaataagattattagggagtcaagcatctcggctcttcttacctcttagggtagtaaattgctttttgtatgcgagtggttttgcgtatgtgaagataattttgagataggagtagaatgccctgaagataatgcttatgttttaaagataataagccaacacagtgaacggaataagctgcactggacctgaggagtgaggttaaatagggaagtaagacaccacctggagacagtattgctcaagactgaaagtggatgagggttgcaaagctgtttgcacagtgcttctgaagcatcatggcagcctggggaatttcccatgctgagcttgcctggagtatgtgtgtgtatgcatgcatgtgtatgtgcattcgtttgtgtgtgaaggaaggggagcagagctgctggcttagtcagctacctttgaatgcttctccctcaacagaggctgagaaccagaccccttgcctttgtccctgaattatattagctcaggggttcttatgccatccaaagataaggacataagaagaatagggaaagtgctgggattgcaggtgtgagccactgtgtctggtccattattttagagggtactcctactcattaaaaaaaaaaaaaaaaaaactcgtag

SEQ ID NO: 2896 - DNA, 713 bp, Homo sapiens
ggaagaggtgcaagcaaaggttttacgtatgatcaatgtttactttagcggccctggggtgctaacgcctttggatgaccaaggctcaccctgccctccggcaccttttgctgctcttcacccttgccctcaccctgctggctcaggggtgctgtgctgttgccccctcaggctgtgccgaccttgcaggattttgttcactgggccactcctgctgacccttcaccatctgctctgtgaaacctctccgagtggtataggagttggaaacatagtccctggggccagacctttgggtgtaaatccagtctttcctatttctagctgtgaccttgggcaagttgctgagccacttttggtgaccatttcctcctgaaaatgaaactaatgatagtgcctacttcacaggtaaataggagtatgaaatgaattcacatatataaagcttctagagcatctcttctcagtacccaacatcctgattactaatttgcggggggtggcactctctcctctttttctctgctctttgcaggtgctgccaccactaacaataaactatagggaggagaaacccagtcaattccctgaaaagtctccagtgtgaccagaagtacagataatattgttccattgtattaaagtcattctagggagtcttagaagattagatgcatgttggttcctacagaggaaaaaaaaaaaaaaaaaaa

SEQ ID NO: 2897 - DNA, 807 bp, Homo sapiens
  misc_feature (784)..(784): n equals a,t,g, or c
gaattcggcacgagctccttcagaaatgtcttggctattcttgctctttgctcttctctgtaaatttcagcataaacttartttccataatatatgactggaaattttacagaagagttaatgtgtctaactagcaaacacgaagaaaagctcagtgttagcagttaactgagggaatgcaaatcaagaccacaaggagataacaatttgagcctattgacaaaagttcagaagtctaataatactaagtgttggagaggatatggcccagtatgatcttatccactgttggtgggagtatcaattagtacaaacactttgaaaaataagarggaattctataatatctaacatttgcatatatccatttatctctctagatctagatcttagccctctccaccctgcactgtgttcttggaaggggatcatgaatggtttccttgcattctgccttctgatttggttcagccaatgagagaccatggcaagacatttgtgagaagggtagagagtcaggtcaaggttcttagtgagatcaactctttctctgccagtttgttaactgaattctactgaaagctagagctctgttgagtaatcttttaaagctgcagctacccttttgagattaagtaatagctccctgtttgtgccttgttagggctagggatgtttaaggatccttgcccttgctagtcctagcatgttttgttgtcccataatagttctttttttaaactttcctcaattacacaatttgatcttgttcctaccagtaccnttgctggtacaaccttaaactgg

SEQ ID NO: 2898 - DNA, 359 bp, Homo sapiens
  misc_feature (1)..(1): n equals a,t,g, or c
  misc_feature (170)..(170): n equals a,t,g, or c
  misc_feature (359)..(359): n equals a,t,g, or c
ncttatttgtatgtgctacagtggacaggcatctgggacttttccaatctgaagctgttaggaacaccaccaccatgaatattcttgtatgtgttttctggctctggggtggagttgctgggtcatggggcaggcacattttcatttttacttcagtaaaaaatgtccangggggccagccactgtgcctggcccagatgacttcttcacaaggagacacatactgtgtgtatcagtcaggatccaaccaggagacaaaccacacagtaatttaaacagcgattgtttaatatacagaattgttaactatgataggggatttgagtaagaggaactggttactaagaaataaagagaan

SEQ ID NO: 2899 - DNA, 1062 bp, Homo sapiens
  misc_feature (678)..(678): n equals a,t,g, or c
gaattcggcacgaggtttctcctgtccaatggcagtgtcccacatcaggttcataatggcgacatgctaattccacatgggcagagccaatgccaaggcattggtgtagtgttactgggaagagaaagaaaagccatattctcacagtagcagggaagtggtcaaaacagtcaggtgtgtgttgatggatgagcagattttcccagaatttcagaggtaaagaagatcacattgtgtttctattttgttttaatgaaatttttttccttttgttgatgctgttggtgtttccatggttattatcaaaagcagtttctggttttgctgaaaggctagaaatgacaactattttcagagtttctaggtcttgaaacatcagtcaacctttcaaagccagcattgatcaagaaggaaagaggtttttctaatgaggaaaataaaatagtaaatgatactttgacattccattagttgtaggaatgtgtgccccaactgactaccttgctttgctctctctctttccctctcttttctaagttttgctaataataaaacttaggaagtacacatttaggaaactgtctgtccttgtgactgatggcatttatacataaaggttacctggggtgtatggggggaggttcatgaatgcagtttttcttttcttttttctgtgtntatgattccgtatcaaattttaacttctagatgtttatttttttaactgcagtcaaggcacaaaccagtgtaaatcagctgcacaaatgtttgtcataataaatttttattaggttttatattggaagccatttagaaactagtcttataatcactcataaaacattagctatcttattgttttacaagagtatgtagagtatagtaatttcttagtaacatcccaaatccgtctttctccaaacacaatacagcaaagctgtgttttctgtgattcagtaagtcagattgcattttgagtattcatgtagttttccccacccccctgaatcaggaattttcttcccccattattattgttttcttaaaaaaaaaaaaaaaaaa

SEQ ID NO: 2900 - DNA, 753 bp, Homo sapiens
ggcacgagattttgcagcctgctgtgatgctcagattcctaggcaaccaaatgtatgcactttatacctggcttctgctacaaagccctgtctgctccgctgtccttgtgacctcagcccttctctacccttctctcttaaccctgaggcccagccaggcccacgcagcctgcatctatctgccttctgtttctctggtctctctctctgatcctttctagcctctctcaagctgaggcaaacccagccctaagcctcttcactctaatattctgctctagagagtggaagctcaggaagaagcctaaaaactaatttaaagaaaagcaaaacttatactcttcccaccaaagcttccacccttcagtctacgtagatcattgttctgtatccccttgatctatatccttggttgaggaatggaagttctgtggccagcagatagggattccagagctgttcagcttcattattgaaagggaggcacattcatggcttacctcaagatagtgggggaagcaagagcacaagaaattgaagagggaaattagggtgcctaatgtttaaactgtcacaacagttagataatgttgacttccgctgttttctctctggaccacagaattgtttgttaaatggaagcagtgcagtcaaacgttttcaaaagaattgagttcactctaaaaagtactgtttttccccactttctcctgctattcctcagtcactggcactaaaaaaaaaaaaaaaaaa

SEQ ID NO: 2901 - DNA, 879 bp, Homo sapiens
ttttttttttttttttttttttctggttgacaatgagaatatttattggggtttcatgagtgcagggagaagggctggatgacttgggatggggagagagacccctcccctgggatcctgcagctccaggctcccgtgggtggggttagagttgggaacctatgaacattctgtaggggccaccgtcttctccacggtgctcccttcatgcgtgacctggcagctgtagcttctgtgggacttccactgctcgggcgtcaggctcaggtagctgctggccgcgtacttgttgttgctctgtttggagggtgtggtggtctccactcccgccttgacggggctgccatctgccttccaggccactgtcacggctcccgggtagaagtcacttatgagacacaccagtgtggccttgttggcttgaagctcctcagaggagggtgggaacagagtgaccgagggggcagccttgggctgacctaggacggtcagcttggtccctccgccgaacatccaaactgcgaggctgctgtcatatgctgcgcagtaatagtcagcctcgtcctcaggctggagtccagtaatggtcagggaggatgtggctcctgacctggatgcagataatctctctgagatccctgagggccggttattattcctgtaggacaggagtttgggagggtggccctggtgctgctgcagccaagctgctccttggtcgccaacattgttgttgttcccggtgcaggtgagtgtggcggtctgtctcaagtccttggacaccgaggggggctgagtcagccctgcctggaccactgacactgcagagtgagtgaggagggtcaggaggagcagaacccagggcatggtgcagattcc

SEQ ID NO: 2902 - DNA, 500 bp, Homo sapiens
gaattcttttttttttttttttttctcagtacccactacagcattatccttgtctgcaggtttgaggatggatctgctcccagggagggcgagacaagtgcacctaggttgccggaagttgtacgcatcacttctgctggtatctgttagcccaacccaggccacgtggactctcccagatgccagagaccatgagaagaagaagagaaagggcttggagaaggatggaccactcaccatttgctggaataaacaatactgcagtccttgttttaacacttcattttcatcatgccacactgtcggtaactgaataacggccacccacagatgtcagggcttatccctggaacccggaaatggtgtttgcagatgggagtgaaagcaggtctttgyagaagggatcaagttagggatcttgagatgggaagaatttcctggattgtcctgctagacactaaaaaaaaaaaaaaaaaaaaagaattcaaaaagcttctcga

SEQ ID NO: 2903 - DNA, 376 bp, Homo sapiens
atggaaatggagtgytgttatamccmaaccaaaaatgtgtgcatcggcttagcagtcaggtagcagatgatagtgaagctgctaccagaggctggaaaggtggcaattcatgttatgcagcatcaacagatgcaataacctggaaggaagatcttattatacctcctgagcctgtggctctaagggaaatggttggaaagagagtagggtattggaatgtgtttgcagttattgctaaatttggctagcattataataagtggatgagttcaagagaaaactgaccagcttatgaaaataaagaaaaggtaatagagcccagcaatatagggttttgaaatgttacaaaaattaacatcttctacgccccaagggg

SEQ ID NO: 2904 - DNA, 599 bp, Homo sapiens
aattctttttttttttttttttttctgcattgccagggtaaggaaagacaggcagcctacttccaagcaagtgatctgttataggtgggatagtgaaactgtcacttacaacattcttgtagagaatgaacacaagacaacactcatactggcaaagagagaagctttgaggggaggtgtgtgatatattgagtctacctttatccctctttccctatcgaaccaccttcccctcatggtaaagctgggacctaggtatattggtggcaacatttctctgctgctgacctcaaagagactaaaagcatacgtgattgaaatgaaaaataaatgagcagctatttataaataactcctgttaacgaaggcatgtgtttcatggaaataatctcatacaaatgactgctttattttgctccctcctccattcccttgtatccctcctgctacccactaagtggggccagggcaaggctttccttacaggtcccctattttcttaatttttctggtggcaagcagcagaacagagtggtgtcactgggttgcctttagaactttagtcattaaatcaaaaaaaaaaaaaaaaaaaaaaaaag

SEQ ID NO: 2905 - DNA, 921 bp, Homo sapiens
ggcacgagggccgtttgcgtcggaagcctgaagcatgggcgctgagtgggagctgggggccgargctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctggaaggcccttttgtctacttgtctttagtaggaaacgttgcaaattccgatggcttgattgcttctttatggaaagaatatggcaaagctgatgcaagatgggtttattttgatccaaccattgtgtctgtggaaattctgaccgtcgccctggatgggtctctggcattgttcctcatttatgccatagtcaaagaaaaatattaccggcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccaggcacgagccattatctaacttcatgaaccagaatgaatcaaatctttttgtttggccaaaatgtaatacattccagtctacactttgtttttgtattgttgctcctgaacaacctgtttcaaattggttttaaggcgaccagttttcgttgtattgttgttcaattaaatggtgatatagggaaaagagaacaaatttgaatttgtaataataaaatgtttaattataaaaaaaaaaaaaaaaaaaaaaaaa

SEQ ID NO: 2906 - DNA, 2166 bp, Homo sapiens
  misc_feature (1)..(1): n equals a,t,g, or c
  misc_feature (2011)..(2011): n equals a,t,g, or c
  misc_feature (2043)..(2043): n equals a,t,g, or c
  misc_feature (2066)..(2066): n equals a,t,g, or c
  misc_feature (2103)..(2103): n equals a,t,g, or c
  misc_feature (2107)..(2107): n equals a,t,g, or c
  misc_feature (2123)..(2123): n equals a,t,g, or c
  misc_feature (2129)..(2129): n equals a,t,g, or c
naaaggagtcgcacgcgtttcgtcgccccctccctccggtgggcccgggaggtagagaaaaactgccattggatgtccagaatcccctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataatgatcaggaacctccctattcaatgataacattacacgaaatggcagaaacagatgaaggatggttggatgttgtccagtctttaattagagttattccactggaagatccactgggaccagctgttataacattgttactagatgaatgtccattgcccactaaagatgcactccagaaattgactgaaattctcaatttaaatggagaagtagcttgccaggactcaagccatcctgccaaacacaggaacacatctgcagtcctaggctgcttggccgagaaactagcaggtcctgcaagtataggtttacttagcccaggaatactggaatacttgctacagtgtctgaagttacagtcccaccccacagtcatgctttttgcacttatcgcactggaaaagtttgcacagacaagtgaaaataaattgactatttctgaatccagtattagtgaccggcttgtcacattggagtcctgggctaatgatcctgattatctgaaacgtcaagttggtttctgtgcccagtggagcttagacaatctctttttaaaagaaggtagacagctgacctatgagaaagtgaacttgagtagcattagggccatgctgaatagcaatgatgtcagcgagtacctgaagatctcacctcatggcttagaggctcgctgtgatgcctcctcttttgaaagtgtgcgttgcaccttttgtgtggatgccggggtatggtactatgaagtaacagtggtcacttctggcgtcatgcagattggctgggccactcgagacagcaaattcctcaatcatgaaggctacggcattggggatgatgaatactcctgtgcgtatgatggctgccggcagctgatttggtacaatgccagaagtaagcctcacatacacccatgctggaaagaaggagatacagtaggatttctgttagacttgaatgaaaagcaaatgatcttctttttaaatggcaaccagctgcctcctgaaaagcaagtcttttcatctactgtatctggattttttgctgcagctagtttcatgtcatatcaacaatgtgagttcaattttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgaggtagcagacacacaattgaagccatgtggacacagtgacctgtgcatggattgtgccttgcagctggagacctgcccattgtgtcgtaaagaaatagtatctagaatcagacagatttctcatatttcatgacacatgtgaagaggcatcgtggacttttttctactcaattccagccaatgttgaagagaaaaacnaaaaaaaatctctaatcagttgtgcgcacatngaaacttatagccatggccagantttatggctaaaaatgggtagtttgtcaaagacaaanttcngcttaggaatccgaanccaacntggccaaccctggggaaattccggttaagggccaagg

SEQ ID NO: 2907 - DNA, 2166 bp, Homo sapiens; identical to SEQ ID NO: 2906
  misc_feature (1)..(1): n equals a,t,g, or c
  misc_feature (2011)..(2011): n equals a,t,g, or c
  misc_feature (2043)..(2043): n equals a,t,g, or c
  misc_feature (2066)..(2066): n equals a,t,g, or c
  misc_feature (2103)..(2103): n equals a,t,g, or c
  misc_feature (2107)..(2107): n equals a,t,g, or c
  misc_feature (2123)..(2123): n equals a,t,g, or c
  misc_feature (2129)..(2129): n equals a,t,g, or c

SEQ ID NO: 2908 - DNA, 711 bp, Homo sapiens
ctcgtgccgtttggatgtgctccctagaggctgcgcctgacacagggagctgtgtatacatgatttattaaaaggaaatcctcttaggagaaacatattagcaggataaacacaagaaagaatgcagttacaagtggagtctcaatcaatcccagaggaaattctgggacttcagcctcagcttgacctatgggggggctctggaatgtcagatttctcctgatcccaactgtgctctggggcttccattgcagccaagagagagcattccccagaaaactccaggtgaggagtctccagtggcccaagggtgatcctccagaggaggttacactgccgaactgggacattggcaccctggatttgaatatctagagagggcacccaatggtcatactaatgtttgccataacagtctcttctaggtctagacttgaagcatatggaagggtccttgggctagagccaacccaagcccaggctgactcccttttaatacttctaattttccctgaagatctggtcttctccctaccaccactaccctattacataagagaaaaggattggagaatgctcttgaaaagaatgtgatgctttcccatacaaggaatatactcaaggaaaaatttcatggcacaaaatgctgattctgtccaatttatcccatgaataaattgtgtacacatataaaaaaaaaaaaaaaaaaaa

SEQ ID NO: 2909 - DNA, 632 bp, Homo sapiens
  misc_feature (623)..(623): n equals a,t,g, or c
gaattcggcacgagtctaacagcataaagaaataacagctgcattcaagaccaggatatgtaaaataatttgtttagtttcagccactttttaaagtcaattttacaccctgaaagaaaggcaatcctgactccattgttctttcgccaataaggagatcgggaattacaataataaatagaagaaagaatgttgcttttcctcactgtaattaattttatggctcttgcgaagatgaatttttgtggtgattaaaatagtcccttgcacatattaggtactcagtaagcatttgtgaaatagggactttctagcctttatttgtgtttaaggaatcagggaataagttcaaaattgcctttcaagaaatttttggaactctcttctcactaagaaactgtaaagtcttataaaagagacattatttattttctccaagtattgcttgcgaggtgaattgaaggttttttttttatcaacagttgttttataagatcgtttgaggactaaaagggctgattgtaatcacctgtaacatgttacccagcaagacattcctcaccaggttgaagtaaaaaaaaraaatgaagtgagaatatcaagcttatgcaagtttgaaattncaaacaaga

SEQ ID NO: 2910 - DNA, 1066 bp, Homo sapiens
gaattcggcacgagaaaaagcaaaagtaaaataaatattaaggaagaaatgtcaagagtagtctctctcttctttttcattctcttttcctttttcttctttgctttctccttatcgtcttctctttcttttgtacactatgagaaactagtgcaagtgaaagaatgtttggattcatttctcaaaaaaataaaaattaaggaatacaagactagacaatgttatcatttaataaggtgggagaacaatggggccaagttgcaaagttgaacacaggtggaagcatcagcaaagcagagccgtagaagaagtcaagcaactttgtccaaggcagggttttaagctcacattaggcaggtgggggctaagcagagctcctcagagggtcagatgcatttgtagataccttactgctctactgtctcctgttccagaaaatacctatgcatataacattcataaaactttaatatacgtacaaaactagtatcttgactgtagtgctagtttgattcttatgttttgcaattcatattttgtaattgaaaatatgaaagagtgtgtgtatagaagaaagaagagagaaggaaggaaggaaggaagaagaaagagaaaggagagaaagaaaaagagggaaaattgagattaaggttcaagtgattgagtttggcgtctcctcccaagggattttacattggctttggttcaactctgatcttaaattgcaactgcctataaaatgtattttataaattggggcaggggggtataaaatgttattttagcttgtagaattctagtggattggagtgtagttacagatcgaaagaactatagatgggagataatgagaagtggaattaagccatgcaaagtaaaaatctaagaggcagctctatgaaatatgactctactgaacaggtttaggagacagcagctggtgaggcaaactcctgctaggaagaattttctaattctaagctactttcaaatttgatagggctgaaaaatatctctctgaatcaaatgcagacattaaaaaaaaaaaaaaaaaaaaaggccgctc

SEQ ID NO: 2911 - DNA, 1657 bp, Homo sapiens
ggcacgagccatgcccagctaatttttgcatttttagtagagacggggtttcaccatgttgggcaggctggtcttgaacgcctgacctcaggtgatccactctccttggcctccctaagtgctgggattacaggcatgagccaccgcacccggccatgttatttcttatttatgtgtctttgcttatgcttttattttcgctttgtctgtccctaccacacctacaacccccttccttgagggaaatactgattcctgttcattctttaagattcagcttagtgtcacctcttcatggaagtcttgcatcatctcttctacttcagcactgtggcactttgagacaagttttcttttaatcccccttgttttgtgcgtgtgcatgcagaccaaatcttcgtcagcactagatattgtcatttattaaatttaatccttctaatgtgtagcgatatctcattgtggtttttagtatttcactgatgcctaatgttgtgcatcttttcatgtgcttatttgctatccgtgtatcttctttgaagtatctgttcaaatattttggtaatttaaaaaataagattgctttattattttgttttgagagttctttatatattctggagtgtttttttttcagatacgtgttttgcaaatatttattcttaaaccctgacatgtcttttccttcaaatttcaaagagcagaagtcttaacttttcttgaaatttagtttattagtgttttttcttttatggatcatgctttttatgttatatctaagtaatctttgcctaattcaaggccacaaaacttttctctgatgttttcttctgatgttttatagttattggttttatatttaagctcatggtccttgtaagtttactttgtgatgcaaggtatggattgatgtttgtttatttatttttccatatggatataccattgttctagcaccatttgttgaaaaatctgtgctttctctatggttacctttttgttgtaaatctattgaccatgtatgtgggtctatttccagcttctcagttctgttccattgaactatgtgtgtcttctttcattaataccaaactctctggattactgtagttttagtaagtcttgaaatcagatagcgtgcacatctatgtttatacctttttcagaagtgtactggctattttagattgtctttccgtataaattttagaattaacttgatttctgcatggggaaatatacagaagaagaggtaaaagatgacttaagccaagaatgatgaaaaggaagttgatacccattaaaaaagatgaaaatgtacgtatcagaggagaaagaaaacagaaactaaatcaaaaaagtggaaagaaggctgggtgcagtggctcatacctgtaattccagcactttgggaggctgaggtgggcagatcacttgggccaggagttcaagaccagcctgggcaacatggtgaaacccatctctacaaaaaaatacaaagattagctggatggtggtggcgtgcacctgtagtcctcggtactcagacgactgaggtgagaggatcacttgaacccaggaggttgaggctgcaccacactgcactccagcctgggtgataaagtgagacctagtctcaaaaaaaaaaaaaaaaaaa

SEQ ID NO: 2912 - DNA, 789 bp, Homo sapiens
  misc_feature (789)..(789): n equals a,t,g, or c
gaattcggcacgagcttgagtattagctgcgtggttaagctctatcatctgggactgcagggcctaagtttaaaaccttgagtgaaattattctgcttctttaggcctcattattctgaaagactggataggagtggtatttatcccagacggtagctttgaatttggatggagataatgtatgtaaaggcctctgcagtcacggtctccagagatgaggctcttactccctgtcttccagatcctcactggaatgcaccctttgcaagacacctcctccagcccagctgttcctttcttgaattcccatagcacttcactggtatttctttctagcacttaacagttatgtgcctgacatgatggttaaaattttaccttccctttgagactctgagcacctctaggctagggaagggcttggtgcactccgtgtcctctatacttgtgggtaccaaaccgagaagaggatcaatatcacttgaggagctttgaaaaatagattcctttgggaggccgaggtgggccaatcacagggtcaggagattgagaccatcctggctaatgcagtgaagccccgtctctactaaaaatacaaaggattggctggccttggtggcgggcacctgtggtcccagctacttgggaggctgaggcaggagagtggcgtgaacctgggaggcggagcttgcagtgagccgggattgcgccgctgtactccagcctgggcaacagagcgagactccatctcaaaaaaaaaaaaaaaaaatcgaggggggtcccgtaccn

SEQ ID NO: 2913 - DNA, 701 bp, Homo sapiens
  misc_feature (404)..(405): n equals a,t,g, or c
  misc_feature (429)..(429): n equals a,t,g, or c
  misc_feature (546)..(547): n equals a,t,g, or c
ggcacgagtgctcactccctgagcaggtgccgtgggtcttcctgtgaaggctgggggtacgcatgcctcctgactccccgcagagatggaggtggtgctggtgctgctggcctccgcctgtcacctactcttgggaggtcacaccactgttgagggccatgctgcctggagatggccgggttggccctgctgtcctggttaggctgagcagaggagtctctggcagccctttccctgctgggggcagcccccgtgtgccatcctgcgcgtgcatagtgctgacaagtagaaatggttcttcttggtagaaagatgaaatttttttcccttatctccaagaaaatcccctwwtacaaaggaaactcamtttgtttcggggwttaaaattttcagagtttgggccnngcgcggttgctgacggctgtaatncccagcaatttgggaggccgaggcgggtggatcamaaggtcagggatcgagaccatcccggytaacamggtgaaaccccgtytttaytaaaaatgcaaaaaaaaattagccgggagnngtggcggccggtgcctgtagtcccagctactcaggaggctcaggcagaagaatggcttgaacccaagaggcggagcttgcagtgagccgagatcgcgccactgcactccagcgtgggcgacagagcgagactccgtctcaaaaaaaaaaaaaag

SEQ ID NO: 2914 - DNA, 811 bp, Homo sapiens
gaattcggcacgaggggcgatcatgctgagcgagactccacatgccaggagggggagggcatttctcaccgacagtcttcccatggtcattccatccctcctcctgcctcctccaggcagagcctctctggctgagcccactcttagatctgtgaaagggcagcctctcaccctgtcacagcacatggaagaccttgctgtgagcagagagaactgctcccactatagggtccagctttgtcctccagcccctgccccttcagctccacgccttaccctgatggctctttcctgctccagcctcccctgagctgcccctttcatcctatctgccccctcaactaatgcagcacagtctcagtaaggtgatctgtaactctggctcaggggcttctcagggggactgaagagtaacatcacatcccatgaacccactcagggaggggcggggctggtcatcactgagtcctcacttgaaagaaagctgaacttaggccggttgtgctgggcacggtggctcacgcctataatcccaacactttgggaggccgaggcaggtgggtcacctgaggtcaggaattcgagaccagcctggccaacatggtgaaactaaaaatacaaaaaaattagccgagcatggtggcaggcacctgtgatcccagctactcaggagaatcgcttgaacccggaaggtggaggttgcagtaagccgagatcacaccactgcactccagcctgggcgacagagcgagactccatctcaaaaaaaaaaaaaaaaaactcgagggggggcccgtacccaatcgcctat

SEQ ID NO: 2915 - DNA, 359 bp, Homo sapiens
  misc_feature (343)..(343): n equals a,t,g, or c
  misc_feature (347)..(347): n equals a,t,g, or c
  misc_feature (349)..(349): n equals a,t,g, or c
ctcgtgccgaattcggcacgagagatggtacttttaagaggtaattaggttgctaagatggattaacatctttctcttgacactgagactgggttctcctgggaatggttagttcccaagagagtgagttgttataaaacaatgctgcctcttctattttgcgctttttgtttgcacaaactcggtccccttctgtttctctacgatgttttgatgcrgcatgaggcagtcatgagaacccaccagatacagctgcctgatcctgaatttcccagccaacagaaccaagtgctaaataaaactctttttaataagttaaaaaaaaaaaaaaaaaaaaaaaaanaaananaaaaaaaaaa

SEQ ID NO: 2916 - DNA, 2566 bp, Homo sapiens
  misc_feature (22)..(22): n equals a,t,g, or c
cccaagaattcggcacgagcgnggcawaaktgggatttctgaaacctgtaggccccaagcccatcaacttgcccaaagaagattccaaacctacatttccctggcctsctggaaacaagccatctcttcacagtgtaaaccaagaccatgacttaaagccactaggccgaaatctgggcctactcctccaacctcagaaaatgaacagaagcaagcktttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggctccacactacaggttcaagagaagagtaatacgtggtcctgggggattttgaagatgttaaagggaaaagatgacagaaagaaaagtatacgagagaaacctaaagtctctgactcagacaataatgaaggttcatctttccctgctcctcctaaacaattggacatgggagatgaagtttacgatgatgtggatacctctgatttccctgtttcatcagcagagatgagtcaaggaactaatgttggaaaagctaagacagaagaaaaggaccttaagaagctaaaaaagcagraaaaaraaraaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcattctgctgtgttcattaggtgccaatgtgaagtctggattttaattggcatgttattgggtatcaagaaaattaatgcacaaaaccacttattatcatttgttatgaaatcccaattatctttacaaagtgtttaaagtttgaacatagaaaataatctctctgcttaattgttatctcagaagactacattagtgagatgtaagaattattaaatattccatttccgctttggctacaattatgaagaagttgaaggtacttcttttagaccaccagtaaataatcctccttcaaaaaataaaaataaaaaaaaaaaaaaaaaactcgagggggggcccggtacccaat

SEQ ID NO: 2917 - DNA, 540 bp, Homo sapiens
gaattcggcacgaggctttctgtgtcctctgtggctgctttagtgtgccaccaggggcagacttgggtgggttgcagcagagatggcatggccctcaaggtccaagatgtttactctcttgccggtcctctgttatctctggtctttgtggttgccacagttttcttggatccaggagttaaaggcagtcctgagggatgatggcctcatctccgcagttgcytggaatgctgaatttcagacgtgctaaaggagggttgcagacattgtgtggwatgcattcagaccccagatgtgggtgcaggaaggcaggcatggcacagccaggtagagactggtttccaggcccaagcagccttcagcagctgtgcgccttgtttctgatgttgtttgggagtaagaataatgtagacatggggggtcatgargctcaataaaaacttcaaggaaacctcccatggcatggttgggcgcagtgactcatgcctgtaaccccagcactgtggaatgccaaggtggaaggatcgcttgaggccaaga

SEQ ID NO: 2918 - DNA, 1358 bp, Homo sapiens
ggcacgaggataaattgcaagtattaatcggtcccaactttaatatgggataaaaataacagtcagtatgtgacctcctaaacaatccctctactgagctgtggaggggagaagggaggtcctggggccaggacagacagggctattttcagtagtacaacttatatgctactctaagaaaagtccagaaaatgcrattctcttcatacgaagtcttarataccctcatkatttrgataaatacattttcarrtctaatatggagacagaaagctgcctagatttatacccacaagtattataaatttagagagtctgaccagcctcaattatttctcttcgaagtgggagagagaaatcaaaagtcagaaatggtggrtaatctccaagtcatatccatttggstttgrtctactacttgtttttatgcttgtatttggrgrcaaggrtgcctgatgttaagggratttcmtacmttgaataatgtgaccagactgccatctagtcaaaaacctataaaatgttatttactttaattctgggctaattcaacagaagtyyysgataaaarctctccaaacaataattatgarccttagttttttgttttgttttggatacaaaacaaaacagctctgtagttgttctgtgaggtttataaatagatttttttaactacttaattttcyggtttcygccyctgkgtttyctgtacctatagaggtagctcttttcagttaagtagagaaaagctcttcccctgggttgaaaataatgcagtcccgagaggctacttaactctacctttctggaggtcatggtagcaattggagatctcccaggcattctaaggggagctactaaagagccccagatactcaatttaccactagaaattcgcttcatctactctctgtcatctggggagraaagtattataactgacattcagtatgcacacaataagtgcataataaagagctattgaggggatccaagggagtaaaatgggtttgcccataggactccatcagggtccaccaacacagacttacagcaaaaattggaaggctcttttctgctggattctgggaatctgtgttctctagtgtgccagggagagttggaatcaaaacacgtaatataatgtttctattcagagccccatttttttgccaaataaagtagcactgtcaaataataaatcttgtattcacttgggcatgtatgtttattattggatctctaaaatatgcttcaaataatgcactgaaataagtgaggtgatgaattttgaaataataacagtttatgatgggtagctccaaaatttttaaaaaaaaaaaaaaaaaactcga

SEQ ID NO: 2919 - DNA, 714 bp, Homo sapiens
gaattcggcacgagtgaccttgtacccttcgttaaaatagagaataatcattttgtgtttctctgtaggcattctctggctgtaggaatgcactcctccgcagaaaccctgctttgctggcccttatttgttggagttgcagttggsgggcagggagcaagcagtaagagytccagcytytggacactatccagagcctgacctaggcacctacttgcaccatcctgccctgatgcacttgggttgagagagggttgcgtgtgtgtgtgtgtgtgtagagaatatgtgtggtatgtgtactgggagaggtgtcccagacctctgccagctgtggcctaattgggagaaagaggccagtggggcacctcccttctgatctggagcttcttggcctaaccttaagctactgatcagtcccatcacttcagggcaaggtgtaccagggccatggttgctaacactagctgtaccaggtcgctcaccttcaggtctgcctgcccttggccctgagtcatggacaggagtgttatgttgtcttttctcttataaaatgtaaataatggctgggcacggtggctcacgcctataatcccagcactttgggaggccaaggtgggtggatcacaaggtcaggagatcaagaccatcctggctaacacggcgaaamcccatctytactaarratacaaaaaattagccaggcgtggtggcatg

SEQ ID NO: 2920 - DNA, 850 bp, Homo sapiens
gggcaaacattgtctacaagtaataaatgctttgcataaatgtgcagacacacgtgtatgaatgtgctatgcaaatacccttccttttagaagtatttgttattcatacaggtgttttaggaagtaaattgcttaaatctggtggtctttttgatttaacatccttttcaccaatgataatttgctttagtaataaaagttagtctcttgttgttactggaatattgttaattcatcaaaaaaatcaaaagcctatcatgacaggaattattctaataactctctaaaaggataatcataataataaattaactagcaaagtgacaatccctttccttaaggtgtttatggcctggtagtgaaaagagaaacctgaagcaattaccccataattacgaggaatacagaataatcactataatggatgaatggatggatgatgcagagaagcaatgcaatgattaggcttaaggaaatcagggacaacttcacaaaggaaggactgtttaaggagaggcttaaagaatggaggccaggtgcagtstctcacgcctgtaatcctagcactttgggaggctgaggcaggtgaatcacctgaggttaggagttcaagaccagcctagccaacatggtgaaaccctgtctctattaaaaatacaaaaattagccgggcatggtggcaggcatctgtagaatcccagctacctgggaggctgaggcaggagaatcccttgaacccgggagacagaagttgcagcgagccacgtttgcaccactgcactccagcctgggcaacagagtgagactctgtcttaaaaaaaagaaaaaaaaaaaaaaaaaaaaactcgta

SEQ ID NO: 2921 - DNA, 3735 bp, Homo sapiens
  misc_feature (110)..(110): n equals a,t,g, or c
  misc_feature (3690)..(3690): n equals a,t,g, or c
  misc_feature (3716)..(3716): n equals a,t,g, or c
ctgctgttcgctggctgggctccgcagcaggcttggccagcsgctgacgggtcggcgggcgggtttgtgtgaacaggcacgcagctgcagattttattctggtagtgcanccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccgtgtttaatgcctgagtactttgaacctcagatcaaagacataagtgaagccgccctgaaggaacgaattgagctcagaaaagtcaaagcctctgtggacatgtttgatcagcttttgcaagcaggaaccactgtgtctcttgaaacaacaaatagtctcttggatttwttgtgttactatggtgaccaggagccctcaactgattaccattttcaacaaactggacagtcagaagcattggaagaggaaaatgatgagacatctaggaggaaagctggtcatcagtttggagttacatggcgagcaaaaaacaacgctgagagaatcttttctctaatgccagagaaaaatgaacattcctattgcacaatgatccgaggaatggtgaagcaccgagcttatgagcaggcattaaacttgtacactgagttactaaacaacagactccatgctgatgtatacacatttaatgcattgattgaagcaacagtatgtgcgataaatgagaaatttgaggaaaaatggagtaaaatactggagctgctaagacacatggttgcacagaaggtgaaaccaaatcttcagacttttaataccattctgaaatgtctccgaagatttcatgtgtttgcaagatcgccagccttacaggttttacgtgaaatgaaagccattggaatagaaccctcgcttgcaacatatcaccatattattcgcctgtttgatcaacctggagaccctttaaagagatcatccttcatcatttatgatataatgaatgaattaatgggaaagagattttctccaaaggacccggatgatgataagttttttcagtcagccatgagcatatgctcatctctcagagatctagaacttgcctaccaagtacatggccttttaaaaaccggagacaactggaaattcattggacctgatcaacatcgtaatttctattattccaagttcttcgatttgatttgtctaatggaacaaattgatgttaccttgaagtggtatgaggacctgataccttcagcctactttccccactcccaaacaatgatacatcttctccaagcattggatgtggccaatcggctagaagtgattcctaaaatttggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctggaaaatgttggggcttttcaggaagcataataagattcctagaagtgagttgctgaatgagcttatggacagtgcaaaagtgtctaacagcccttcccaggccattgaagtagtagagctggcaagtgccttcagcttacctatttgtgagggcctcacccagagagtaatgagtgattttgcaatcaaccaggaacaaaaggaagccctaagtaatctaactgcattgaccagtgacagtgatactgacagcagcagtgacagcgacagtgacaccagtgaaggcaaatgaaagtggagattcaggagcagcaatggtctcaccatagctgctggaatcacacctgagaactgagatataccaatatttaacattgttacaaagaagaaaagatacagatttggtgaatttgttactgtgaggtacagtcagtacacagctgacttatgtagatttaagctgctaatatgctacttaaccatctattaatgcaccattaaaggcttagcatttaagtagcaacattgcggttttcagacacatggtgaggtccatggctcttgtcatcaggataagcctgcacacctagagtgtcggtgagctgacctcacgatgctgtcctcgtgcgattgccctctcctgctgctggacttctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttgtaattagtgtacacgtttgtatttttgttaatatagccgctgccatagttttctaacttgaacagccatgaatgtttcatgtctcccttttttttttgtctatagctgttacctattttagtggttgaaatgagagctagtgatgacagaaggatgtggaatgtcttcttgacatcattgtgtattgctggtaatcaagttggtaacgactacttctagcagctcttaccactatgacttaagtggtcctggaaggcagtaagtggaggtttgcagcattcctgccttcatgagggcttctaccactgaccactttgcacgtacctggctcccagatttacttaggtaccccacgagtcgtccacataagcagcttcatctttaccttgccagagttgacaattatgggatactctagtctacttatacttgtgttcccatctgtctgccatcctctgaaggccaggacccagtcatacatccttagaaaccaaagtatggtttttgttttctcttggaatgtcaggtcttaaggcatttaattgagggacaaaaaaaaaaaaaagccgatatagtagctagctacttaagcatccatgggtattgctccatatcaaagcagatttgcaggacagaaagagtaaattagccttcagtcttggtttacagcttccaaggagagccttggccacctgaaatgttaactcggtcccttcctgtctctagttcatcagcacctgcagatgcctgactcttgttagccttactattcaatacagtccttagattcacggtatgcctcttcctatccaggcacctattctgaatcaccatgttgctctgcagctagagttgataggagaaaatccatttgggtagatggcctatgaatttgtagtagactttcaaaatgagtgatttgttagcttggtacttttaagtttgtggtacagatcctccaaacccatactctgagcaattaactgccttgaacatagagaaaattaaggcctcacaggatgagtctccattctctgtaaatgcttattttatcatagtctttagccnctactatgagtaaaatgttctcttcngccgggtgtggtgactcac

SEQ ID NO: 2922 - DNA, 654 bp, Homo sapiens
gccaacataagcacacttaacctagacttcaatatgcagtagacgcataaataaacaaatcaatgggtgaatgcttattacttttttccttaagcaactctcctcatattttgtttgcttgttcttcattktctaggagaatgtggattatattattcaggagctccgaagacccaaatacactatatatttcatttgtaagtatgttagttcactttttcaaacatgtaacaacatcccagttagtgtgtttcattgagcccttcatatcatcaataacttcatkgaatctgtcactataaaagtctagtttatttaatgtccttccaaagtattaaaaatcttttgacctgccgggcgcggtggctcacacctgtaatcccagcactttggggggccagggcgggcggatcatctgaggagtttgagaccagcctgaccaacatggtgaaaccccatctctactaaaaatacaagattagctgggcatggtggcacatgcctgtaatcccagctacttgggaggctgaggtcaggagaatcgcttgaaccggagaggcggagattgcagtgagccgagattgcgtccattgcactccagcctgggcaacaaagcgaaactccatctcaaaaaaaaaaaaaaaaaaactcgta

SEQ ID NO: 2923 - DNA, 688 bp, Homo sapiens
  misc_feature (1)..(1): n equals a,t,g, or c
nccaatactcctttactttctttgagttacaatgttgcatctattctgttcacagcccctagggctccttttcctgctgatctttctaggtcttgactctctgcctcgttgcttgaccgctacccggcttcagagtccaataaattatattttcaactttgtcctgtgatatgctccacttcttggctgggaactctgttcagtttatttcctgactttgaactatctccacgtagtgccaccttgtttcctgatctaaggactgtgcaactcctctccagtcggccacatctctgaccaagggattcagtgaaaactctggtttctcacctgaactttgatctttaaccccagctgacactagtaatggcctttgtgatcaggctctgaaagaagactgacttcatgtgaaccatgtgagcatattgttcatatatccctcaaggtggattccttcttttctaaaaggcatctaaaaagcaacggaagttcttttgaaaatcagaggctgcctttttggtagcagttctttcatttattctgtagaggatccagattgagctctttataaaatattctcctacataatgtactgggatagtcctaacaatagtaaaccttgatccacagatcacatgtgccattggataaaaataaataatgcagaggaactcaataagaccagcct

SEQ ID NO: 2924 - DNA, 1389 bp, Homo sapiens
  misc_feature (755)..(755): n equals a,t,g, or c
  misc_feature (1177)..(1177): n equals a,t,g, or c
gcttttttaggcattcattggacacttgctttaataagaatagtttcttagttggcataatgcttctgaagtaatggtactttaaaataatttatctcatgaactttaagcattcctcttgaaatcttgtttttactctatctagtcagcccttataggcaatccaaagggatgctttggatgctttagtccagtggttctcagagagtggtctgtggagtcctggaagtcgctgagaccctttcaggcaatttgcaagctcaaaactaatttcagaatgacaccaggatgttctgtgccttttttgctgtgttggctatttgcactgatgatgcaagagaaatggggaggagtaaaatcactggtgtcttaccactattcaagacagtggcaccaaactgtagtagtctagtaggcattgtatcctgcacagcctcccgccaggagtgtgatggaagaccaaggaagcagtgtaaatggaggtacacgggaagcacttcctttgcaccgtgaaggatgatgactgttttaaggaaaagcacttatgccatggtttgtgtcgtgagctgaaccagctgcctttttcatggaacatgacttttacttgaaagagtaactgacagaaaaccaattattctgacttgtgtttgtagcagacattttcttgaaaatgaagaagtgggtctgtgacttcaggaaaatgtctgacagtatctgttgccaaagaaaatgtgagttttcaagccaagaatagnaatctagaaaacttgtattcmcctccatgggcttgatgmcctcttagtacttagacctttctgacgagataagcggtggcattaacaaatgtgacgtttttcatgttatctaaatacatttgtcaacatttrraagatctgcacaactccctggaccaggatttyccaaatgattgttgctttttgttacaaaatcagggaatagatagaagattcattcaaataatgaaagatagactgatggatttttatgtaacagaataggaaaagtttatgacatgttttcagattccaccttgcaactaatttttaagaagctaccacttgtcagccaggcacagtgctcacgcctataatcccaacactttgggagtccaaggtgggcagatcacttgaggtcaggagttcaagcctggccaacntggtgaaagacttctctactaaaactacaaaaattagctgggcatggtggtgggtacctgtaatcccagctactctggaggctgaggcaggagaattgcctgagcctgggaggcagaggttgcagtgagccaagatcgcgccactgcacaccagcctgggcaacaagtgcgaaactctgtctcaaaaaaaaaaaaaaaaaaaaaaactcgag

SEQ ID NO: 2925 - DNA, 1040 bp, Homo sapiens
ggcacgaggtgaatccccagcctgaggtcgtgcttaagtgccacctgctcaagagagaaggcttcctgcccgcgcccatgatgtaagtccccccagatgctttccaccatcctgtcctttgtctgtaattgcgcttgtcgcttgaacagaatcctaattgtgctgattacatgtttaattttggtctcccctgtaagacaggcatgctttttggaggcagggactgaatgtcattcacatctgtgctcctagggtctaatacatgatggtgcattgtaagtattcagtatataacttgttgaataaatggatcgggtttagcattttcccccattggacctggattgacctggaaattggtggactgaacctgcaagtagagattaaaggacctaacaactgtagagtggctggtgaaggtagatataagtgcagtaagggagggagtcgttgatgtkgttttggttcgtagtgcagaataaagctacttatggaaatatacgactcctactcttagtttctgctttgatgtggtwackgctgttgtttagcgtaagcatataaacaaatcactggcttagtgggttaatttttcttctcttttgttaaacagctgagtttttgctgttttcaaagttagccaaaaattccattttcatgtttaaatgatttagaaaaatcatttttctttaaaaaataacagtacataaaaagaaaacattctcggctgggcgcggtggctcacgcctgtaacccagcactttgggaggctgagacaggcagttcacctgaggtcaggagtttgagaccagcctgaccaacatggagaaactccgtctctactaaaaacacaaaaattttagccgggcgttgtgccacgttcctgtaatcccagctactcgggaggctgaggcaggagaatcgcttgaacccgggaggcagaggttgcagtgagccgagatcgtgtcattgcactccagcctgggcaacaagagcgaaactccatctcaaaaaataaaaaaaaaaaaaaaaaactcgta

SEQ ID NO: 2926 - DNA, 782 bp, Homo sapiens
ggcacgaggtttattccctgtcacccaccttatcccactgtcttattcttagagttgtctttcagaaacccaaatacagatcatgtcacagatactgagaagttccttattgccttgataaggtgatacataaaaccttagaatggctttcagggttctttactattccgtctggtttatctttttacacgtgtcatttgccactccaaaagttacaggactaattgcctcaacataccattttctttatgtcttcatgtttctgctcatgatcctttctgcctaatgcttttccacatcttccatttccgctttgaggaactcctttttctttcttcaagatacaatgcttgcagtcttaatcttccatgacagtgctctcatagtttagtttaacctctgcaataggatatacctcatgattactacaatttatatgtgtttccttttaccaaactcttaggaaaaaggagagcctgggccgggtggggtggctcacgcctgtagtcccagcacttggggaggccgaggcggaggatcacaaggtcaggagattgagaccagcctggccaacatagtgaaaccccgtctctcctaaaaacacaaaaatcagctgggtgtggtggcgcgcgcagctgtaatcccagctactcaggaggctgaagycaggagaatcgcttgaaccccggaggcggggattgcagtgagccaggatggcgccactgcactccagcttggtgacagcgagatccgtcttaaaaaaaaaaaaaaaaaactcgtag

SEQ ID NO: 2927 - DNA, 1063 bp, Homo sapiens
  misc_feature (965)..(965): n equals a,t,g, or c
ggcagaggcataactctgcttatttaaggtggtttggtttgtgccaagctaaaggagggaatattgattgaattacttttttaaaatgcaattaatttttatttaattgttttccctggagttgtggggttgaggtattgcagtttaaagcagtttggatgtgctgataatttttttctgattatcttcaagtctccatggacagtgtcactgcaggtctattcatgctttcgttcctcctttacctgccttcatctgctttctctgggcattggtacccatacccaggtgtggtcagttggagtaactcctgccttgctgggcttaactgtggtgtttctgggcctaaggcaattggaacatctgtagtttatttcctaatcccaattttgtggaggtttgtgttctagctttgattcaattactcctaagtagtggcccgtattaagtagaggctgtgtgagacaagacacttaatgtagccccttggagctgctgggtccttttcatcagaatttggctaatgatgcctctctcttttttacacactaagcctaatataactagtaatgaacctcattaataatttgtattggcagatgtgaggtgtcacacattaaaactgttttacaccatgagcattgacttcattcggtcagtgagggaggatgcaaccacctttgccaaaataggaaggaagagaagacccagagttttcagggaacggaattaaatagcactttaacaagcttggcggaggcagtggggtgaggagaggaagttaataggcctagggaggagagtatctcactggtttctccaagctgattcttctgggtgccaagagagctgtggaaacccacagaggaatgccccggttcctttccttccttctttctggtaagggtttagatctatttatttgatggtcagccttccagttttatcagcaccggtctctttgnacaacttcccaaatgtacaaactccagacagatgagtacagttggtgttttccggggagggtgttgctccctgtggtctgtcacagccagagagcagg

SEQ ID NO: 2928 - DNA, 690 bp, Homo sapiens
gaattcggcacgagagcagggctaggtggacatgaggagcccagttcagggctgtcacagtagctccagcagcagatgattgtggctgggcctcccaagtgtcacgttggagaaccggagaaggggacttctttgggatgtactctggacttgttgatagattaagtgtaggtggggtgaggaagagaactcaaagatgacaccaggtgttggagctgagccacggggagaagggtgcaaagggaaagcagtgcgggggctgggaggggagagggtcagtcctgttttgcttgtgctgcatctgaggagcccctcacctgtggaaggagagcagtcccagaggcagtggggtgtgcagttctggaacttagaagaatgatcagggggctgggtgcagtggctcacgcctgtaatcccagcactttgggaggccgaggcgggcggatcaagaggtcaggagattgagaccatcctggctaacatggtgaaaccccgtctctactaaaaatataaaaaattagcagcgcatggtggcaggcacctgtagtcccagctattcaggaggctgaggcaggagagtggcgtgaacccgggagacggagcttgcagtgagctgagattgcgccactgcactccagcctgggcgacagagcgaactccgtctcaaaaaaaaaaaaaaaaaaaactcga

SEQ ID NO: 2929 - DNA, 1247 bp, Homo sapiens
gcgagttcatctaactatgtgctccacgagggatctctccttgagacttgacagttgatttgcagacagaagtatgccctcatggaactctcacctccaggggttccccttagacctcacatccattaggagggggtgtggaaaggatgcccacgtggccacttttacaactgctgtcctgctcatttccttccctactttgtgaaacgttcactttctgctccaaagatgaagtgtcacgttggaaggcgggatgctttgtgccccttccagcaagctaacttccaaataaattctctawttttatatcagaccttgttcttgttaattagactttacatgaagtgagcaactaagcttttctgttacaagacttcatgcccacagatacattcaagtcccaggtggaaggatgatctggattaggcaaggtgctgaccatgggaacaggagacagtcaagggaatctgaggaagcacatgtttgtgtccaatatagtcccctccttgtgccactcagatgtgctcatgccctccaactgtggctggttttataagcagatgccttgtgtagttgcacggggtcttgtgcttgaggggctttttgcttggattaatgttctgcacttgcatttttatttttcagacagcggatactcctccactgaagagggaatagttctgcagtaattccctaggggtttgctttctcctctcctacgggcttgatggagacaggcacagagtcctgtgatgcccacgtkgcatgcctctagcagctttgaattctgctggatcatctggcacaatgggccgagcaggttgggccagaccctgtatctgctgtagagatattatatgttctggattccacttgaaaccaggagtctttgcattcattctgtaacccatctggttttggcagaggctaggtaggttaactgaacagggatttaaaaaggactttattaacacatcagagcaatatcctctactgtggtatttttggactccaaaatccctagaggctcaataaacgccgtgcttctcttttagtgataggaagtatataggaagccatttaccttaaacaggatgtttctgctcggcatggtggttcacgcctgtaataccagcactttgggagaccaacgcaggcagatcactggaggccaggagtttgagactagcctgagcaacatggtgaaaccccatctctacttaaaaaaaaaaaaaaaaaactcgtag

SEQ ID NO: 2930 - DNA, 1035 bp, Homo sapiens
  misc_feature (522)..(522): n equals a,t,g, or c
gcagttttccagcaccattcgttgaagagactgttctttccctgttgaacgatcttggcagccttgtctaaaaaagattaaccataaatgcgagggttcacctctggactctcaagtctgttccactgatgtgtatgactgtctttattgttttctattattcttttatgagattgttattcaggtgcagccacaataggagacactggagaggctcaggaaaaaacacagtttatcacacaggtcctagagacgaggcatgctgtgccatgccatgctgggccacttggggaagacgctagggtggttaggaggagggaargattaggctactgccttcatcgaggtttccttagggtagggcagggcgaacagtttagtttgaataattttggcatactttagactggcggggtggtctcgttgcctggcacctggctctgggatgataggtagaggagtagtgcctcttggggtataagggccagatagaggagatatggctctggattttgaatagcntgscatattaaagacatactcctagctgggcccyttgttatctttaagaattggctagaccttggagggacagtttctcaaatagctagaaaggttctttaacatgttaaacatcagtatacaagaaaagctaaaagtccatctgtgccagtgccatactgtctkgcttactgtagcagtgtggtaagttttgaaattaggaagtgtgagccgggcgcggtggctcacgcctgtaatcccagcactttgggaggctgaggtgggtggatcacgaggtcaagagatcaagaccatcctggccaacatggtgaaaccccatctctactaaaaatacaaaaattagctggcgtggtggcaggcatctacactcccagctgctcgggaggctgaggtcaggagaatcacttgaacccaggaggcggagtttgcagtgagtccgagattgagccactacactccagcgtggcgacagagcgagatccgtctcaaaaaaaaaaaaaaaaaaaactcgta

SEQ ID NO: 2931 - DNA, 710 bp, Homo sapiens
gaattcggcacaggtttcaccatgttggccaggctggtctcaaactcctgaccgcagkgatcccaaagtgctgggattacaggtatgarcctcccaaagtgctgggattacaggcatgagccactgtccccagcaggattatcttactatattgtgccacagaatattttattagcgtttgattggaattacatagaattataaatttggtatttgtgactttctgctggaaatcatgataccatgaacattctgatgtttgcgtttatgataattttcatgggagctaaatttcaagaagtagaattttgggtcagaggatatgatcatttaaaagcaacattgtttgatcagattggcagatacttaaagatgggtggacaggagccattgctggcaaaggtttgggtaaggggcacttgagtatgctgctagtgacagggaattctacgcatttgtgcatagaatctgggaatgactattaagatttatttattccctctctaggtaaaatccctctctaggtatataaataaataataaataataaataaataatcagtttcagccaggcacaatggctcacacctgtaatcccagcactttgggaggccaaggccgatggatcacttgaggtcaaggagtttgagaccagtctggccaacgtggtgaaaccccatctctactaaaaaaaaaaaaaaaaaactcga

SEQ ID NO: 2932 - DNA, 1750 bp, Homo sapiens
  misc_feature (24)..(24): n equals a,t,g, or c
  misc_feature (34)..(34): n equals a,t,g, or c
  misc_feature (1287)..(1287): n equals a,t,g, or c
  misc_feature (1392)..(1392): n equals a,t,g, or c
agaaagtgaaagctgtttgcaatnatataaattnctaatttggaaatcatgacaagcagtcttaagaacaaagttaaaattaaaaagtctttatccaagtcaccaatgaaacaggattctgattcattaatcatgtcttgcccacttttttcaacaaacctgacgtcctataatgagctatacagtgtgaggcatatttcatagcaacgttggttgattgccaaggagactctgccaccgttctggataagctcatgtttcccttttccttggctgctaatagaagggcaacttacagtgcagggtcaagagcaagaagctgggggagtagaggctatacatctagcctaataatagagatctgaggtggtyaccaggagactacgttcttttgattccattcctcagcagcaaaagtacttgagttcaaatgataaaacttgaagttgtaggcttggaagagtatcagctcagtatatccttccttgcataaatacaagggaaaggccaaggaataatcagcattaacctgccaggtccaagggtcttctatccctgacttcatctgagtcacaagatttctctaataagagaaactttgctactctgaggaaaattatcccttatgggagcccccagttcagaggtaagaacagttctttcacgtggaggtccaaaattctggacttctagaaacaagtgaagtgtgctaaagtctcctatttattgtttctcttccagtattgtgccatcgattcttgcataaaattctggaatgctggctcttcatggctttcctctgtaactctgtggtcaatgtcatcagtatcgctgtctgcttcctcatcctcttcatccaaggttcctcgagtcaggatcaaatcagaagggtgcagcacaggagataagctgtctttggcagtccctgcatccaaggctacagaacccatatcttttcgaaggcgttccagttgttctctctgctgttggctctctgcgttggccagtgattttttcagacgttcatattcaggacgatactccctttcatattcttcggcagcactggtaacttgcacaaagagttcatctaatccagtacccagaacagcagagacacccaccaccctgagtgagctgtaaaactcatctaacaccaggctcattgaacgagtcaggttatgacgtatgtagtctcttgattcaaggcatcttggaaagcctyaaaatcctgcatccattccactgcaaagctgtggtcaatgatgtcagttttattcatgcccncaatgaaagccagcttggttttgtataagatgctgcaggcatagagcatgttgcacatgaaggtcactgggttggtacttctcgatgtgtccattacatagatgncaactgttggaaatgaggatgcaagggcttcagtgataattgtcccagaagctgaccaggtgaatacctcaatctgtccaggtgtgtcaatcaacacatatttggacatgttctgggccttctcaataaatttcatcaccaatattggcaggaaagggaacttcatgtactgctggatccaggttgatcacatacggtggagtgccttgggcatgcaggtgtcctgtgagcctctgtacaaaagtggttttcccggatcccgccattcccaacaccaacagacacactgggtgccgcggacccccagaagcctggagctcagcggcagctgcggacgccgccatcttcctcctggcaa

SEQ ID NO: 2933 - DNA, 896 bp, Homo sapiens
  misc_feature (401)..(401): n equals a,t,g, or c
gaattcggcacgagaaattgagaaacattaatacaaagtaagagacaagagcctagtaacaaatggtggctctttgagaaaaggaaattattaccaaaattttagactaactgaaggcatgccaattaagcaccagattttgctcttaaacttttttggaagctgagtagaaattatccttttgttccatatgatgacttattaaataaaatactttgcacaatatgtgcttttagatggagtaaacaacataccttttaaataattattttgattgcctatattcatatcatgatgctaccttttkgcatttgtgcagtgtacatkgaatattaactgagtgtttagaaatgctggattttaggtttcagctttgctgtgggtgaagggaagtggggggncttctgtttgttggtgccaggcattatgctacatattatacatctgttatctcatttgattyccccaaatccttaagaagttgaattattatactcattttggaaataagaaatgaagcttagagaggggaagaacaggtttaaatcctggctgtaagccctttgggctttggttttcctaactagggaagaggaataatagtgatgaaaataacaatcatctgatgatctttgtaattttactgacggagtagaagccatcagaagagaatgcccacatcttccctttgatagagcatctgacttgcatctccttagtaactactttccctcccattctaaactgttcttttctaggggccaacctctcctcttgtgaacgagctctcatcctttcctggatacacagcttcttctttcctgcatacttttttctttgtacagcatgaaaatatactattgtgtcttgtttaaaaaaaaaaaaaaaaaactcga

SEQ ID NO: 2934 - DNA, 866 bp, Homo sapiens
  misc_feature (22)..(22): n equals a,t,g, or c
  misc_feature (37)..(37): n equals a,t,g, or c
tccacgtaaatgggaacaaaancatggaccaccaccngcaagtggcggccgctctagaactagtggatcccccgggctgcaggaattcggcacgaggtaatatgagtcttccagcttcattctttttcaaaattgctttggtttttctacacgttttttctgtgaactttagaatcagcttgtcagtgtctacaagccctctgggattttgactggaattgcattgaatgtatgaaacaatctggaggacagctgacattttaacaatactgagtcttctgattcacacacccataggtcagtgatgggagcaaggctcaggctaaagcagattcagggtgtctttctgtgtggaacgtttaggaaaagtatgtttgcatgccactgtctcctgaccaaacccttcgcttttttgtcttctagtatctttatgtatccttatagattattataggcagtaatgattaatgatgagatattaaaacgcctttgttcttttgatttaaggagagggcaagtattgaggattttccctcttgcttttgtattcagggccgggcgctggtkgctcacgcctgtaatcccagcactttgagaagccgaggcgggcatatcacgaggtcaagagatcgagaccatcctggccaacattgtgaaacctcatctctactaaaaatacaaaaattaactggccctggtggtgtgcgcctgtgatcccagctactcaggaggctgaggcaggagaatcgcttgaacccgggaggcagaggttgcagtgagccgagatcgtgccactgcactccagcytgggccacagaaagagactccgtctcaaaaaaaaaaaaaaaaaaaaaaaaaaaactcga

SEQ ID NO: 2935 - DNA, 655 bp, Homo sapiens
gtctgttgtttactaaaatgaaaattcagttgaaaatgccactaattcagaaattagtaaatcctatttattatgtattttaccaattaatagaatacaaaggtatcatatacaactaccatggaggtggcaggaagaagattgactttttcaaatggtcttcatactggaacagattaaaaaccaagtcttctttcttttcctcctgttaaaactcacttgtgtctcacattaagctcctaaatgtgccctctgtttccctaggccagagccagtgtctaacaagtaatgcatttggagggtcatggcccaacagtctacattcagccaggatttaggaacttcattccaatgatctttgaaggacttgtacaactctagccagcctttgaagggagtattttgggaactgggaagagatctttctagtcctcccatggagacagcaaggttatggtgaagtttggaatcagataaaactaatggaggcattacatctctaatctaaaatgaggattatagtctaggtgtggtggcacacacctgtaatcccatcactttgggaggccaaggccagaggattgcttgtccaaggagttggggaccagcctgggcaacatacagatgcaaaaaaaaaaaaaaaaaaaaactcgta

SEQ ID NO: 2936 - DNA, 651 bp, Homo sapiens
gaattcggcacgagctatagtctcctcgtattttcatattttcatagctaaattgttaaagaggcgatggcagtgtactcatcaggagacttgttcttgcctcgaacattaaaagcccaatttaagactggagaatttcttctttgagggttttgtccacccatcataagagatttcaaactatgtaatgagtcattttacttttccccttttcttatggggacagcttctctttaatacaccgtgtggtctgccctcttggaggttgtgtcaccattatcagtagacaaatgctgccatgtgtaaaaggctatgccagtttctgcagtcctgtagttttgcccctcactagaacttcaagttgcttaacctaatcaggaatacgggcatctttacataggaagtgcacttcttcatcatatagacatagaggtcaggtattattatctttggcttcctttctcagaaattcttaaacatgaatgtctgaataaacatacagagaagaggttgggcgctgtggctcatgcctgtaatcccagcactttgtgaggccaaggtaggtggatcacctgaggtcaagagttcaagaccagcctgaccaacatggtgaaaccctatctctactaaaaaaaaaaaaaaaaaactcga

SEQ ID NO: 2937 - DNA, 756 bp, Homo sapiens
agcacgagggtgggaatgtgaagagggcagcccaggccctgtgtttcgggggtgtgcctctccccgcactcccgtttctgggaatgctgttccttctaccttcagggcctgcccgccctgcggtgtagccgcactcctcccgggtgtcatttcttcagagtctttccttcatgccctttttcctcctcacgttccccctcgtgctttacccacatctgtcccgtggttcggatccagttctcccgtgcgttatgggtatccacgtgtttggtcttagccatcactccaggaaagtggctcctccctgaggacagggctctgtctctgatgctgctggcctccctccagtgctgccctcctccttttggggcttggtggatgcaagtgctgacacacaaaggcaggcaggcaggcctcgggccaggggtgtcctccaggcccctctgatggcagggaccagcgagacctggggaaactgcacagtctgtgcctgtctgtgctctcaggagactgagggaattagtgggtgggagagattttatgttggattaaaaactgcacctccaggccgggcatggtgtctcatgcctgtaatcccagcactttgggaggccaaggtgggaggatcacttgagccctggagtttgaggcttccaggaagctatgattacaccactgctctccagcctgggcaaacagagtggcaccctgtctctaaaaacaaacaaacaaacaaacaaaaaaaaaaaaaaaaaa

SEQ ID NO: 2938 - DNA, 576 bp, Homo sapiens
ggcacgaggtctattaatttgcttttctttagatgtattctagaggggggaaaatcagtagaagaacagttatgtaattcttacaagttctccatgtgtcttgccatcttgctttttctcatcctatcagtactggatgagaatgtttatttcactgaactttgccaaagagtttcaacatttttttgtttaatcataggagaaaaaggtttatcttatttttaaaaatttttatttaattctttcattacaaatgaagtcccagaagttgtatttgtttctttaggctgttcttaattgttcatkggaacaggcagggtttgaaggagtggggatactgggaaagccagggtgatgagaaaataggaaaggggtcttgtcattgggaggccactataccagtggcccttgtaccaggactaatatggtactttgaagctttaaattcatttctttattcaccagataattattgagtgcttactggttctggacaagtaagcattcaataattttaggcatcccaggatacatcagtgaacaaacaaacataaaaaaaaaaaaaaaaaactcgta

SEQ ID NO: 2939 - DNA, 1906 bp, Homo sapiens
  misc_feature (617)..(617): n equals a,t,g, or c
  misc_feature (940)..(940): n equals a,t,g, or c
  misc_feature (1461)..(1461): n equals a,t,g, or c
  misc_feature (1901)..(1901): n equals a,t,g, or c
tctggagctccaccgcggtggcggccgctctagaactagtggatcccccgggctgcaggaattcggcacgagcccagcttctggtggttgctggcaatctttggtgttccttggcttgtagatgcatcatcccaatctctgccttcattttcatgctgcattctccctgtgtgtgcatggctgtctctgtgtccaatttttccctttttataaggacaccartcatattggattagagcccaccctaatgacctcatcttaacttgataatctgaaagcaccctatttccaaatagggtgacattcaragggtgttaggacttcaatatcttttgaggggacacagttcaacccataacacctaccaacggtttctggaatcatctctcaaaataaactatctaaactctaatctttgwttcagggtcagcttctagcagaactcaatgtaagacacccttttaaagatggtacctcagaggtacagacagattgtgaaccttccctagcacagtgtaacaagtcccttgcaaaaatcctgatttgagtcaacattgtaatttcttgcttaaatctaagaatatgcctyccagcttcttccaagactatctgggggnagttgkttctagggtggctcaatttattcgttttgaacgctgatggccgtgcaccacaccgtggctcaatgggtgttgaggacacgttcacatgcaataaatgcacagggctttgccattaggtggcattaggggaaggacacttycagcatactgcagaggcattctcttccagcctggttgcctgtcaagcacctgctgagatgactggcccagacggagattgtggggttgctgagccagccctgtcccctccttatctccggaagatggaataaatgcgtgtcagaagggagggtgcctcccatctcgggrgcaccggngttgcccttcagaaaaacattgcctgcacattttgtagtcttgaaatgaatctgagtggcaattcaagcgggcagagcttgttttggattttagacagttctacctgcgtgctcctcttctctgctccagctctgacatctcggctccacatacagtggtctgaagtggcatacggaccctgagaagaggagaggcaaaggwrgcagctgtggctggcccctcctgccytctggtctccttggctggtgagggaagaacaaacacagttgtgtttccaggtcacagctgccagggctccacctgtggggtgggtggctccagttctgttctgagttaagaaatgctgcaaatacgttctccttraaagagmcctaggaattgccatttctttctgcagctttctgtagccaataagcatttgaggaactgragaagggttcagccctgaattgcaagggaaaactgtgtgagtgtgttttagttaagaaaaaagttaattctagtgagacctgcttgtttncaaaacagatgtataggccagacagatgtacagggatgaccttgactttcttttgtcattgcaggaaggtggggtatgtatgacccctggttaagaccaataggaggccgggcgcagtggcttacgcctgtggtcccagcactttgggaggccggggcgggtggatcgcccgaggtcgggagtttgagatcagcctggccaacatggagaaaccccgtctctactgaaaaaaaaaaatacagaattggccgggtgtggtggcatgcctgtggtcccggctgctcgggaggctggggcaggagaatggcttgaacccgggaggcggaggttgtggtgagccgaggtcgcgccattgcactccagcctgggcaacaggtgcggaactcggtcaaaaaaaaaaaaaaaaaaaraactcggggggggmaccgaacccgggtcgnacatt

SEQ ID NO: 2940 - DNA, 3761 bp, Homo sapiens
ggcacgagtgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccgaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcactgtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctgaaaaaaaaaaaaaaaaaaaaaaaaaaaaaaaaaaaaaacaaaaaaaaaaaaaaaaaaaaaaaa

SEQ ID NO: 2941 - DNA, 1896 bp, Homo sapiens
  misc_feature (1802)..(1802): n equals a,t,g, or c
  misc_feature (1856)..(1856): n equals a,t,g, or c
  misc_feature (1886)..(1886): n equals a,t,g, or c
aaaacaaaaaagctaataatctcctcaagcaatttctggcctaatagaattatagtagacagtgaagtatctaaacccagggaatcagattgaggcaccatgtccatcgccttgagaattaataggctgcatttctgggttctcctttttttttttttttttgcccaactgagtctttctgtggacttacatggaacttcttattctcttaaatcattaagttacttgacaatattcttggatttggagaaactggatgtagggccgtatgaaaaaatcattcgaaatcagatttaggggtataaggttggataggaatgttttagaaagaagaatgtaaggcagataactaatttgtcacatccaaagtataaaactgctactttttccctagaaaagggaagctcattttaggcagcctaaaccagtaagattttcttcctcctccaagtgcagatttttgtacctttcgtttgtcaaaacattctttggccctatgcatgccagagtgatatagaaaggaagttaccacatttttttgagaacaaatcactcctgataaaatttcttagacaattgataatcattttaagaagaaatttaattgtatttagctctgtgtctcgcccctttggtgtcactcttctacctcttccatcactatagctaaatatttagaagtatatcttgacacctagcacaaatgttttggttaagtatcttaaaactgatggatggtatggctggggcagcatggctcacgcctgtaatcccagcactttgggaggccaaggcgggtgaatcacctgaggtcaggagtttgagaccggcctgaccaacttggagaaaccccgtctytactaaaaatacaaaaattagtcsggtggtggcgcatgcctgtaatcctgtctactcaggargctgargcaggagaattgcctgaacccgggargcarargttgcartgagctgaratcgtgccattgcactccagcctgggcaacaagagcaaaactcagtctcaaaaaacaaaacaaaaaacctgttggtatagtacgaaagaaacgtcttgcagttttctgttgcagagaattaattagaaccaacctgttggattatacacattcacctttcagaatcctttcttctctgtggaaacccacactctcagcagtgtgtgggaacacagtagattcttaaggaatgcttgttgaatgttgcagtctgcatcttcttgaagtaacagaactgttggtagctgtttaaaagtaaaatgtgtctaaagaccttttggaaattaagatgtaagagattaatgcaccaaagcagtctcttaattacttaaaatgaattatttcaaagaatctttaattgaattttctgtgaagtctggaatttgtaaattatgtccctttgttcaaaccagcccctgaaaagaacaattaaggcaattaagatagcattaaagttttcaatgaagttggcattttcygtgtattaagattagatgttagctgctgaagtttgtggaggtcggacataaagcttccaacatcagtaatgcaaaattgtcttgaacctgcgataaaattttgttggacttttttttcattgcagtgraaagggccatgtagcatgcctcaaagccaggttactcagcctagtccttgtttaagcagttttgatattcatycaagttcaattttcycacctgatttwakgattaatttcctkggaaaaattttgaaaagttttccaaagaaagtaaaaaatttaaataatccggtaaccccgtataatangaggattaaaccttccaggttccaaatggttttgggtggcaattttcccttccnaaggtcccttttttttcccaatgggtaatnaaataattaa

SEQ ID NO: 2942 - DNA, 944 bp, Homo sapiens
  misc_feature (932)..(932): n equals a,t,g, or c
  misc_feature (942)..(942): n equals a,t,g, or c
  misc_feature (944)..(944): n equals a,t,g, or c
tcgacccacgcgtccgcccacgcgtccggacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataawgcaatcacgcagattaaagaaaaaaaaaaaaaaaaaaaaaaaaaaaagggcggccgctctagaggatccaagcttacgtacgcgtgcatgcgacgtcatagctcttctactacgtgnaccctaactncn

SEQ ID NO: 2943 - DNA, 1049 bp, Homo sapiens
ggcacgagagatagtgtagtgcaaaggatcatggtttggaatttggaagcctgcgactgactcttcaccctgccacttgctacatgtgtaacctaatgactgaacatctgaacccctgtttcctcatctgtgggaataaataaatcatgttaatatttatttccctaggccgctgtgatgcttaactgagagaatgaaggtacaaatgtattgtaaactatcaagacctcgttattagagattggtgtagtagctaatgctgatatttttaaaatgtttaacagtttcttatgcaaaatacagcagtaaaatttatactgcagtgtcgaacacattcagcacagcttcagactcctggctgtgcgtgaaaactccaagaggataccactggtttatgtcacttgagactccagacattgaacagtaattagggaacatgacagttatttgatttaaagtctgcagccacagagttcaggctccatccctctctccatcattctccctgagtgcaaatccagagggagggcaagtaggtcgaagcagactctgatggtgtttacttacttgccagagattagagaaagtgtgcccactaggtctacagtagtgcaaaaccaagccaaaaagtgagcacttcagtgcactcaatgccaaaaaaaaaaaaaaaaaaaaaaaacatgtcttactttttttgtcattactgacttcatgagtagtgcatgtaactatttctatgggtcttctctttgattttttttctctttgattttcaaaaagaaccattaacattttaatgttatatttactgagaggttgcatgatatcagccaaagtaaaagggatatggatgaaataagaaatacagaagtctggccaggcacagtggctcatgcctgtcatcccaacactttgggaagacgaggtgagaggatcacttgagttcaggagtttgagaccagctgggcagcatagtgagacctcctgtctacaaaaaaaaaaaaaaaaaaaaaaaaaaaaaaaaaaaaaaaaaaaaaaaaaaaaaaaaa

SEQ ID NO: 2944 - DNA, 1646 bp, Homo sapiens
  misc_feature (1544)..(1544): n equals a,t,g, or c
aattcggcacgagtctaagtgagcatttggtatgattttgggattattgaatttgctgaggattgttgtgtttctgattgcgtggtcaattttagagtatgtgacacatggtgatgagaaagatatatatactatgttggtttcagatgaagagtttcatatatgtttattagaatgatttggtcaagtgttgagtttaggttctgatatctgctaattttctgcctcaaggtgggaaattaaagaaaataaaattaaattaaaaagagaaagaaacaaggtttcctgtattaggctgacttatcctagaggcagtaacaggcacagcccacatccaggaaaagttttgataacactacttaagaagccagggctggaaagaatgtgctctggagactctcccagcattccctcaacatagggagaagagaaacaaattttcctttctcttatgattcctgtttttcatttaagcagcacattgaaggtcatgagatgcctgagcaggcctggattgcagccacctaggcaccatagtgaaggttataagataagcccatgcaaggcactagagcaagcctaggtaacagccatctgggccacatagtaagagtcatatgtaagtctgagttataaacctgtcatagtatgattaactgcttttgttctgtttctgtatccttgctttcacatcactacactttgtgccactgtaggcttgtttcaagttagcccaccctctttagaagtgtatgtaaaagttaaatgctgtctttgtccttggcccagtctctggatgttaatccactgggtctgagtgcactcaataaaatcctccttttctacctatcggtctttccagtctcctaattcccacaacacagtgatctaagtgtctgcggagtgttgtagtctcctattattgtgtcagaatctacatctctttataggtcttctaagaacttgctgtattcatgtgcacccatgaattttttttttttttttgagacagtttcactttgttgcccgggctggagtgcagtggcatgaactcagctcactgcaacctcctgggttcaagcaattctcgtgcctcagcctactgagtaactgggattacaggcacctgccaccatgtttggctggtttttgtttgtattttagtagagatgaagtttcaccatcttggccaggctggtctcaaactcctgagctcaggcagtccacctgcctcagcctcccaaagtgctaggattacaggcatgagccactgtgcccagccaacacccatggatttttttagaacacctttttctcttctgctttttccttcataaacattctttcaagtgtacacagggtgcccaaggctacaccttagatacctgaatccagtgtctcctaaaattcagatgtccaagggttcagggacatgtccagagacttggttgttgtaggagaaaatataaattagaaataagaggctttattctcctacctgaaaataatggaagatattttgttcttttttcttaaagcatttngattatatgtagatatttttctctgatttttggaaatatatgtaaatcatagtaacagctaaataaaccatttgtcattttttttaaaaaaaaaaaaaaaaa

SEQ ID NO: 2945 - DNA, 1060 bp, Homo sapiens
  misc_feature (453)..(453): n equals a,t,g, or c
  misc_feature (1045)..(1045): n equals a,t,g, or c
gccacttcttccaaatacagtagatgtgtctgctgtgtatttatacaacatcctgaactacttaacatgctgtttatttacttgtttgtattccccattagaataggctctgagaaagcaaagactgtatctgtcttgcttatcattgtatccctgacagctcgcccactggctggcttttaataagcacaccataaatatttacttgaaatactcatttttaaaatgaacagatgaatgaatgatagatggatggtggatggcattatgtagctaaaaattgtgtcctgtctctacctatttttgaagaccatcctttagtttgcgtttcctgccatgtttgaggggcctttttttggtccataactcttgtcttttattcaaattaaaacaccgaacaaaagcacattcgattattgrccatgrggttttttattcygctgtcagtgtcanccycmtgtctaaatccccyggggtcaaacttacatatatctggatagcccttttkgatgacgatggtagtctaatttgtgtgttatgtgctcttgaaatgttttgctgtaaagacactagaactgaattttgctttattgccaatgatgatgaatgttaaaaaaaacaactcagtaacattcaaaccaatttccaagtttgttcttcagccagaggaacttgcacactgactttttgtaaaggtagcagatttattgtgttgtaattcatacaccataaaattcaccattttaaagtttccaatttagtggtttttagtatgtttacagagtcatgcaaccatcaccacagtatcattgcaggatgtttttatcatccctcaaagaaatccagacccacaggaggctgaggcaggagaatcgcttgaacccggaaggcggaggtttcagtgagtccgagatagcgccactgcactccagcctagtgacagagcaagactctgtctcaaaaaaaaaaaaaaaaaaaaaaaaaaaaaaaaaaaaaaaaaaaaaaaaaactcgaagggggggcccggtacccaatcgtccctatnatgagtcgtattaca

SEQ ID NO: 2946 - DNA, 1732 bp, Homo sapiens
gttcggagggaaacgtgtattgtggtctcaagmmttgccccawattaacctgtgccttcccagtctctgttccagattcctgctgccgggtatgcagaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtgtgtgtgtgtgtgtgtgtgtgtgtgtgtggtaaaggggggaaggtgttatgcggctgctccctccgtcccagaggtggcagtgattccataatgtggagactagtaactagatcctaaggcaaagaggtgtttctccttctggatgattcatcccaaagccttcccacccaggtgttctctgaaagcttagccttaagagaacacgcagagagtttccctagatatactcctgcctccaggtgctgggacacacctttgcaaaatgctgtgggaagcaggagctggggagctgtgttaagtcaaagtagaaaccctccagtgtttggtgttgtgtagagaataggacatagggtaaagaggccaagctgcctgtagttagtagagaagaatggatgtggttcttcttgtgtatttatttgtatcataaacacttggaacaacaaagaccataagcatcatttagcagttgtagccattttctagttaactcatgtaaacaagtaagagtaacataacagtattaccctttcactgttctcacaggacatgtacctaattatggtacttatttatgtagtcactgtatttctggatttttaaattaataaaaaagttaattttgaaaaatcaaaaaaaaaaaaaaaaaaaaaactcga

SEQ ID NO: 2947 - DNA, 970 bp, Homo sapiens
ggcacgagggaaggaggaattgtcttaagtgtagaatcaatgaaaagacttaacagccttctcaatatcccagaaaagtgtcctgaacagggagggatgatttggaagatatctgaagataaacagctagcagtttgcctgaaatatgctggagtatttgcagaaaatgcagaagatgctgatggaaaagatgtatttaataccaaatctgttgggctttctattaaagaggcaatgacttatcaccccaaccaggtagtagaaggctgttgttcatatatggctgttacttttaatggactgactccaaatcagatgcatgtgatgatgtatggggtataccgccttagggcatttgggcatattttcaatgatgcattggttttcttacctccaaatggttctgacaatgactgagaagtggtagaaaagcgtgaatatgatctttgtataggacgtgtgttgtcattatttgtagtagtaactacatatccaatacagctgtatgtttctttttcttttctaatttggtggcactggtataaccacacattaaagtcagtagtacatttttaaatgagggtggtttttttctttaaaacacatgaacattgtaaatgtgttggaaagaagtgttttaagaataataattttgcaaataaactattaataaatattatatgtgataaattctaaattatgaacattagaaatctgtggggcacatatttttgctgattggttaaaaaattttaacaggtctttagcgttctaagatatgcaaatgatatctctagttgtgaatttgtgattaaagtaaaacttttagctgtgtgttccctttacttctaatactgatttatgttctaagcctccccaagttcccatggatttgccttctcaaaatgtacaactaagcaactaaagaaaattaaagtgaaagttgaaaaataaaaaaaaaaaaaaaaaa

SEQ ID NO: 2948 - DNA, 606 bp, Homo sapiens
  misc_feature (272)..(272): n equals a,t,g, or c
ggaattcggcacgaggaaataaggtgacagatccccagctgctgaagaactagaatgtctattacactcatacaattgatgttttattttaatacaccagagctaccacacaaaacttccttccatgtgaaaggctccagataaaattctgccatccctcctctcctcatgtcctcctgctcagacccaccttcatgcccctaaaccaatctgcatcatgcctgtttcagagagtcatgggaagatgggcagtgcctccattgtcaccattnccccacacctctgcacacttctgccccttcccctctagacgccacaacttcacagtcttactgttgtaaatattcctgcacagttagtaatgatcaaatgatcctgtggtcagaggcctctttggcagtgtcttcttacccttaagaaaggtcatgaaatccagaaggggcaacctttccaggagagctttggagtcatttctgtgtgagacactattgcataatcctgtaagattgcttttatatttaaggaatgatgttacttaacaaatgaacaaaaaaaattgcaaataaattttttaacaatgtttaaaaaaaaaaaaaaaaaactcga

SEQ ID NO: 2949 - DNA, 963 bp, Homo sapiens
tcacgcggtgatttaggttttgccctttcggggatctcgattgcttatggattttcgaaattcatcatgggttcggtatcggatcgctcgaatccgcgcgttttcctgcccgcaggtttgattctggcggcggcagtgatgttgtttatgggctttgtgccatgggcgacgtcgagcattgcggtgatgtttgtactgttgttcctctgcggttggttccaggggatggggtggccgccgtgtggtcgtactatggtgcactggtggtcgcagaaagaacgtggcggcattgtgtcagtgtggaactgtgcgcacaacgtcggtggtggtattccgccgctgctgttcctgctggggatggcctggttcaatgactggcatgcggcgctctatatgcctgctttctgcgccattctggtggcattattcgcctttgcgatgatgcgcgataccccgcaatcctgtggcttgccgccgatcgaagagtacaaaaatgattatccggacgactataacgaaaaagcggaacaggagctgacggcgaagcagcctggggggcgaagattgtggctccacccagcatatactgctgcttgacgaattttatcgtaccgccgtgcgtctcgccggtaagcgtattctgtggaatatggtgccgtgcgacgaagaagagcattacgacgactatgtgatgacgctttacgcgcagggcgtgctgacgccaaatgaatggctggatctcggtggcttaagctcgctttctgctgaagagtactttggtgccagcctttggcagctctacaagagtatcgattccccatacaaagcggtactgaaaacactgctgctggaagcctattcctgggaatacccgaacccacgtctgctggcgaaagatatcaaacagcgtttgcacgacggcgagattgtatcgtttggtctcgatccatactgcatgatgct

SEQ ID NO: 2950 - DNA, 1742 bp, Homo sapiens
ggcacgagctcgtgccgctttgtagtctagggagtttaattaaagtaagtggagacaaaagtactcttttgagagctgtcatttctcttagtgtgacgctattaataatgtagtgtaatgctattttggaagtttggttctttccttttcttttgtcttcctctgactcttttctgtattctaaatgaaaggggaataatgcacttagaggggggcactctcctaaattcactgtctcatgtacgacattatctccgacttcggctctcatgttttgaaaaaatacctcttcatcgctctatttttatttttcttcttcttttattgtgaatctcttttaccaaaaacatttgtagggttcttcacaaagattttttttttcaatcaggatgaaaactagatcatgatgtgaccatttcactgtgagtgtaacttccctttttgacagctccattagatctgccaggttataaatcttcatatttctgacttgccttgaaatcagaaagtgttttcattatgctagtctctgtgagcaacaagcatgaaggaaggcatggcaggtatcatagcccctttgatgaacttacctgtttcaactcagtgccagggcagaacatttactgctaaccctgatgggtcaactttgattgcaaattatgtgtggtacattttgaatttaaagaatgtttctgagattattctacgatcacttgtcatttttatgtgtgcagtaatgtgttgtgtataacttggatttcaacaatatccattgtttgaaagttagaaaatattctaagaatactaattatcttgctcaaataatcatttaagtacaactgtcacttgattatggtgaatatttttaagtaaaattatatatttaaggtgtgctacctctaattttattgtcatacaaaaagcagattattgaacatgttaatgtaaattgtacttttaattttttccagtactctagaacatgtgtaaggttaaaagaatttaaattacccaggtttttctttttacataataaataagaagaaatcacaaaggaagcagatattatattgtttttaatatacacatgaaattgtttgactttattttgagacctcacacaagtataaacatggcagtggtgtgtatgatcaaagtaagaaattaaagagttaccggttctttataaaccagaagtccattgacttttaataatgctgtctcaaatatttgatagtaaattgtggaaataatcaaagctgagcctatgggactgtactttgtagtactgtttaatttaataactctaataatcccttaagaatattaggaaaaataggccgggtgcagtactcacgcctgtaatcccagcactttgggaggccgaggagggcggatcacctgaggtcaggagttcaagaccatcctggccaacatggtgaaaacccatccctacaaaaacacaataattaggcaggcatgatggtgagtgcctataatcccagctattcaggaggctgaggcgggagaatctcttgaacccaggaggcggaggttgcagtgagccaagattgcgccattacactccagcctgggcgacagagcgagactccctctcaaaaagaaaaagaaaaaagaaaaaagaatattaggaaaaatatcttaatgcaaaatatattaattagtaatctgccaacactgagatgtactataaggccaagaagaaaaaaaaaaaaaaaaaa

SEQ ID NO: 2951 - DNA, 1667 bp, Homo sapiens
  misc_feature (1628)..(1628): n equals a,t,g, or c
tagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggraaaaaaaaaanwaaaaactcgagggggggcccggttacccaattcgccct

SEQ ID NO: 2952 - DNA, 586 bp, Homo sapiens
ggcacgaggttttttcctttataacggaagttttataattcatcttttatgtaagtgtaattctcattaaaaataccctaaagcttaaagtttgcaaggctgcccagcctaacccacaacagtttgatgctgccccctagcgtttgattcccttcaccttttgctaaaataaggtaatgtttaaattacaattagatttacttactgctgtaaatctggtctattttagtttcctctgggtagttagtgttgctaataagatggacgtaagtgtttttgaactggtgaattctgattgcttttagcccccagttttccaaataggggtgaattttgggtagagatagaacaatcaccaagttaccttgctccaaaaaagaaatttacgtatgggattgttttcaaagcgggaagttagctgtgtaaataacaacaattttatatatttaatctgggcttctccttatcttgaatgatataaaaatctactttctagattaatttagttccatataactttgtattgctttgactgtactgataataaagtttgaaagtgttaaaaaaaaaaaaaaaaaaaaaaaaa

SEQ ID NO: 2953 - DNA, 1408 bp, Homo sapiens
  misc_feature (1385)..(1385): n equals a,t,g, or c
  misc_feature (1395)..(1395): n equals a,t,g, or c
attacacacctgagcactgtgcctggcaagacctgtcttaatagattagagaaccactgatagatggtcagctttctgtagcagtgagaaccctacatttcaaatgtggatagcacctttgcggggaaacatcacttggcacatctgcattcttttttgacacagggtctcactctgttgcccaggctagagtgcatggcacgatcttagctcactgcaacctccacctcccaagttcaagcgattcttctgcctcagcctcctgagcagctgggatcacagacatgcgctaccatgcccagctaattttttgtattttttgtktgtttgtttttgtttktaagtagagacgggctttcaccacgttggscaggcaggtctcgaactcctgamctcaggtgatccacccacatctgcgttccaatatctttctcaacataatgatagccgtaattaatattttccagtacatttttatgcctttacacacgagagtggtagacagacacaaacccagatctgtctgactccaaagcccgtttgtcatcattccttttacggtatcctatagtggtatcctttacagaaagacagcttttacccaacaaagacttaacttcccaggatgccagaaggacaaagcgggattgcttttaagragraagttatcaagamcttattttataaatgagattagatagggaaaggcaatttatctttattaaaaactgaaaaggccagcatagggaaggaggtccttcggtggtctttttcagggaaatacttcagttgcttttattagaaacagatagtacctaaggttttgaggtaggwacagcttaaggcatgctaatgktcatgggtccttccatagtcattttkgtattttggttwacatttgagcaataggcagcccttcactgctgctggaytcattcctgccaytattacaggtgacagaggagacaggaggtatgtcttttctatttttawacatgctttatatttaacacaagctcttgggtatcttagataaacagaagttgcctagcactccttttagtgcattgaaccctttaacatttaagcaaaataataaacagtcttttgaggttccttaacaatgaaacgtgttcgagtggcagcagcggaatccatgcytcttctcctggagtgtgcaakagtccgtggtcctgagtatctcacacagatgtggcattttatgtgtgatgctctaattaaggccattggtacagaaccagattcagacgtcctctcagaaataatgcattcttttgcaaaggtgaatatttttctcttaaaaaatatgtataaggtggtatgttcatttattagtcttgctaaaaaaaaaaaaaaaaaacttngagggggggnccggtacccaatt

SEQ ID NO: 2954 - DNA, 914 bp, Homo sapiens
  misc_feature (909)..(909): n equals a,t,g, or c
ggcagagcaagagatgactttagatgagtggaaaaatcttcaagaacagaccagaccaaagcctgagtttaacatccggaaaccagaatccactgttccttccaaagccgtggtgattcgagagtcaaaatacagagatgatatggtaaaagatgactatgaggacgattcccatgttttccggaaacccgccaatgacatcacatcccagctggagattaattttggtaacctccctcgtcctgggcgtggagccagaggaggcacccggggaggccggggaaggatcaggagggcagagaactatggacccagagcagaagtggtgatgcaagatgttgcccccaacccagatgacccggaagatttccctgcgctgtcttgaaagagccctgtttcccagcaccgcggagctgcactgcacacctgtggggagacttttccagctgggccaagggagtcagactctaagaacaatagatgttgcttttcccgtgtcatgtaaatttgttgcacttttttgggctgagctgttagaggggcttctccagaggctcgagagcaggccatttcccaagaagatgaagaatggtgactgtgtttttattgaaggaatttcaaatgaagaataatgtttaaaatgtgtatatagagatagtatagactcctccgcggaagcatggagggaaaggaggttgtaaaatagactccatggagactcttaggaagcagtagattcccgggggctgtgcctttagcgttagaggaaacacatagagctggaactgttaatggaaagcagtcacagctgagttttcggagaccaagaaattaaaatacaattgcacttacaaaaaaaaaaaaaaaaaaaaaaactcgagggggggcccgtacccaatcgccttgtgntgcat

SEQ ID NO: 2955 - DNA, 857 bp, Homo sapiens
  misc_feature (550)..(550): n equals a,t,g, or c
gaattcggcacgagcttatggtctttattacttacatgtctcatcattcctgtacaactgtagcaaatataaacatcaaaatgcctctagatcttcttttcctcataacatattttctcctttctgtcattttgaaagtgttgtatattgatgcccctggtcatttaggaatgcccatttctctttgttctagtgctgttgtgtgggtgaaggttgacctagtktcagagaaggggtgaggaaaggcaggggcmaaaagaataaaggaaagagttycttttgagtacmaataaaaactaccagggaaatctgatttaccaaaatgttctagggattagattgcaacyattaaatatgatttaacygaaggacccctccggccttttttattcccttcttttttactaaaattctttatcgaattgcagaatcctttttcattkgtctcagtaagtaaacttcaataaattataggtaaaatttagaaaactgaaaattctgttagagattagaatgcattaatatttcttgccttaggctgggtgcagtngctcacgcctgtgaccccagcactttgggaggctgaggcgggcacatcacctgaggtcaggagttcgggaccagcctggccgacgtggtggaaccccgtctctactagaaatacaaaagttggccaggcatggtggcaggcccggctacttggtaggctgaggcaggagaatcgcttgagccagggaggtggaggttgcagtgagccgagatcgtgccacagccgagatctgtgagcctgggccacagagcgagactccatctcaaacaaacaaacaaacaaacaaaaaaaaaaaaaaaaaactcga

SEQ ID NO: 2956 - DNA, 1151 bp, Homo sapiens
gcagggacagccccacgcatgggaggtggtggccagccatcaccccagggtgaatttctctaagagcagtcctaggccagggggtgagtgtgggaaagtcagggccgtttccatcagttaacgtttcagagcgggttcccgctggaagtgctggaaatacccagatgccatctgtagcattttatgaactgtggcggatccactctctgtgtcttgagcttctgctctgtggtctgctcagtggaagcatcctgtcagtccactgtacagtggggtggagccgcagccagggtgggtgtgccgtttgattggtcacggaatgaacagggcaaaggtcactaagtagatatgatactgcaagtaggattgtggtcataggtatttttatgaatttgtgttatgtgaagttgaggatttgaatgttgtgattattatatccagataaagttctagcctggcacagtgcaggcacgtgcctgtggtcccagctgcttgaagtgggaggagagcttcagctcaggatttccaggctatagggagctgtggtcccaccattgcaccccagcctgggtgacagagtgagaccccatctcaaaaagaaaagaaaagaggctaggcgcagtggctcaggcctgtaattcaagcactttgggaggctgaggcaggcggatcacttgaagtctggagttcgggaccggcctggccaacatggtgaagcccccccatctctattaaaaatacaaaaatcatacttacccggcaggggagataccatgatcgcgaaggtggttttcccagggcaaggcttagccattgcactccggatgtgctgagcctgcgttttccccaaatgtgggaaacttgatgcgtaatttgtggtagtggagggactgtgttcacactgtcccccccgcccaaaaaaaataaaaatacaaaaatcagtcgggcgtggtggctcacgcctgtcatcccagcactttgggaagccgaggtgggtggatcacctgaggtcaggagtttgagaccagcctggccaacatggtgaaaattgggaggccgaggcgggcggatcccaaggtcaggagatcgatacatcctggctaacacagtgaaaccccgtctctactaaaaaaaaaaaaaaaaaactcgta

SEQ ID NO: 2957 - DNA, 2078 bp, Homo sapiens
  misc_feature (337)..(337): n equals a,t,g, or c
  misc_feature (492)..(492): n equals a,t,g, or c
gattattttcaatagattgtcaataaattatcaaattatggaaatatcctttagattcctgtgataatgctttgtgcatgttttctattatttagaaaatgaaaacagcagtcatttgaccagccatgttatgacaccagataatattctgcaaggatcttccaaacagggagaaactgcaatgggaacaatctttggatatctacattgtgtcaaatgttatgtgctttatttcattttcatacttataacagctgtatatcacagtttttattatccacattatagaggcaaggcactgatatcaggaacttgagtaattggcttacacagcaantgtagttgaaatagaagccaggactgtctgattcccaagacagtgttcttgtactgcaggtaagcctggtgttgctgggkttccctagcactgagtattgcagaaatacggagatttatttactcaggtgaatgatgaagcagaatctttatttngctttttaaattatkgatgggkcckgagttaagctagttcaccaatgagtctcaaagggtgaagaactggcctgtgtagttttaaaacaaagcagcagttttcttcatttgtagatattatatttaatttaccttgcatttccaatagcattaaatattagaagcgtataagctttttctttttatgcctaggggatatggcttaacactgagaaacacttgagaaacactgccacattctaaggaacaaccaataataagaaaaattatttcatataaaaggatgcagcttgcatataaaatgctgaattcaactgaagttcattatgctgcctttatgtgagctcaggggtgaccttcatgctctggactcttaaaggatccagtgtcggatacagctctgccattggagcaatgtgttccataactagggttgcctaagtatatcccttcttctgktatctatagtttttctttaaaggtgtgcttttcaaaacatgatgttatttcatatacmtatatatatatatgcacacatacatatacmtcatgcatgkatcatatatgtgtgtgtatgtatgtatctatcttcaatctttcaggaaagtttgtaaaawatagccctaagtagaattatggggaaacagttgcagaactgctgaaattggctcagatgaaaaggaaagagcaaaaatctaggttattcacaggaagttagtccagctgtgttttgcgaggcatgaaccaggctgaatcagagcaagaacaggttgcaatcttaggtcacatggcaattaaattccagctatagaatattgaagacatgtaagtgcttaatttaaggattattcaatgcagtgaataaatttatatcattcccaaaagtatgcacatcagataatgagttaactgcatgtaacttgaaaaccttaaatatttaactgaaaggattttgtgcatagaaagatgtcttagtcaatgtaaaaatgccagtgatttgtgtagcatgtcctttgctaaaagtcattatataaactgaagtcacttatctttgtttccaatgtgataatattccacatttaacaggtgataattattgaaaatattagtttgcctcactaatattgtgtccgagatattctagtttaaaccaagtaactaatactgtaaaagaagtattccttttatgaagccagcattatcctgatactagaactgggaagagacacacacaaaaagaaaacttcaggccaatatcgctgatgaacatcaatgtgaaaatcttcaataaaatactggcaaaccgaatccagcagcatgaggcgggtggatcacaaggtcaggagatcgagaccatcctggctaacatggtgaaaccccatctctactaaaaatacaaaaaattagccgggcatggtgatgggcacctgtagtcccagctactggggaggctgaggcaggagaatggcgtgaacctgggaggcggaacttacagtgagccgagattgcaccactgcactccagcctgggtgacagagcaagactctgtctcaaaaaaaaaaaaaaaaaaaaaaaaaaaactcgta

SEQ ID NO: 2958 - DNA, 638 bp, Homo sapiens
gataagaaattatttaaatttctttatgaatattgttcctcaatttagcgttcttcctcattttgcctatttctcttttattatcctatattgggctgttttgttcagccaaacaatttgtagcatgtctgttttcaaagtaaaatagtgatatatttaaagttctaaatgtgttctttatgtatttttaaaggagatgggtaaaatagaatgtatttctctttaccctgatgacattcccgtgatatatttcaaataatatttttgattgggtaagccagtaggaccaaatccatggtgatcacagatacagattcacaaatgcatagagagaatcataaatagatgcatatggaggagtctgacagtatagtgaaattggtttcaagtaatttgacacattagaactttcaggcattcacctgccagtaatccttattagaaataggattggaatattggggtcaccagctcaagaccatttttttgtgagagctgaacaataaccaaaagtcagagctataggaataaaaatgaacctattccagtcattagaactgtttctctgaataagctctttcttcctctccttcataaaaaaaaaaaaaaaaaaaaaaaaaaaaaaaaaaaaactcgaa

SEQ ID NO: 2959 - DNA, 1336 bp, Homo sapiens
  misc_feature (766)..(766): n equals a,t,g, or c
gaattcggcacgagagtaagagtatgtttgtttacagccccaacctcagcaatgccaaaggctggcatcgggggcagtgccaagctgtccctggatactatttacctttgaggaagaacagcatgggtttgccaagctcaattcccaggctggtgctccttgaattaatcatggcacagtgttcatctctctggaaatgcccacgccagcccagacacagcctcarartcctttccaacacgaccctccaggcagcagttaccaaccatcagtcttcagctgaagcttcaagtctttgccatccttgtaatgacagccttaggccttgccccaagcattctggactctctaacactcagaattgtaatgtaatattctgctctaatttaaatttttaaaaatatagtctcctaattcaggataaggagtaagcaaactttctgaaaagggctagataataagtattttaggctttgccagtcatatggtctcttgcagctactcaactctgccactgtagtatgaaagcagccatgagtaatatgttaatgaatgggaatggctgagttccaataaagctttatttttttttttatttgagacggggtcttgctctgttgcccaggctggagtgcaatggcgcaatctcagctcactgcaagctctgcctcctgggttcaagccattctcctgcctcagcctcccaagtagctgcgactacaggtgcgcaccacaatgcctggctaattttttgtatttttagtanagacagagtttcaccatgttggccaggttggtctcaaactcctgattcgtgatccacccaccttggsctcccaaagcactgggattacaggcatgagccaccattcccagccaataaaactttatttacaagaacagctggtgggccagatttgcmaagggtcatagtttattatcccttgagctaggctgctgctgaggttgattcaacatcccagctccagtcaacaacaaaaattctaagtctcccgcctaatgctgctgtggtgtgtcatgccaaaaaagtgggctactcaggttagaccaatgacttcagaaccacagggctcagaacaggaaggagcttctttctgcagagctgattcctggaaagccaccagcactccaccttctgcccagaaatgtgattcagtcaatagctgatgaggaaaagcaacctgcaaacattaggaagaaggagaaaaataattcagaggtgatgataccacctccaatgaacagggaagcaagttcatcagtaacaaagtcagtgaggcaaaaaaaaaaaaaaaaaaaaaaaaaaaaaactcga

SEQ ID NO: 2960 - DNA, 2409 bp, Homo sapiens
cggcacgagcggctcccggcgccatgtgagggggctcgggggccgcggggggccgggcgctccccgccggagatgaggaaactgaggctcagagaggtcacatggcttgctcgaggccccccagccagtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctgctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtacttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccgaaaaaaaaaaaaaaaaaaaaaaaaaaaaaaa

SEQ ID NO: 2961 - DNA, 1357 bp, Homo sapiens
agtaggatccagtctgtggggctcatttgagggagaatgagcacggggcttttggaggctgcagcctagggccaagggatggaggctcacctgagtgcaggttaggcaggtgaagtgtctccccggaaaccaagctagagtgccccacctgctcggccctgccttctcggatcggatccagcacatccaggcttctcctcctcccgaggaaccagtggtgacagctgaggccatgtgagtaggatcctgaatgaggctttatctctggctgttcgtcccatcgtccaccgtggcaccagctccctcagccagccgggatgggaccagcgactgagagagccagaggcagagaggtgagggtgaccatatcctggactgtgagaggaatgggactctgggcctgtagctgccaagcaggtggcaggtgctccaggctgtgatctgcaccctctgacccctgacattgacctcctaccctgacccctgcctgaccaagccatgtctgaacaggaggctcaagccccagggggccgggggctgcccccggacatgctggcagagcaggtggagctgtggtggtcccagcagccgcggcgctcggcgctctgcttcgtcgtggccgtgggcctcgtggcaggctgtggcgcgggcggcgtkgcactgctgtyaaccamcagcaagccgctcargtgaatggcggctaagcaamgggcactgtgctctgtttgctggctctsctggttctggtgaacagctgatgagctcggctgtcaggacatgaactgcatccgccaggcccaccatgtggccctgctgcgcagtggtggaggggccgacgccctcgtggtgctgctcagtggcctcgtgctgctggtcaccggcctgaccctggccgggctggccgmcgcccctgcccctgctcggccgctggcckccatgctgtctgtgggcattgctctggctgccttgggctcgcttttgctgctgggcctgctgctgtatcaagtgggtgtgagcggacactgcccctccatctgtatggccactccctccacccacagtggycatggcggccatggcagcatcttcagcatctcaggacagttgtctgctggccggcgtcacgagaccacatccagcattgccagsctcatctgacggagccagagccgtccttcttctcacagcggcctcagcgtccccaragccgagccagggtgtgagtgcatgtgaacgttgagtacacatgagtgcgtgtatgcccccaggctgggtcagctcttctgtggattgcatggcgtgtgattaaaagtcccatgtgttcccacacatccaaaaaaaaaaaaaaaaaactcga

SEQ ID NO: 2962 - DNA, 697 bp, Homo sapiens
gatttagggagggggctgtgatgtaaaacgtctcccctgccaaaggaggggcaaagtgctgtgtcagttcctgtttcttcccatttcctggcacactctgcccctctgtccgggggacacgcgcatgtgtttgccagggatggggccaccgggttgatgccaacgctccgggtgcctgtcttgtctgtgtggcttctcagatggtggagggtgctgggagctggcagggtccttccagacagtctcagcctctccccgccgcccccaacaggctgtcaaacaaaaccggagagggggtgggggagccagcctcccagcgtgctgtkcccgcaggcacccgtgtgacatccgcacgtccagctccgtgacctgtgtgtgtgtgtgtgtgcacaagtgagtgagagatttcgaacgcccacccctcgactttgaaatctgagcaaaacaagaaactggggtcttcctctcccccgaacctctccccagctagtcttccctctgttcttcctgcctccagccgcccgcgccagattttgaaatctcggagacaaaactagtactgtaagataaatttttttgtactgtatttattgtgtataacgatttttttaaaggagaattctgtacatttagaactcttgtaaattaaaaaccgatcctttttttaaaactgtaaaaaaaaaaaaaaaaactcgag

SEQ ID NO: 2963 - DNA, 2541 bp, Homo sapiens
tggggaaacggtccctctagaactagtggatcccccgggctgcaggaattcggcacgaggagaaggtcactaccatcatggagatggcttccaagatgaaagacacagggttcatcgtgtttgctgtgcttctgctggtgtcatgcctcatcctcatctttgtcattgccccacgttacgggcaaaggaatatcctcatctacatcatcatctgctctgtgatcggggccttctctgtggctgctgtcaaggggctgggcatcaccatcaagaacttcttccaggggctgccagttgtccggcacccgctcccctacatcctgtccctcatcctggcactgtccctcagcactcaggtcaacttcctcaacagagcactggacattttcaacacttccctggtgttccccatctactacgtgttcttcaccacggtggtcgttacctcgtccatcatcctcttcaaggagtggtacagcatgtctgctgtggacattgcaggcaccctctcgggctttgtcaccatcatcttgggcgtgttcatgctgcatgctttcaaagacctggacatcagctgcgccagcttgccccacatgcacaaaaacccacccccttctcccgccccggaacccactgtcattagactggaagacaagaacgtccttgtggacaatatagaacttgccagcacctcatcaccagaagagaaacccaaagtatttataatccattcctgaagcttggaatatgtgagtgagaggatgagtccgatggtacagcctgccctcccaatttcaaaaccacctggttattttccagtgcaactgttaccaatgggctctcttttcttgagaagttcatttatacctcatcactgtttccaggagaaaaatctttacccaaatagcaatggtggcagaacttcctggaaacagattcagtgaccaaatacccaagtttacatcagtgcctgcaggttccctggaccttccttctcattcattctttcggtgccatctctatgccgttgggaagaagatggagtctgacccactgaatgtagcacagtccaaggacttctctaagatattggtcattggaagttccttcacaccaattctcctcctgagacggaatctccgttgttgttgttgttgttgttttctagcccaaggatgacatagagctggctcccagaggcccacagagcaattggccatgcctccctatccagagctgacagggacacaaccagtgtaaaatatcctgttgcctttgtcacttcctctttggaggcagaagcaagacctcagctgaccttcttactgtgaaagccacttgatgtctcagggaaaaatttcaaccagctcattccccgagcactccagcctggcagtcagcacctcggcatccacccagtccatcccaccatcaccccttccccctctacttacatcctaaggagtcggtcactgagacataaaggcagtaatcgcagaactggaaacaaaacaataacagagccacagccaaactctggtggccaaacccagtgttgcattttgtcttactctgaaagaagaacagcaaattcactgcttcaaagtggcctggctgccaagctagaatttggcagaacgcacttttctattcctcaaggagtcaaccaacctatgatctggggaggtgggaagaggatgaggagcaaagttgggatttggcagaaggcagtcccaggctctctggatactaggggctaacttttgtgttgactctggtgctcatctgggaacttaggagaaacgagctcaggggtaatttctgggttgcagccttaaaggcttggacagctgtgaatctcaatggccaactggaggtgcagacttggcatggggtgcattctagctgttgaccagattgctaccgagtcccytcctccactgatgagctgcccacactgggaagcagcatgccctgactgttccaacaccacctgctatggggagtacctttggtcccctcacatttggccagaggatacaaaaaaccagagcagctggagagggagataattactattccttcccttcccatctcctttctagccacaagagtgtgggggttggagaagaaccattagaaagggaaattagtgggctggtgtatctggaaagagggaagacttgatcctcagccccgaggttggtgcagggcctcccctgtgtgactctacctgcactctgtgtttatatcctgtgccctaagtgggccaagcccaggtaaattcctgctggccttggaactccaaggtttggctgaccagcagactggctccctgactcttcagcctcaaatccccagtttttgatgaatgtggatttctgtctgtaattaaaagcaatgcaacaagttggctcttgagaatggcagtaaactgagggccctaagagtgtggtctgcagggtcaagaataaagattacagattatatttacttgaaaaaaaaaaaaaaaaaaatttcctgcggccgcaagggaattca

SEQ ID NO: 2964 - DNA, 956 bp, Homo sapiens
ggcattttcagtcaaaaatatggctgccgtttaaggtgtgagctttttgcctttttacctagaaaaacaatgatatgtaaatttcttattataatttgtattactctactcttatttgctatttgtcaactctgcaagagacaagggttggtacagaaaatatcattttatcagaaggaaaccttgtcttctacagtaggtactaccttcttgagctgattctggataataaagcttgcttcgcaataatccagagttttccaaaccatatatttgactccctttactgactgatatgcaaagttgtgtttaactatatggaaaattgtgaatccttttcttccaagtctacacactccacttgcttttcccttctaccttgaattcatgtgcattcccccagttttctgcctttgtaatggaggcttcagttcttctgcagccacagttgcaggaaacccaattgtaatcagcagctgccctgctgstaaaagctattagtgccmatgttgttaatgaccgacccagttgaatgtgctgatttaaggggtagacttatttcttgtcactccctagggccttgttcttaaatgagatttctacgttgtttagttgtttactcctctagcataaggagtattaaccactaaccaccacattcgtatatcagcacgttgaattgaaataatggggaggttaagacatatcactacctttgaggtatgaagacacgcgccctgaaaaaacttggctctcacccctaatttttgcctaaagaagttggataccactgcaatttgctctgaagttatacatgttattgtcttcaagggactataggatgagaagggtacagttaggtttcttttcagaactaaacacattagcagtaacctgcaaaaatcaataccaattacttgcaagcaagggcttaaaaaaaaaaaaaaaaaactcga

SEQ ID NO: 2965 - DNA, 655 bp, Homo sapiens
gaattcggcacgagctcaaacaaacaaacaaacaaacaaactagcatggagagggacacaagagagaaatgtttatggtccttgccttaccctaaattactgtgcaaccttttggcaagtcacttcctctctattctgagtttctttatctattcaattgggttcttagatttggtggtctctaacactctcccagtttttcaatttgatgttacattctacccagtgaccaaattcatattccagaagcatagtatgctatgtcataccgcaaatcttgtaaacgttcctgatatggtttggctgtgtccccacccaaatctcatcttgaattgcagttcccataatccacacatgtaacaggagggaccaggtggagctaattgaaccatgggggcgatctccccccacctgttcttgtgatagtgagttagttctcatgagatctgatggttttataagggtctttccccttcactgggcactcattcttctgcctcctgttgccacatgaggaaggacatgtttgcttccccttctgccatgattgtaagtttcctgaggcctcccagctatgctgaactgagagtcaattaaacttttttcctttataaatttaaaaaaaaaaaaaaaaaactctgacgggggggccctg

SEQ ID NO: 2966 - DNA, 848 bp, Homo sapiens
  misc_feature (2)..(2): n equals a,t,g, or c
  misc_feature (17)..(17): n equals a,t,g, or c
  misc_feature (81)..(81): n equals a,t,g, or c
cnaggccwrraaccccnaaggctggcactgagctgtgactgctttaacagcccccaagatttggtcagtttgaggtggtgnagactcagattgttgctgaaagttcagtaacacagtcctggtctttggccctagagaaactttttatatgagaagtgttctctatatacatgtttgaggtgactctggaatggattatgaggtcatatctcaaaatgtcagaaaacgttatagagcactcgaacttttgtatttgctgcttaacctcaatattacagccacaaacaaggggtaccaagacaaagtataactgagcataagcagaaaatgttaaccctccaggtttctttcttaagcacaataaaagtgggagcgaacaacacaaggatatttttacatttgacccgtctcaaaagtagcacaccctatccttgtgccattatttgtacaaggaaatatatgattagaaggawtagaacccccagttgtcatcagcttttttagacaccacaggttgtagcagtttgaacaaactgaaaactttatacttctgtgtgagctgaactcaagtttcagaataatcatcgccatgtgggaggctttttgttaaatgcagaagaaatttcaaaatattgtatttatatctgccttccactgctgccaatttagtaagcatctcctatacaatcgacaataaacagcaaatgatgcagttcatagagtattttgcacttggggaaaaatatgtatctgaattgtaaaaagaaatgtttggattttgtatgtcttttttattattattaaaatactaaatgaaactcctcaaaaaaaaaaaaaaaaaaactcga

SEQ ID NO: 2967 - DNA, 545 bp, Homo sapiens
  misc_feature (7)..(7): n equals a,t,g, or c
  misc_feature (16)..(16): n equals a,t,g, or c
  misc_feature (41)..(42): n equals a,t,g, or c
  misc_feature (87)..(87): n equals a,t,g, or c
tcacttncggttccgntcgatgtggtgtggattgtgagcgnntacaatttcacacaggaaacagctatgaccatgattacgccaagncgaaattaaccctcactaaagggaacaaaagctggagctccaccgcggtggcggccgctctagaactagtggatcccccgggctgcaggaattcggcacgagattcgctgcctaattccaccatgatgttttactatgcatgctttatcttatactcatctctctctcctctctctctttctctttctccctccctcctttctctattataatttagtcatcttattttttgaggcatttcagaatatatcacacttgtcctaaatacttcagtatgaacatcattaactagaatttattctttgttttacttctgatgtgaaayttatataaatacaacatgctatgaatttgttttccmaaaaaccaatcaacaatttawtaagcatggkaacaaaaaacctgaaggctttatcttttagagtagtagtttttaaaaaaaaaaaaaaaaactcgta

SEQ ID NO: 2968 - DNA, 617 bp, Homo sapiens
gaattcggcacgaggcggaagatagattaaaatgtctctacttctctttttaaaagttcatctttttagcccttctacaattttcaaaagaaataattagatggtcgctgtaacatttatatgaagaaaatagtttgagacaacctaaatatgtcaatactrgawtaattattaaaataawtcatggccctgtcatataatwgaatactatggagtttggaagaaagcatgatgtagaatatttaattatatgggaaaataatcagtaaatctttttaaaacagaaggtaaaactatacatagttcaatatagtaaagagggccgggcacagtgctcacgcctgtaatcccagcactttgggaggccaagacaggtggatcacctgaggttgggagttccagactagcctggccaacatggctagtctctactaaaaatacaaaaatcagccaggcatggtagcaggcacctgtaatccaagctacttggcagggaaggcaggagaattacctgaacccagaaggcagaggttgcggtgagccaaaatcatgccactgcactccagcctgggcaccagagtgaaactctgtctcaaaaaaaaaaaaaaaaaactcga

SEQ ID NO: 2969 - DNA, 928 bp, Homo sapiens
ctgcaggaattcggcacgaggcagggtgggtgcatcaagggggttgtgcggtggctgacaagaggttgtaatgtggggaagggcaggagcgggctggtctttacccactgccatccccgtcctcttattaaatagagattcctagtattgctgttataaaaaatgtcctgctaaacatagttctctcaaaaatatttttctgagattctctgacaattaaatctggatcccagccccaatattcacctgcaattacattatggatgaaattaaatgtgcactttctatggtgtacatttatttttcaaacctcaggaagccatattgagctcttaatctcaggtcaagtgtcttcttatatcccctcccttgatttttgtactcataaggttgtatccagagagaagtttgaggaataattcattacctgggaattaaagtaaaccttgagcttgggagtcctaacatataaccatctctaaaattctgcaactgtagatttttaatcatctaattttagggacttcaaaatatttttctgactttacctacattcgaattaagttaaaatagcactgataatggatagtaggatccaaacagaaacattttaaatgaatctagttaagtattgagccgggcacagtggctcacacctgtaatcccagcactttgggaggccgaggcgggcagatcacctgaggtcgggagttcaagactagcctgaagaaaccccatctctactaaaaataaaaaattagctgggcgtggtggcacatgcctgtaatcacagctactcgggaggctgaggcaggagaatcacttgaacccgggaggcagaggtttcagtgagccgagatcacaccattgcagtccaccctgggtaacaagagtgaaatccgtctcaaaaaaaaaaaaaaaactcgta

SEQ ID NO: 2970 - DNA, 731 bp, Homo sapiens
ggagagagagagaatgtggagaaataggaatgcttttacaccattggagggagtgtaaattagttcgaccattgtggaagacagtatggcaattcctcaaggatctagaaccagaaataccatttgacccagcaatcccattactgggtatatacccaaaggattgtaaatcattctactacaaagacacatgcacacgtgtgtttattgcagcattattcacaatagcaaagacttgggaaccaacccaaatgtccaacaatgatagactggattaagaaaatgtggcacatatacaccatggaatactatgcagccataaaaaatgatgagttcacgtctttggagggacatggatgaaactgcaaatcatccttctcagtaaactatcgcaaggacaaaaaaccaaacaccgcatattctcactcataggtgggaattgaacaatgagaacacatggacacaggaaggggaacatcacactctggggactgttgtggagtgaggggaggggggagtgatagctttaggatatataactaatgctaaatgacgagttaatgggtgcagcacaccagcatggcacatgtatacatatgtaactaacctgcacattgtgcacatgtacgctaawayttwwwgtwtaataataataaaataaaataaaataaaaaaagaaaagatgtggctccaggtttctttgcttctaaaaaaaaaaaaaaaaaactcga

SEQ ID NO: 2971 - DNA, 585 bp, Homo sapiens
ggcacgaggtgaggaccctggctggactgttacagtgacacacagtggcatggggtgtgcaggaaggacactacaccacaaacattttaaggacagaatctgaagtatttgtcaactgagtgatggtgcagggctctggtggtacctgtttaatgatgacagatttactgtttgcagtgatgctagctgtcatgattgagtcctgtaaaagattatattaagctaaaactaactgtaaaaatcagtatatctgtttctttcccttcctttctctcacttctttcccttcttccttccctccttccctccttccctctctcctatctaccaggtgctttgtgctaacttttcattcagagtgttttctgtcccttacaaagctgacagagttgtcaagaggtttcacccactcaacccacattacttgacacacagttacttgcattacaaagcactgcatgaggagctcttggtaataaaggggtgactcaaacacagatcctcccctccagggtcacgtctgtgctgttgaatgttgaaccaaatgactacattactaaataaaaaaaaaaaaaaaaaaaaaaa

SEQ ID NO: 2972 - DNA, 620 bp, Homo sapiens
acgcaggrggccaaggggcctcttccaggctctgggcacctccagctgaggggatgtgggctgagaggagatgagtggctgcaagtggaggaagaacattacctacttcagattttatgcctcttgctctgaaacgaggtcagcttttccttatcccttggcttttcccccagggagtttgcccgttggaaggtgaacaacttggctctggaaaggaaggacttcttcagtttgccattgcctcttgccccagagtttatccggaacattcgcctccttggaaggagacccaatctgcaacaggttacagaaaatctgattaaaaagtacggcactcatttcttactttctgccacccttggaggtaagcaacatcacaatcccaagctaattggttgccagaccattggaaataacgttaagactcgtgtagcgtagctccaacagtcttatcttcytccgggccttttattgcctgagaagtctttctggtgcatttgaaaacagtgcagtctcttcacatctcaatttaccccagaacatctctatttaattattccctgaggaggggaagttgggtatggcggttggaggtggacaggctcctaaaaaaaactcga

SEQ ID NO: 2973 - DNA, 612 bp, Homo sapiens
gaattcggcacgagagcgtgttattctcctgcctccagatcatttaggctttggtaaaacctcggccaatttggctataataaaatagatttccttgagggcaggattggttagggggaacagaaagctctgggtattatttcaaaatgatttattttctcctcctcttgcctgaagcacaaggagagttctcatcgattttcacagtgagaacctggtaggtaatactcatttaagcatgggatcctgtgttcgtccagacccttggagttttaaattctcagggtggttcaacctgagttaatttgtcaattatggtttaaagtgttcctatggatgttggctttagctgcaggctcctgtatccacctccctctctagtttttgagatggcagtttgtttcatgacctctatgaagagctgccatctatctatctatctatctatctatctatctatctatctatctatatacctatctacctatctatgagaggagtcttccttgagcccaggagttcaaggttgcagtgagccatgatcatgccactacactccaccctcagcaacagagaaagacactatctcaaaaaaaaaaaaaaaaaactcga

SEQ ID NO: 2974 - DNA, 1162 bp, Homo sapiens
  misc_feature (340)..(340): n equals a,t,g, or c
ggcacgagctgattcctaaggaatattctagccaaatcatgtatctgtggtttagtttttctacagtagggctgtgcggttgctgcctgctttatagggcatgtgggtttatatggtatctgctgttacttgggcacagcagcaccaactcattacaggatggaggggcagaacgcccagagcacccctgggctcacgtgcggtacagctgcaggagagagctgtccttttggttttatgtttttaattaattctgtttcctcagattgatgattaaatttatttttccagcctgaccaagaaggcgtcaccataccagatctggggagtctctcctcanctctgatagacacagagaggaatctgggcctgcttctcggattacacgcttcctatttagcaatgagcacaccgctgtctcctgtcgagattgaatgtgccagtaagaaaatctttactttttgctaattagcagattttttttttttggaactgtaagtgccattaagagtgggagagggccaggcacagtggttcatgcctgtaatcccagcactttgggaggttgtggcacgtggattgcttgagatcaagattttgagaccagcctgggcaacatggcaaaaccccatctctacaaaaaacacaaaaattagccaggcatgttggcacgtatttgtagtcccagatactcaggaggctgaggtaggaggattgcttgagcctgggaggttgaggctgcagtgagtcatgatcataccactgcactccagcctgggtgacagagcaagactctctctttaaaaaagcaggagatggccaggcagtggctcatgcctgtaatcccagcactttgggaggctgaggcgggtggatcacctgaggtcaggagttcaagaccagcctggccaatgtggtgaaaccccatgtctactaaaaatgcaaaaattagctgggtgtggtgacgggtgcctgtaatcctaggtactcgggacgctgacgtaggagaattgcttgaacccaggacacagaggttgcagtgagctgagatcacgccactgcactccagcctgggtgacaagagcgagactcggtctccaaaaaaaaaaaaggagaggaggattcaacacagttgatgatgacaaaaaaaaaaaaaaaaaaa

SEQ ID NO: 2975 - DNA, 803 bp, Homo sapiens
ggcagaggtcaatccaggactacaaacacctgtgccaagacctgagcttctgccaggacctgtcatcctccctccattcggacagctcctacccaccggatgcgggcctgtytgacgacgaggagcctcccgatgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgcctcacctcacaggagggccaggcatgtattcctcagaggcgaaactgccaaactctttctcctgtcttgggttggctggcactggggcgggcatctagggtacagcctctgctcatggcactgggcctccagttcttccacatgtgtgcacccccagcttggccaaccctcagccttgcggtggggcccgaagcatcttcccttccgcttggcgtctctgggattgggatgagtgcctggctcccatctcctcctcaccttttgttgctatcggcagctgctggctcaggggcatcccamctccgggctctgggttcctctgccctggaagggctccaggacccgtcccaataaccacccacggccagkargccaaggccccgtgctggatatttaaatttaggggccggtctccagggcgcgtagataaataaatacactcagcgtcaaaaaaaaaaaaaraaaaaaaaatt

SEQ ID NO: 2976 - DNA, 2923 bp, Homo sapiens
  misc_feature (1882)..(1882): n equals a,t,g, or c
  misc_feature (2829)..(2829): n equals a,t,g, or c
  misc_feature (2899)..(2899): n equals a,t,g, or c
  misc_feature (2911)..(2911): n equals a,t,g, or c
ctcctcctccggggccccctcctccccctttmactggtgcagatggccagcctgctataccaccaccgctttctgataccaccaagcccaagtcctccttgcctgccgtgagcgatgcccgtagcgacctgctttcagccatccgtcaaggttttcagctgcgcagggttgakgagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtaggggaggaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaaggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtccgggcagagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaaggtttcttttcttctgccctnaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaagtgctttcatcagaaccctaaaatggtcgttgaaggcgcctgggccgcagccagcagtagttggagaggcaggcagagggcagtggttctcccaaataggagacctggggcctggccaggcagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgnagakcstctgggctccacttatgcatatgcaccaaaaaaaaaaaaaaaaaaaaaaggggggccgctctanaaggattcctcnaaggggcccaag

SEQ ID NO: 2977 - DNA, 1398 bp, Homo sapiens
gggagataggaatggaattgatggctttattcttcagaactaccaccgtagcagccatggcaagcaggggcgcccttgcgttgttcttgaggaaaatattaagtgaggctaaattcaaactgagcctgactccccaacccccacaacccttttatatatatatggcatattacagtgagaatttctttttaaagttttaggtctttgtctttttcttgataaaattatagttataatagttgtcataagttaatcaatcgtatgttttaagtgcccttagtgcaaaatttgatgcccctggatactgttgatttattaatatgaaatatacctttgttaatttttaattttatggataggtgtatatgtttatggggtgtgagatacaacttactctatttacgttacttaccgcagaaccacatatttcttccaaatgtccatgccctatcttagttacaaaaacacaatcatttgccaagtgaattatcggtgattattagaaatcatttatactgtggttctgtgtgcatttaaactataatatacttagaaattattcttgctttggtaaaatactttccttcttattcaagaggattttttgggtcatgctgtcttgttatatactcttttaagtttattatgattgtgtgtgtatatgtttgttttttctttttccttctgtctgaattctgttgcactgagcaatgttgtaatatttttattttaaatataagtaatatttaaaattactggaaatatgtaaccatcagattattatctcctaatgataaacagaatttgttaattaagctaaacctagaattgtagacaattatttttacattgcatctacattaaaatgctatctcaaacacacatacttggttgtgtaatatttatctactcattaagtagaaagagtaaattaaaaattgcttttggattattgatgagggtggattatactttagaacactttattcaaacagttcttccacatatctcccttttgacttgactgagcaactctctttctgtgcttcggtttggtctctaagtcagagttaatatttcttgctctatctagcatatagaagcattgtgggctgggtgcagtagctcacacctgtaatcctagcactttgggcagattgcccaagcttaggagtttgagatcggcctgggtaacatggcgaaatcccgtctctactaaaaacacaaaaaaattagctgggtatggtggcgcacgcctgtaattccagctacttgggaagctgaggcgcaagaattgctggaacctgggaggcggaggttgcagtgagccgagatttcgccttgcactccagcctggcgagattctgtctccaaaaaaaaaaaaaaaaaaaactcgta

SEQ ID NO: 2978 - DNA, 1423 bp, Homo sapiens
ggcacgagcttgaacatatataatgaagaaatacagtggctctttattaaaaataatagttggataatataaactgaactatttatgcatttttatatacttataaatccttccaaatagttttaattctatccttttacatataaataacttaataagtgtgctggaaaaacacagatgttcacagcaccactgttttttttttttttttttgagataataaattccatgagaaatctgggtttgaatatttgtttactttgtctcctaattgaacaccactccaggccttctgtctgtctcccctttacccccaaaatactcacaaaaaaattttaagacaacaagtaaccatatataggtgtttgaatgattttctcatttttatctaatttcatttcataagtcccgagtaatttacctaccataggctactatactgataatataaatgaaaccgaacattttttgctactaactctccccaatttaatgtgttttcgaaataaaaatttaaatttttttccttttaattaaaaagtcatctttgaagtccttattggctgtacattttacatgtttgctggtactattattttgtcagtcagttaaagctggcatgtacagctcttggctttaatgaaaagcacattgacataatgttagtaaattccaaaccccggcacagaatgtgagttaaaattaagtcttgctgggttagtgtacaataaactatacctacagacttttttttaatagaaagaagacaaagctgctggtataggatttgtcctttgaagaaaaaatgagggaaacaaacacaaaaacccaatgcagtgtataaataacattttgttcaactacctcttaatgtggaattatctactttaatagtttcctgacagtaatgttaaatagtaactgccaaatttgttattttcccatctctcttaaaaaagtctttatgattattttatatagttttgagaactttaaagccacttttttttaaccttacatttgcataaaaatgtttagcttttaagtagagagcaaattatgatcatatattttgatattcatgacctgtttgactataggagttttttttaaaaaaatgcactttggctataaaaccatggatgatttgatccataagatttaaatgtgccaccattatagtattcctagacatgagcttgatgaatggtattctgtaattataacgtgccccacattattgtgtcttaattgcccttagcctgaattttaatgatcaatttgttattgttgcagatgtgaatattgtgcataaacttactaaatttatgtaaaattgtataaaatagaattagaagtcactaagttctttctgtgtagaagtaataaatttattgtaacacaaaaaaaaaaaaaaaaaaaa

SEQ ID NO: 2979 - DNA, 1605 bp, Homo sapiens
cccccgggctgcaggaattcggcacgagctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctgggtgagtgtacagggtctgggagggaatgggcagggtccttggaccagagtaaccaggctagaaggaaagggaatggggggcatgttagggaaggggtggagagcagggtctggcaagtgactggctcttgtccctacagtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaagctgccatgccccgaggcatgcaggtaccaagctgccttccaccatatcctttggggaggccttaagaaccagcttggggacgacgaagcagaaagcttgaggacaattgggaagctgggttgccgggttagtgctgattgttggggaaatgctcacagtgatactgccccactctcaggtacctccttaggccaggtctccttctccaagctgggctcctttggtgccgtcattcaggtttgtactcatcttgtatccttctggaaacccatcattgcctctgttcagcaaacctgtctcctgggactctagaccgagcacttcttggactttgtctcctttgggactctgagcaacgctgatgggaagtggggcaagttttcatcaacctcaggttcagaaagaaggaaaagacttaatttgaaaggagggctggtggttcagtagaatctgatcagaagaaaataaaaagaggccaggtgcagtggctcacacctgtaatcctagcactttgggaggctgaggcgggtagattgcttgagtttaggatttcaagaccagcctgagcaacatggtgaaacccggcctctacaaaaagtacaaaaaattagccagacgtggtggtgcgtgcttgcattcccagctacgtgggaggctgacgtgggaagatcgcttaagcccagaaggtcaaggttgcagtgagctgaaatcgcaccactgcactccagcctgggtgacaaagtgagaccctgtctcaaaaaaaaaaaaaaaaaa

SEQ ID NO: 2980 - DNA, 1951 bp, Homo sapiens
  misc_feature (1948)..(1948): n equals a,t,g, or c
gctgcgcggctgctggaccgacgggcgcacccaggtaggggggcggctgagccgcgcagtgcggaccctcgcggggaactgcgccgccgccaccatgtctcaggaaggtgtggagctggagaagagcgtccggcgcctccgggagaagtttcatgggaaggtatcctccaagaaggcgggggctctgatgaggaaattcggcagcgaccacacgggagtggggcgctccatcgtgtacggggtaaagcaaaaagatggccaagaactaagtaacgatctggatgcccaggatccaccagaagatatgaagcaggaccgggacattcaggcagtggcgacctccctcctgccactgacagaagccaacctacgcatgtttcaacgtgcccaggacgaccttatccctgctgtggaccggcagtttgcctgctcctcctgcgaccacgtctggtggcgccgcgtgccccagcggaaggaggtatcccggtgccggaaatgccggaagcgctacgagccagtgccagctgacaagatgtggggcctggctgagttccactgcccgaagtgtcggcacaacttccggggctgggcacagatggggtccccgtccccctgctacgggtgcggcttccccgtgtatccaacacggatcctccccccgcgctgggaccgggacccggatcgccgcagcacccacactcactcctgctcagctgccgactgctacaaccggcgagagccccacgtgcctgggacatcctgtgctcaccccaagagccggaagcagaaccacctgcccaaagtgctccaccccagcaaccctcacattagcagtggctccactgtggccacctgcttgagccagggtggcctcctggaagacctggacaacctcatcctggaggacctgaaggaggaggaggaggaagaggaggaggtggaggacgaggagggcgggcccagggagtgacccctgccaggtgcagatacaaaccagacacggtctgtggctactttgtgttattataagatatgagctcaaaccgagatatgaatgaccttggggagccatctgaggccaagatattgacgggggggattcctgggtcccattttcagcgcccagggtcacagatccacagtgggaagttctgtgggacacattggcactgagccacaaagaaggtgtggccagaacaacttgggctcctgctgaccaatgtcctctagggcctaggggacagaggaacacagagtcacagcttcaggggccgaatgagcatggcggccttcctgagagaatatgccccaccacgaaactcagcccagtagacaccatcctggtagcggcttcggtagtggccgccgtggtgccacacaccgttgaggttggagtgggcacaggcatggtaccaccagcctccccgctggtacagggcacagttacctgaggggagagagagagtccatgtcctctcaccagaataaaagcctctacctgcacctcacagtgcaaggcttttgccaggcatcccctggcccctcccattcttattgaatacaagccctgatcttccatctcctcagcaaaaaaataggagccctggccccccaactttcttcagagtaatagccttaattccttccctatctccttaccaaagtacaagtcacatctttcccaccttttctgcaaactaggagtctaccgttcattcctttatcaaagaaaagtatctacttcctttctagaataagagtactagctctcaccctctgccctttacttgaacaggagtcttgattctttttttgcctcatcagagaaggaatctggactccccatccccccaccaggataaaagtcctgacctttgttctcttgacggaataaaagcttgcttatccttawaaaaaaaaaaaaaaaaaaaaaaaaaaaaaaaaaaanaaa

SEQ ID NO: 2981 - DNA, 1410 bp, Homo sapiens
cagatcagggtcttaagaagattatctttcatagtgcctatttgatggtaatgatcataaatacagtataatagaaggaaaaatatctggtggcttatatgcattggtagtttctcatggtaataagcatttttttttctcttccttttagcacaagtgcatacaccttgatagcaccaaatataaaccggagaaatgagatacaaagaattgcggagcaggagctggccaacctggagaagtggaaggagcagaacagagctaaaccggttcacctggtgcccagacggctaggtggaagccagtcagaaactgaagtcagacagaaacaacaactccagctgatgcaatctaaatacaagcaaaagctaaaaagagaagaatctgtaagaatcaagaaggaagctgaagaagctgaactccaaaaaatgaaggcaattcagagagagaagagcaataaactggaggagaaaaaaagacttcaagaaaaccttagaagagaagcatttagagagcatcagcaatacaaaaccgctgagttcttgagcaaactgaacacagaatcgccagacagaagtgcctgtcaaagtgctgtttgtggcccacaatcctcaacatgggccagaagctgggcttacagagattctctaaaggcagaagaaaacagaaaattgcaaaagatgaaggatgaacaacatcaaaagagtgaattactggaactgaaacggcagcagcaagagcaagaaagagccaaaatccaccagactgaacacaggagggtaaataatgcttttctggaccgactccaaggcaaaagtcaaccaggtggcctcgagcaatctggaggctgttggaatatgaatagcggtaacagctggggtatatgagaaaatattgactcctatctggccttcatcaactgacctcgaaaagcctcatgagatgctttttcttaatgtgattttgttcagcctcactgtttttaccttaatttcaactgcccacacacttgaccgtgcagtcaggagtgactggcttctccttgtcctcatttatgcatgtttggaggagctgattcctgaactcatatttaatctctactgccagggaaatgctacattatttttctaattggaagtataattagagtgatgttggtagggtagaaaaagagggagtcacttgatgctttcaggttaatcagagctatgggtgctacaggcttgtctttctaagtgacatattcttatctaattctcagatcaggttttgaaagctttgggggtctttttagattttaatccctactttctttatggtacaaatatgtacaaaagaaaaaggtcttatattcttttacacaaatttataaataaattttgaactccttcctggtataaatgggtccat

SEQ ID NO: 2982 - DNA, 2006 bp, Homo sapiens
  misc_feature (70)..(70): n equals a,t,g, or c
ggtcacgaggcacttttggtaagccagggatcgtgtgggtggtacggagttgccacatttcggcaaaggnaactatgtagctgatcttggagccatggtggtaacaggtctttgagggaatcctatggctgtggtcagcaaacaagtaaatatggaactggccaagatcaagcaaaaatgcccactttatgaagccaacggacaagctgacactgtcaaggttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcakttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcargggtgagctcttcctcttctggaacctctataaagctccaatactgttggcactagtggcaggagaagctgctggtatcatggaaaacataagtracgatgtgattgttggccgatgcctggccattctcaaagggatttttggtagcagtgcagtacctcagcccaaagaaactgtggtgtctcgttggcgtgctgatccctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattgaaaaaaaaaaaaaaaaaaaaaaaaactcga

SEQ ID NO: 2983 - DNA, 1124 bp, Homo sapiens
ggcacgagcggcggtggtcaatgcgttctactccccaaaccgaaaccagattgtattccctgccgggatcctccagccccccttcttcagcaaggagcagccacaggccttgaactttggaggcattgggatggtgatcgggcacgagatcacgcacggctttgacgacaatggccggaacttcgacaagaatggcaacatgatggattggtggagtaacttctccacccagcacttccgggagcagtcagagtgcatgatctaccagtacggcaactactcctgggacctggcagacgaacagaacgtgagcgctgccaccagcacccaggctgcgggggtaccggagccccagccctggccctgagggagagggaagtcagggccggggctgccccaatcctgtctcctgtgcgcaggtgaacggattcaacacccttggggaaaacattgctgacaacggaggggtgcggcaagcctataaggcctacctcaagtggatggcagagggtggcaaggaccagcagctgcccggcctggatctcacccatgagcagctcttcttcatcaactatgcccaggtgtggtgcgggtcctaccggcccgagttcgccatccaatccatcaagacagacgtccacagtcccctgaagtacagggtactggggtcgctgcagaacctggccgccttcgcagacacgttccactgtgcccggggcacccccatgcaccccaaggagcgatgccgcgtgtggtagccaaggccctgccgcgctgtgcggcccacgcccacccgctgctcggaggcatctgtgcgaaggtgcagctagcggcgacccagtgtacgtcccgccccggccaaccatgccaagcctgcctgccaggcctctgcgcctggcctagggtgcagccacctgcctgacacccagggatgagcagtgtccagtgcagtacctggaccggagccccctccacagacacccgcggggctcagtgcccccgtcacagctctgtagagacaatcaactgtgtcctgcccaccctccaaggtgcattgtcttccagtatctacagcttcagacttgagctaagtaaatgcttcaaagaaaaaaaaaaaaaaaaaa

SEQ ID NO: 2984 - DNA, 912 bp, Homo sapiens
  misc_feature (906)..(906): n equals a,t,g, or c
gaattcggcacagagaaacatttcatccccagtaagattcctcatcgtcattcacaggtgatctctgttcccaccctagccttggacaattctgcatctactttgtagctctataaatttgccttttctggacatttcatgtaagtcgatcacacagtatgtgttcctttgtgactggctgcttttgcttagcatgacgttcttggggctcgcaacgcagcttgtgtctgttgttcattccttttgcagcagaatcgtattctgttgtttggatgggccacctgtttgttgtctgtttactctccagctggtggacatttaggccgtttgcactggcggttactgtgaatcatgtcgctgtgaacattgtgtgtgtgtctgcgtggacttgtgtgtcctgttctctgggaaggagttgcgggttagarggtagttttttgtttcccctggagactctctggtttccacatatggtagttttatgcttaaccttttgagaaattgccaaatggctttctgaagtggccacgtcattttgctccctccagccgtttgtaatgttcccatttctcctatgtgtaattttaatacaaagcagtaaaaagttgccattatggacctagtaaattctgaggtaacataagagagaaataatgatgcagccgtcattactgtgctggtaatgtaagtttcctttttttttgtttttaaatggagctttgcagagatcaagtcgagagaagaacactgggccagcctgactccaaagcctactctcttaagcgctttgctgacttgtgatgttttaaaatctagcattattttcaaatgctgtgagagcactgaagataaaggatttgattctttttttcaggcatccaaggatggttcatcatcaagaatcantttaat

SEQ ID NO: 2985 - DNA, 1141 bp, Homo sapiens
ggcacgagctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggagaaaaaaaaaaaaaaaaaaaaa

SEQ ID NO: 2986 - DNA, 1847 bp, Homo sapiens
ttctaacaactagcggaatccaggagcaggccctccggacttttttccttgggtaccagggtactcggggcccaggaacctgggtctgagccctgctcaggtttgtcccagccggctcagcgcactggctgtgtgttgctgctcctacagctcaatgcactggaccttctcgtccagcctgggatgcctctatcatttctctttgtctttctctggcctccataccgttctgaagagctcaccttcctctaggttcctcctgccctgctcttcccaagtgacccagccctcacctgtagggcagccaaggctggtggtgcagctgcccccagtgaaggtcattgggcatcgcactgggcagtgcagaggtccaggctgaggagttgagtggcgcgcccatcctggcgcctgtgcagagaacgggaggggggcccctggcttggatcctagaatcggtgaagtctgagggcccccctgcagtctcagcaggacctgctctatcaaggggcttcctccttcctttccccaccctgtctccttggcggggaggattagtgccaggtgggggaagccagacatttgactgacgggagaggaaggcttgccaggcagcccgaagactgttgtgaaaatggggctgcttttgcaagggaagctcttttactccccattcctgtcctccagaggccccccttttccctgccgtgttattggtgtcaaccctggggtaagtggctggctggactcacccctgctccccgtacacctgtgcctgtgactggcggtccaagctccccacacacacatcttgctggtgcctttccctgaagtcaccacccaggggctggctgtcatcagcccattcttgtcccagcagggtaccgagggaatgataaaacagaatgtgtttgaattacacacaaaaatgttccctgcagcaggtcataaactctgtgaactaatgaagctgacaaacagagctggagtacgtttcccctcacccttcctttcctcctagctcagcaaggggtgctcaggttcaggatgttgtttgttgattcaggctcaaccaggctccgcaagaaaaccttatcaggagattttattttcatgaacaggtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaattttaaaaaagaaaacgtaggaggttcgtttggatgagctagtctcttccggttgaaaagtctgactcggtgagcatcctgacgactccatttccttctggctccccacccagtcttacacttggctgccatcaataccacatgctctgaagggagagtgcttgcatgtactttgccaaatcctgtctgctccatctcagttgaatggaaaaggagggaggtggggctggtagataggtgcttttggtgctagtatccaccaggttttgtgtgcatcccgtaatgagcccacttcctgaaaacatttaaagaaaaaagatatcagctggagatggcagtgcgcacatgtaatcccagctactcgggaggttgaggtgggaggatcactcaaacctgggagtttgaggccagcctgggcaacacggcaagaccctgtcttttttaaaaaaaaaaaaaaaaaa

SEQ ID NO: 2987 - DNA, 1589 bp, Homo sapiens
ggcagagcttttgctctgagaacaatgctaccggtagtttccagtgtgtttgctttgcctttttatttgaattttagaatttattattttaaaattttatcttatttaaatgttattcatttttcttctactaattttgagtatcacagcttcgtactccttgacttgcattctctcaggagctggggagccaagctcggtctccgcttcggtggtttcaggtcccgggttctgtctggcggctctgcttctaatgcggactggcggttttgcagcaacgcttttgccagtagcgcccactgagcggtttttcagttgctgcaccgttcttagcgcccaacggaacgtttcccgtacgcggagtccataagttgtctgtgtcgtcactttctcggttctggcamcgctagtatctcctaggaacttcctaaamccgttttacggtgcagaacggtaattgcaccgagcctctgtgccaactagtacttccgtaataccgttagccggctcttttcctgtcacaacacattaaaacgtgttaaaacacattaaacggattaaacacattaracggattaaaacacattaaaacgtcacaacacatttaaacagagtcggtccattcytccagacagtatgtttcgggatggaagcacccytcctaagaatccgcagtttctttstagcagcaccgttatggcgcytaaacggatatttgtttggcaataccagcgctatccgctaggtgccggcgcttgctgagtctcagcgccgccagattcttgctagcgaggtccagagcagtgcagagacctagcggacagttttccggtggcagcaatgctcatttcccggacacagatggtttttggsccctgaagaactctttaatccctgcgttttgtagcgctcgttctctgtaaggtttgcttartatccgtttcatttcgacttcttttctcgctgtttttctgtcggaattacgatttgttttgtttctatgtgtyctctagaattttaccggttttcatttgtctactaattttcgtgcattcgttactattgagtttcataatatctgggtgccmtctgcccackagctccggagagcataaatacccaggctgatggtagtgctaaaggttctgcttcatctcgtcaatcagcgcaaacgcttatgtcctcctgctctgaggcttaattaagcgatggagcaacattttcttggctatgtgaagcctgcttgagattccgcagaggtggtgcctgagctccagcctcggcctattttgaattcagaagactgtgatattactgtgtgagccaccactttgggaggccagcatgggcagatcacttgaggtcaggagttggagaccagcctggcccaagtggtgaaaccccatctctactaaaaatacaaaaattagccggtgatgatgcatgcctgcaatcccagctactcgggaggctgaggcaggagaatctcttgagctcggaggcagaggttgcagtgagctcagatcgtgccaccgtcctccagcctgggcagactgagactccatcaaaaaaaaaaaaaaaaaactcga

SEQ ID NO: 2988 - DNA, 680 bp, Homo sapiens
ggcacgagcttggaggtctactggcagacttccttctctccagaaaaatcctcagactcatcaccatcaggaaactcttcactgccattggggttctcttcccatccgtgatcctcgtgtccctgccctgggtcagatccagccacagcatgaccatgaccttcttggtgctgtcttctgccatcagcagcttctgtgaatcaggagcccttgttaacttcttggatattgctcctcggtacactggctttctcaaaggactattgcaagtctttgcacacatagctggagccatctctcctactgctgctggatttttcatcagtcaggattcagagtttggttggagaaatgtcttcttgctttcagctgctgttaacatatcgggcctggttttctacctcatctttggccgagcagatgtgcaggactgggctaaagagcagacattcacccacctctgagcaaaccgagagatgtgctagatcctggtgcttagttcatcattgttttccctcacagacatttctctttcatgcctgcttgactgataagccattagctagaccctgactatgtaacgctaaagattttaccatgcctggaaattttacaggggaagaaaacacgctagttatttaactgcaaaaaaaaaaaaaaaaaaaaaaaaaaaactcgta

SEQ ID NO: 2989 - DNA, 1723 bp, Homo sapiens
cggcacgaggtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaatgaagaaattacagaagaaatgtcaagtaatattgaagaaacaatagtttttatttatgtagttgtacatttttaaactaagggcaatacactgacatggttatgtgcataaaaattttgacttaaagaactggaagtttatatacacctggactataagaaacggaagaaaatcagtccacattttacagttagcagaatcctaaatggcactggcctggccaccttttcattttacaaatggggaagtgaatgtgaccccttacttggcataggaagttaacttacacctaataactgacaggtttttgtttgatgacctattaattatgtagcctaggattaatatcccaaaattactctggtttaagtagctttattcagtggcataataacactgttttcttccttaagtcttcaatgaagtgacttaaaacagtcactttacatattaaaaatgaggagagcaattctctggaatctctcctttcagttcctttgtaggatttctggccttgaggatagtcttcatgttcaaaggcactatgcttttattatataacttccttcagaagactgaaccacatgatattctcagccctgttaacactaaaaatatttaaaactgaatgatagtagtgactcattgtattacttaaaacttatataacacgctgtattagatgtgtgtaaattagccaaaggttattttacaaagtgagacattggtttttatgtctaaatgctatttctgaataaatgaaatagtaattagatcaagagctgattagcatcaatgtgtttgaaagatataaaatttatacatcaccttaacctctgtatgcacatgatgggattgataaaatattaaatgagaacaaactagatatgattaggacatttgaaaccctaattgtgaatttatttttaatagttactgaaatgaaaatatttaaaataatgcacaatgtcttaagtcttcctaaatcaagattttggttaaaaaatacttctaataatagtaaaagattttttttttaagtaaatcataaaacggttctaaatgtaaaataaagacatgtaaaataaaaaaaaaaaaaaaaaaaaa

SEQ ID NO: 2990 - DNA, 250 bp, Homo sapiens
  misc_feature (1)..(1): n equals a,t,g, or c
  misc_feature (174)..(174): n equals a,t,g, or c
nggagttgtcttgctcaaatatcaacagtgctgcagtgtagaaacttgatcgttggttttcttttaatgcaaaactctcataaaaacctttcacttttcctgtcattgattatatgcttgatacaccccaaaaagaaaaagggaagggcaccaattcacctacactccaggggntccatcacctttaaaaaatatttattaaaatagtttccaaaaaatctggtatctgaaaagccaatccaagcctgtt

SEQ ID NO: 2991 - DNA, 788 bp, Homo sapiens
gtttttgttgagtataggagttctttatatactctggatattaacctcttattagatacatggtttgcaaatattttctcccattctgtaggttaccttttcactcttgtttcctttaatgggcagaagttaagtttgatatggtctcatttgcctgcttttgctttcattgtctgtttttggtgtcatatccaagaaatcattgccaaattcagtgtcgtgatgctttttcccgaagttttcttctaggagtttttcaggtcttatatttaggttttatcaactacattacgttttatgttgaagaaaaaacackggaatagaattaatgtttaaactgataataaattttcttcccccacaaaacaaaccaccctgaatataaatactgtaaggccactctgtgtgcttgggaaagttgactcagaggtgtcagatcctagtgaaacgattagattttaaagataaaagaagtcctctcgggccaggagtggtggctcatgcctgtgatcccagcactttgggaggctgaggcaggcagatcacttgaggccaggagtttgagaccagcctggccaacatggcaaagccccatctctactaaaaatacaaaacttagctgggcttggtggtgcacacttgtaatcccagctacttgggaggctgagtccatgagaattgcttgaacccaagaggccagggttgcagtgagccaagatcgcaccactgcactccagcctgggcaacagagtcaagactgtctcaaaaaaaaaaaaaaaaaactcgta

SEQ ID NO: 2992 - DNA, 1067 bp, Homo sapiens
ggcacgagcagccccccagggtcctgcatcccaccatgtcgatggctgtggaaacctttggcttcttcatggcaactgtggggctgctgatgctgggggtgactctgccaaacagctactggcgagtgtccactgtgcacgggaacgtcatcaccaccaacaccatcttcgagaacctctggtttagctgtgccaccgactccctgggcgtctacaactgctgggagttcccgtccatgctggccctctctgggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctcccgtgtccgtgatgcccgtcgccacctcggaccaagaaggcgacagcagctttggcaaatacggcagaaacgcctacgtgtagcagctctggcccgtgggccccgctgtcttcccactgccccaaggagaggggacctggccggggcccattcccctatagtaacctcaggggccggccacgccccgctcccgtagccccgccccggccacggccccgtgtcttgcactctcatggcccctccaggccaagaactgctcttgggaagtcgcatatctcccctctgaggctggatccctcatcttctgaccctgggttctgggctgtgaaggggacggtgtccccgcacgtttgtattgtgtataaatacattcattaataaatgcatattgtgaccgttaaaaaaaaaaaaaaaaaaaaaaaaaaaaa

SEQ ID NO: 2993 - DNA, 2107 bp, Homo sapiens
ggcacgagattttgaaatgagattcttttgaaattgtagagaattttttattgtatttatatgataactgggctcatatccaaagtctaaacatcagataattttatgtgtgtaagttcctatctcaatttttaatttttttgctagcatcatggtactgaattttgtatactttcacagtcttaagaatgaatgctgagatttagctctagcttactagaatgcctactctctccattatgtcttacagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaaaaaaaaaaaaaaaaaa

SEQ ID NO: 2994 - DNA, 2150 bp, Homo sapiens
gcggacgcgtgggtcgacccacgcgtccggtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaaaaaaaaaaaaaaaaaaaaaaaaaa

SEQ ID NO: 2995 - DNA, 2854 bp, Homo sapiens
ggcacgaggagaaatcacagggagatgtacagcaatggggccatttaagagttctgtgttcatcttgattcttcaccttctagaaggggccctgagtaattcactcattcagctgaacaacaatggctatgaaggcattgtcgttgcaatcgaccccaatgtgccagaagatgaaacactcattcaacaaataaaggacatggtgacccaggcatctctgtatctgtttgaagctacaggaaagcgattttatttcaaaaatgttgccattttgattcctgaaacatggaagacaaaggctgactatgtgagaccaaaacttgagacctacaaaaatgctgatgttctggttgctgagtctactcctccaggtaatgatgaaccctacactgagcagatgggcaactgtggagagaagggtgaaaggatccacctcactcctgatttcattgcaggaaaaaagttagctgaatatggaccacaaggtagggcatttgtccatgagtgggctcatctacgatggggagtatttgacgagtacaataatgatgagaaattctacttatccaatggaagaatacaagcagtaagatgttcagcaggtattactggtacaaatgtagtaaagaagtgtcagggaggcagctgttacaccaaaagatgcacattcaataaagtaacaggactctatgaaaaaggatgtgagtttgttctccaatcccgccagacggagaaggcttctataatgtttgcacaacatgttgattctatagttgaattctgtacagaacaaaaccacaacaaagaagctccaaacaagcaaaatcaaaaatgcaatctccgaagcacatgggaagtgatccgtgattctgaggactttaagaaaaccactcctatgacaacacagccaccaaatcccaccttctcattgctgcagattggacaaagaattgtgtgtttagtccttgacaaatctggaagcatggcgactggtaaccgcctcaatcgactgaatcaagcaggccagcttttcctgctgcagacagttgagctggggtcctgggttgggatggtgacatttgacagtgctgcccatgtacaaagtgaactcatacagataaacagtggcagtgacagggacacactcgccaaaagattacctgcagcagcttcaggagggacgtccatctgcagcgggcttcgatcggcatttactgtgattaggaagaaatatccaactgatggatctgaaattgtgctgctgacggatggggaagacaacactataagtgggtgctttaacgaggtcaaacaaagtggtgccatcatccacacagtcgctttggggccctctgcagctcaagaactagaggagctgtccaaaatgacaggaggtttacagacatatgcttcagatcaagttcagaacaatggcctcattgatgcttttggggccctttcatcaggaaatggagctgtctctcagcgctccatccagcttgagagtaagggattaaccctccagaacagccagtggatgaatggcacagtgatcgtggacagcaccgtgggaaaggacactttgtttcttatcacctggacaacgcagcctccccaaatccttctctgggatcccagtggacagaagcaaggtggctttgtagtggacaaaaacaccaaaatggcctacctccaaatcccaggcattgctaaggttggcacttggaaatacagtctgcaagcaagctcacaaaccttgaccctgactgtcacgtcccgtgcgtccaatgctaccctgcctccaattacagtgacttccaaaacgaacaaggacaccagcaaattccccagccctctggtagtttatgcaaatattcgccaaggagcctccccaattctcagggccagtgtcacagccctgattgaatcagtgaatggaaaaacagttaccttggaactactggataatggagcaggtgctgatgctactaaggatgacggtgtctactcaaggtatttcacaacttatgacacgaatggtagatacagtgtaaaagtgcgggctctgggaggagttaacgcagccagacggagagtgataccccagcagagtggagcactgtacatacctggctggattgagaatgatgaaatacaatggaatccaccaagacctgaaattaataaggatgatgttcaacacaagcaagtgtgtttcagcagaacatcctcgggaggctcatttgtggcttctgatgtcccaaatgctcccatacctgatctcttcccacctggccaaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacattacttttgaaaatggcacagatcttttcattgctattcaggctgttgataaggtcgatctgaaatcagaaatatccaacattgcacgagtatctttgtttattcctccacagactccgccagagacacctagtcctgatgaaacgtctgctccttgtcctaatattcatatcaacagcaccattcctggcattcacattttaaaaattatgtggaagtggataggagaactgcagctgtcaatagcctagggctgaatttttgtcagataaataaaataaatcattcatccttttttttgattataaaaaaaaaaaaaaaaaaaa

SEQ ID NO: 2996 - DNA, 1972 bp, Homo sapiens
ggcacgagaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataactttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgttaaaaaaaaaaaaaaaaaaaaaaa

SEQ ID NO: 2997 - DNA, 2405 bp, Homo sapiens
gagacggtatgaatttctaagtaagcacatatagaactggatgcccttgtggtacatctcaaggctgatttgaaagcttgagagaccatcaagaattggatttggggaagagcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagagtaaaatgttgcagagcccagctagaagccaggaggagcagacaccctgctgatggagcccaacaagaaagatgttgtgtccctcctggtgaacgctgtcccagtgcacccgataatggcgaagaaaatgtgcctctttcaggaaaagtataggaaatgagagaagactgtgacaactcatgacctgcatccttaatatccagtgacttcatctcccctttcttcaccacaattccaggcaatggcctgtcggaccagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttwacttcaccgcctaacccaaaacctataagaactaatgataatccatcacccttcgctgactctcttttcggactcagcccacctgcacccaggtgaaataaacagctttattgctcacaaaaaaaaaaaaaaaaaaaa

SEQ ID NO: 2998 - DNA, 634 bp, Homo sapiens
ggcacgagctcgtgccgcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatctttcaagataggagatatttcccatccccttcctttgtaaatatctcatctcccactggagagcccaggagcctattcctggcatggatgtattgtacactgacgcgtccccactcctgtacagctgctttgtttctttgcaatgcattgtatggctttataaatgataaagttaaagaaaaaaaaaaaaaaaaaaaaaaaaaaaaaaaaaaaaaaaaaaaaaaaaaa

SEQ ID NO: 2999 - DNA, 1560 bp, Homo sapiens
  misc_feature (8)..(8): n equals a,t,g, or c
  misc_feature (1428)..(1428): n equals a,t,g, or c
gagagagngagagaggtatcactgcaaggctactatgagtattttcaaatcaccacatcttatcctgagcaagaggtcactgttctgtgctatggtaagatacaaactattccttcatatataataaaattccaccttttttcaaaattaatatagggtaagtgaagtctmccaatcatgacrgcaraggaaattagtgtctaaatgractgtgrgttacaggtacctttcactwaggggcaggcaggtttttataaaaaaccmtgtggtaatcatcmattgccattaagctcctattactagcttttaagaccattttataaagattatctggtgcctaattaacaagaaagaaattagactcaggtttaagatgctgctggtgttctgaaattactctgaaaggtcattcaaagaacttcaaacttaaaatttttcattcatgtatttattccacagtcaaaataaatcaaaatttaaagctataacatttttaaaagataaaggagaatttgtggcacagctgcattaacaaaacagacaccagtctaaagtgcaacactaaacaggtattctctgttcccacggtggaataaatacacacaattacacataagatttcactaaagataggagatgaggcaaataaccctttgaaattacctgcccaacaaatagaggcaggctacattaatttaacattttactgcaaaatggaaaaaatccccgaggtgactaactcaaactcctcatttcatgcacatgaccttggcttctgtgttctttccatagccacatccaaatccagaaaggctcctgcaccccatgctcaaaaatgcaacctcaagtccctgaggtcctcagcacagactgacattaacaagcctgtgttcagccttcatccagaacctccagggaaatcaggagcacaaacacagagcaaagcaccgtttctttaaacaatggctttaactgtcgaatgagctctgacaagccatatgcatttcataaacaaaccaaaacatcatcttcatatcttcctatttttcttgcaaaaatgttaagccatccaagtaaaaaaaaaaattttaatttaacaatgaaaaaggaacttcaaagggtttatgccaaaaaacaaaccagtcctctgcagcctaactcatttgtttttgggctgcgaagccatgtagagggcgatcaggcagtagatggtccctcccacagtcagcgccatggtggtccggtaaagcatttggtcaggcaggcctcgtttcaggtagacgggcacaccatcagctttctggaaaaacttttgtagctctggaactttgtttttcccagcataatcatacactgtggaatcggaggtcagtttagttggtgtggcaaatatgataggtggtgcttctgtggaaaccacaggctttnaatctgcgggctataggcctccgaagcccatgctcctgccaacttctgcgtgaagccactaaacttgtagtacatgacgcccagagtccggcttcccgcatccgctgccaacgcgaccgccccagagaagga

SEQ ID NO: 3000 - DNA, 2954 bp, Homo sapiens
acggtggaaacacccaactcgatttattgaaaaactrttacagttaattattcctttgttacacaagtttagaatattttaagatatcctttcctgggcattacagttaaaacttatgacatgtctagcggattttttgaaamcgtacaatgtgtcatttgacattgtatttcaaaaggcctgatgtcctcgaaactttatcttgggttttttgcttaccatttttttctttttgccagcgtttgtccaattatatatattgagaggaaaaaataaaattacaccaaaagaatttctgcaaatataagaagtaattttattgcaatatactgtggctagagtggtctggggagaacgggacacattttgaagttcagtacaaattataacaactttgaagggaccacagaggaagaaaatgacaggagaaaaggacaaattggatgggatgagaaatgaaaacagaatcacatgacctagacgcagtccacgggggtcgcgggacagtcctcggctatggcttttcttttgaagagatgaaggtgacagtcattggcacatgctggcatcctgggctccagagactctccaagccagacttttctttggcaagagcgagacttactttccagggaaatttggaaaatccacgctggcggtgttttgttcctcctgggtggcttgtttgtggcttcctaagctggaactgcattctggtggtggtgggggtcggggacagcaccagagccccgcaggctcaccccaagggcccagcctgcatttcccatggtagaaggaaaaggcgctgcacccgggcaacttttcacagtgaagagatcgcctttcctggctgcccctcgggtcctcctgcccacagacggcagccccccgacctcgatggccaggaaagggttccccaaaggggacctcacccgccccgagctctggagccgctgacgctcgcatccaggacatttgagatgggaatccaaataggctacttggaaaagacgtgctgcaggcagccctggagagactcatggagttcattgtacattactccatctaccgaggcagcgcatggcatgactgaacggcttggaacaaacacagaaattagcaccacaaacattcaggaaccaaatataatctgctatggtcacaccacagacaatgcaggaagaggctttttattgcttgtgtgtgttttcaaatcaagtaggcacaacccagtcctcataacagccctcgggagtggacgcaccggggcgggagagcgcaggagggagtgtgcttggctatcctgcccagtggaaaggaaagtgacgtgcattgatcttagagtccttggcaacagactgtggaggcaataacaggataaagaaagcagggagaacgaggcatggccagggwccccagtgcgccttcaaggagaccttaaaacagatagcaccacaagagagccacaagagagaagtgtaaaaaataagcaccaattttcattgagttatcacctacaaaaaatgtggtttccctgccctggacattctcccatcaggctctgcgggaagaaaagcggaaaaaggaagcaaataaaattaatccaaacctgtgttttagtcttaagtgcatgtagaaaaaagaaaattatcaaattttttccctccctattaaaaaaaaaaaagtctagagcgaatcaaaaactgtctgaaaaggggcactggtacctgcttttcaatggcagcataaattcttgctgccccggggcaaacttccaatttattgcacgttcttggccagggckggggtggggagacttcctatttctaatcagaacggtactgcaacccagaatccatgcctcgcccattctgtccgtgggactgagactgggtttccgtgcatgattgaaagccaggcacacttaacatttataacaatacaatacaaatatttacttaaaactcacaaaaacataagcacctttaatccatcgggaaggcacctgcagaatgacatttggcctctaaatggatcgtgttggaggttgttaaaaacggaggctttggtgatggtgggatgacctttacgaggcttaccttggaacattttttgaaggtcaggggaaatacacatcttcaagttgaatttagaaaaaaatatagtgtccaaatctggcagtccctcccccaacccctgagacctattcacgaacaggatgggtcgggcgagctggggggctggaggcatggccccgctcccggggcgcatgggtgtggacagagcgtggggcgggcccaggcgctggggtgcagctaggtcatgtgattcagctccaggtgggggcgcggctccttccctctgttctctccgggctggggtcccacaccccgtggtgccgaggcgtagatgaagtcaggtgggaggggagggagaagccttcactgtccaggatcaggacgtgcacgggacactcacgaacgaatggcatgctgaggtcacgaggttgctctcgggagcccgggctcggcggctcctagcccatgaagcaagccggccccacttcaaatccaaatttctgtgacgcttcaccgaagtcattgaacatgatgtccacgatgggcacctgctccactttgggggtgtcgatctccagaaccgtcttctggtagcctttcttggtagcacagccgtccaccagggcgcggatgtaggggttgttgtcataggacatctcctcgtcgttggagcccaggaagcggagggccttgtcgtagctgcccgtggctgcgtcctgccaggccactgactggtagcagtggtaggtgacgttctggtgggcagaggcgctcagcagccgcaggaaggtcatctgtggtcttctcgggggaactacctggaaacgcactgtacccacagacccggccgaggccagcgcacatcggacgcgtggg

SEQ ID NO: 3001 - DNA, 1251 bp, Homo sapiens
gcccacgcgtccgcccacgcgtccggcggtgcggagtatggggcgctgatggccatggagggctactggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgccatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacagtgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcakaatagatactcaatatgtgaatatgtgtctactagtagttaattggataaactggcagcatccctga

SEQ ID NO: 3002 - DNA, 2550 bp, Homo sapiens
gacgtgaggagcgttccatttggccagtggtgggcggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtggttcaggccggctcccccttcctggtctcccttctcccgctgggccggtttatcgggaggagattgtcttccagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagttttcgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaaaaaaa

SEQ ID NO: 3003 - DNA, 1373 bp, Homo sapiens
  misc_feature (877)..(877): n equals a,t,g, or c
  misc_feature (897)..(897): n equals a,t,g, or c
gatgtgctgctgcctctgctgtacctcctggtccggaagcacatcaacagagcgggtatcgggaacacgtttcagggaggtgccaactgcatcatgttcgtcctctgcacccgcgccgtccgaactcggctcttctctctctgttgctgctgctgctcttctcagcctcccaccaagagcccggctggcactcccaaggctcccgcgccttccaagccaggagaatctcaggaatcccaagggaccccaggggaacttccaagcacctggagcttttgtcctttctagttctgtggcataggtgctgccttcctgggggtaggcamttctgtgagtccctgstgcagggcagaagtgcatgtctgctgcaccagaagcccccgctattgatgctctcggctccattgggagagcagctgccaactcagcttcttctacctcctagatcctcaggcagcaagttccamcggtaccagcgtcctggcccacgggtgggcgttcatctgcataagggtagcagtgagattcgggaagccggtggcccacagctgtggccacagtgcccccacccagtggaccttgatgtcctgaggaccacacagcactgtttacaatctgagggacccacatctgtgcacctatcctctgtgtgattaaataagctgtcaggggccctcagagatgtgtccccatccacacatcatggagcagattcccggctggtcagggtgttaagattctctggagaacccggctttccttggagactttgctcaacagaggaaccakttgccattcaccaggttgaaggtyccctgargttgcatggtgaccaccaggggcaagcacagcccggcgcactgctcagggacagcantctccccgggsctcytggcntctccytccatgggctgctaacccttgccgtagcttgggtttgagtgtcagcacaggccagaatccacactcctgtccccactgtcatcacttcagacacaggttccctccttccaattccaaagctggaacaagggcaggaagaggcgtctcagggaacccccgaagaccccactgtctctccagctcctttcttagaatcctcctcttcttggggagaccaaaggggatgagtagggaggggttctggcttatttacttcttagtttagttttttgtaagtaaagtggccggagagatgagtaatccaaatacgattcctcaggccgggcacagtggctcacacctgtaaccctagcactttgggaggccaaggcaggcagatcacctgaggtcaggagtttgagaccagcctggccaacatggtgaaaccctgtttctactaaatatacaaaaaaaaaaaaaaaaaactcgta

SEQ ID NO: 3004 - DNA, 1863 bp, Homo sapiens
  misc_feature (1836)..(1836): n equals a,t,g, or c
tcgacccacgcgtccggcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtgatactattaangtaacatttagccccaaaaaaaaaaaa

SEQ ID NO: 3005 - DNA, 819 bp, Homo sapiens
  misc_feature (57)..(57): n equals a,t,g, or c
ggcacgagggagagggacggggagggggcgaggggcggaggccgagggggcaggggntgggcggcggccagtgtttacagatgagctttaactgccgcctcaggcgtggagacggagaccccgcagcccggcggcgcctcagcccttcaacgacagtattgagtggtcaggttacaataaaccggagagaaaaggtccgcttgcactttttttagttttcttatttttagacacccctcccctccagggtgatctttaaaaaagcaaaacaaaaaacacgacttttccagcgctcagcgttttttcctttcgtccgaagccgttttctgatttgacttttctcgccggccggtctcaggcccacagacgttccagaggaggagggtgacatttttactccctttttggggctaaccatttatgcttttgtacatcaaccgtgcgcggccggagggggcaggggggcgggggcgaggggcgttccaatcaaatttctaatttctgttaattattaatcccckttttactgcggtttctgttgtcatttttaaaatttttttaattttttttttttttttacttttactttttacctcttgtgtatatgtagggaatttatagggaaatatgtactttatggaataaattttaagaactaaaatatattttattttaaataaagtaatggacctttaatcttacacagctaaattactgattatatatttsctgagctgatttaagggttaaaaaaattgtatcaagagttttattttttgacttcaaagccttcttaataaagcctcttttctacatgtg

SEQ ID NO: 3006 - DNA, 1315 bp, Homo sapiens
ggcacgaggaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaaaaaa

SEQ ID NO: 3007 - DNA, 1144 bp, Homo sapiens
  misc_feature (605)..(605): n equals a,t,g, or c
  misc_feature (1144)..(1144): n equals a,t,g, or c
gcagaatgaggaggcccccgagctggctgttctaacttagaaggaagagaagactggatgggcctgcttgggatctaggcctcttctaaaccctatcctaagctccagttccatggcaaggctcagacttttaatgccatcttaatctgatggttgagcgcttcactctattttctggtgctgcccagccagtgccttctgccatggatgttactggctacttgagaaaaaggagaggggagaaccccttctttcattccaactgcctccgaccccaaagggattcttggctctctggtaaccatggataccaccatgaattttatttggatcctcagcaggttgattctggaggcctcatgctatgactttttatttctcttcctgggatccaccaccctctactctcagctgactgctgcatttaggccaggtctccaattgctttcctccagaaagtgtgttcccgtctagtgaggtagtattgaagcctcggctttccctctggagcctgggaccctgtttacagttgcacatctgggsccctcactgtggggattgatcattctcatgaaggaatcacagttatatggcaactgcagaangctgagctcctcatggtgctataaccccttgggacactcatccagacttctctgaagcagaaaacctgagctccccactcactgccctagaatttatggcaaggagcaaatctacagcattctctcccacctacgtcctgcttcttggttgagactactgggatccttcagaaaagaaacactgggtcccatagctaaattctcaaccgccaggcaccttcagaagaatccagcctaatactggaatttgtgctattatcttcctctccagccccccaactccatccctcaccacagttgtctaggaaatgacatgaattcaatatctaatgtcaaccaatggggagagccacaactccaggagaggttcctgagctgagtcccttaatttctggatgaagaagaccaacaagttttgtccaatgtatttgtttctcagaccttgcctaggcactaaaaataaaatactaggtcattggaggmwaaaaaaaaaaaaaaaaaaaaaaaaaaaactcgagggggagcccgcgctacatcan

SEQ ID NO: 3008 - DNA, 2432 bp, Homo sapiens
ttagatgctgttttagaatacctcccaaatccatctgaagtccagaactatgctattctcaataaagaggatgactcaaaagagaaaaccaaaatcctaatgaactccagtagagacaattcccacccatttgtaggcctggcttttaaactggaggtaggtcgatttggacaattaacttatgttcgcagttatcagggagagctaaagaagggtgacaccatctataacacaaggacaagaaagaaagtacggttgcaacggctggctcgcatgcatgccgacatgatggaggatgttgaggaagtatatgccggagacatctgtgcattgtttggcattgactgtgctagtggagacacattcacagacaaagccaacagcggcctttctatggagtcaattcatgttcctgatcctgtcatttcaatagcaatgaagccttctaacaagaacgatctggaaaaattttcaaaaggtattggcaggtttacaagagaagatcccacatttaaagtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcagtttgtgcctgctgtagaaaaggggtttttagatgcctgcgagaagggccctctttctggtcacaagctctctgggctccggtttgtcctgcaagatggagcacaccacatggttgattctaatgaaatctctttcatccgagcaggagaaggtgctcttaaacaagccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtccctctaaatgatatgtttggttattccactgaacttaggtcatgcacagagggaaagggagaatacacaatggagtatagcaggtatcagccatgtttaccatccacacaagaagacgtcattaataagtatttggaagctacaggtcaacttcctgttaaaaaaggaaaagccaagaactaactttgcttactgtgagttgactgactctaattgaatctgcgtggttttgatactttgatggattccagtggaataaattcaggctgctgaaacaagaaattctgagcccaggaagcgggctcttctttcttcaaaagaagcccttcttgttcatattcaggagcttctgttatattcaaaggtaattctatgtctatctcaactctattgattggttttatagttcattgaaaatcctcaaataaaatataattattactgaaatatgtttaatatttaaggggaaaagagactaatttcagttatacttttaagcttagaatgtatgttcatttccaaattttgtatcataagagttttcaacatagagaaaagctgaaaaaatgcaaagaataaccacatactttccatctaccttcctttgttaacgggttgtttatcatataataatttgttttgtcatatttgctttcactgtctattatctgtttaagtctcataactctatttttagtttgctgaagacttgaaagtgaatcgcatatatcatgacacttcttggagtgtcattaatgggcaggcttttctgttgaagagtggattccgtatgttcttcatagagagtgtttttcagattcttcattgggatattaaaatattagccaaatttcyctctgttttatatatgycagtttatttcagtttgtggtttctgcaaatttgtaactgcctctgttttaggagtataagtattacttccttgtggtctattgtgaagtaaaaagtagacccttgcatatactattcttgtttgtgttcatcttaatgtttttgtacagctaaatcaaatgtaatttatagagttagtttcatcaacctaatgaatgctagttaaatttgaattccttggaatttatcgtatattgtattcactgagattatgaagggacaaatgttaatcttttgtttccagaaaaagttgggctttcccaagcagttctattacccggttcagaattgcttcatccaaaaatcatctgatggtatagatggatcctagtccttttcattacctgatggtagaaataaaataattgatttta

SEQ ID NO: 3009 - DNA, 1133 bp, Homo sapiens
ggcacgagctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcaaaaaaaaaaaaaaaaaa

SEQ ID NO: 3010 - DNA, 1411 bp, Homo sapiens
  misc_feature (1391)..(1391): n equals a,t,g, or c
  misc_feature (1403)..(1403): n equals a,t,g, or c
ggcacaggagcgacccgggagaaggagggccamgakgcggaagcggaggagtctccaggagacccggggacagcatcgcccaggcccctgtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaaccagtgaattgaaagcacatctgaaagatgcaattcaccatggagctttgtctctggcccttatttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctayacttgttgcaaaaaaaaaaaaaaaaaaactcgaggggggcccggtacccaatcgcngtatatgatcgnaaacaatc

SEQ ID NO: 3011 - DNA, 911 bp, Homo sapiens
  misc_feature (6)..(6): n equals a,t,g, or c
cccgcnggtaaagggaacaaaatcgtggagcgccaccggsggtggcggccrcgtctagaactagtggatcccccgggctgcaggaattcggcacgagcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagrtgaagatgactctcmagaagaggamgaagtcaggtmagtcctaamatgcaataaaatgagtcagtaagtcttagttagacaatttctccactattcaaatacaaatggaatagttagggtctgtaacttagtttaaaactaatatataggctggacacggtagcttatgcctataatcccagcactttgggaggctgaggcaggcagatcacctgaggtcaggagttcgagatcagcctggccaacatggtgaaaccccgtctctactaaaaattgaaaaattagccaaggtgttggtggacatctgtaatcccagctactcgggaggctgaggtaggagagctgcttgaacccgggagcggaggttgcagtgaggtaacggatcacgcmattgcactycagtctgggtgacaagagcgagactccatctcaaaaaaaaaaaaaaaaaaaaaaaaaaaactcga

SEQ ID NO: 3012 - DNA, 634 bp, Homo sapiens
gaattcggcacgagatcccttgacccctcgggtaggcacagggtaggtgcagcagggatggggccagcgctcatggtggcctctctgtgcctcggtggacctgccccagcagtgggagccataaccccctcccccttcattacttcactcaggtgggcaccttcccctgcagggtgtctgccctcagggaactcaaggactctcagagacaccagggcagcctggcccagaggagcaacagccaggcccccaggaggacagccatggagagaactgagacccacttacagtggggtctgggaaccctgcctgtacctggggtycagtccctcccaactccctccttgtgtcttccccccagcaaaggtggggtgaccacttctgtagctaagcacctgctccccggctctcttcacccaggacatctgtctctctggagtgtctgtctgtctgtccctccctctctgaacctgcttcctccgtgtcccctgctcctcgcccctgggagcccamtcccmctccttgcggctccctcccatctcactcaaggttctctgaggacattaaagtggtggattcaccctgaaaaaaaaaaaaaaaaaaaaaaaaaaaaaaaaaaaaaaaaaaaactcga

SEQ ID NO: 3013 - DNA, 2743 bp, Homo sapiens
tgaacccgcccctctcccagagtggagctgcggggggcgggaacaggcacggagaaaataaacaagactaaaaagtcctgagtagcgctgtgtggccgcaaacctgaacccaccttttgcaccacgcgggacccggcactcttcctgccacccacccctgagagggtgcgcggccgaccccagtactagaaaacactcgtcacctcactcaagacgggtacgaaggccaacggacgccttcctttagaacgctcagcacacagagcaacttctcacgcctactctcaaatggcgtactccaaactagcactcccgacgtccagctgtgaacccagagcggcggaaagccctggaacccagcgcccgggcatgygcagacgcgttgttgtggtgggcgtggctccctccggacccggcgccccggcctgccgccccgtgtccgcatgcgcgactgagccgggtggatggtactgctgcatccgggtgtctggaggctgtggccgttttgttttcttggctaaaatcgggggagtgaggcgggccggcgcggcgcgacaccgggctccggaaccactgcacgacggggctggactgacctgaaaaaaatgtctggatttctagagggcttgagatgctcagaatgcattgactggggggaaaagcgcaatactattgcttccattgctgctggtgtactattttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacaggtgctcgcatttggcttttcgttggtttcatgttggcctttggatctctgattgcatctatgtggattctttttggaggttatgttgctaaagaaaaagacatagtataccctggaattgctgtatttttccagaatgccttcatcttttttggagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcatttccatgctagccatggtcatctgacagtctctacrctgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactcttaaactaaaaaaaaaa

SEQ ID NO: 3014 - DNA, 534 bp, Homo sapiens
  misc_feature (456)..(456): n equals a,t,g, or c
  misc_feature (489)..(489): n equals a,t,g, or c
  misc_feature (527)..(527): n equals a,t,g, or c
gaattcggcacgagcaagggtggaacctgagtctgcttgtctgtttgccccatgacagcccaggggtggtggsctcaccccacctccaggcamccacaagaatataaaatcttgtacaargatgtcgatattactattgscattcccaagtgcacctgcacctgtagtatcaggtggtttgcagccttggctgcatagctgcatatgagaatcacctgggaagcttttaaaaatcccagtatccccacctcttccccagttacagtggagtcttgcgggtggtgggggacatcaattatttttgaaagctccmaagtaattctggtgtgcagtggggtgaccagctgtcccagggamctcctttaaaaaataatatcccgggcacatgacaggccaattgccctaatgcaaccaaggttaagaactactggtttaatgggaaaatatttttttccngtgcttgaataatactggttttattaaactccngaatcccatttctttccttgccaaattttttaaaggcnaaaaaaa

SEQ ID NO: 3015 - DNA, 1863 bp, Homo sapiens
  misc_feature (172)..(172): n equals a,t,g, or c
  misc_feature (1820)..(1820): n equals a,t,g, or c
  misc_feature (1826)..(1826): n equals a,t,g, or c
  misc_feature (1833)..(1833): n equals a,t,g, or c
gaattcggcacgaggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggaccnatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcctggccaacatagtgaagccccgtctctactaaaaatacaaaaaattagctgggcatggtggtgggcgcctgtagtcccggctgcttgagaggctcaggcaggagaatcgcttgaacctgggagtggaggttgcggtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagrattgatcaggtttaagtcatcctgctcaggttggggcatagtgggntcatgnctgttantttcaggcatttggggaagccaaagtggaa

SEQ ID NO: 3016 - DNA, 1092 bp, Homo sapiens
gtcacacggtcgaatagctccttcttctcagtaatacaagcttttttggtttgaaatatggatcctcttcccagcataataatgtgattttttttattcattttatgttattatattcacatttttacttaaaggaaaatgctgctatttgtgatgaaattgctcgtcttgaggaaaaatttcttaaagcaaaagaagaaagaaggtgagctggcttcattttgtgttcagcatcacctttttggtgattgatttggtgattgataatggtgttactgctctggagactttttttcccagtgggattgatgcgtatcgcacagccccttggccacttgatcaagcacagagaaacttacagcctgaggcattggtgcctgcacacccaagttatgttgggccatggcgatgagacagctcctctactcatctttctgaaaaagccatcttgccacatctaataaataatcttactaagattatttaatcttatggcccaattataaaagccaagtgataaaagcaactgcctctcgttctacaaatatttattctgtacgtactattctgtgcaaagcacaatgggtatatatacatgtgtaaataatgtgcctttcagaagcctaacaccgtccaacatcaaggtagaggaaccgtccagatgcaagagataagctacagttcttatccttggcctcttgaagtattgattatcctccagggctttatgattcatagggcctaataagaacctttcttttatgagtatagtaatctttgtatataattctggcttttcccagtacttgagtaaaatactgaattgagacaatacggaagttcatttctctgctcctttccttcctgatctcaggtacttgctaaagaagctcctccagcttcaggctctaactgaaggggaagtacaggctgcagctccttcccacagttccagtttgcccctgacttatggtgtggccagctctgtgggaactatacagggagctgggcctatttcagggcccagcactggggctgaggaaccatttgggaagaaaactaagaaggagaaaaaaaaaaaaaaaactcgaa

SEQ ID NO: 3017 - DNA, 1827 bp, Homo sapiens
  misc_feature (1)..(2): n equals a,t,g, or c
  misc_feature (4)..(4): n equals a,t,g, or c
  misc_feature (13)..(13): n equals a,t,g, or c
  misc_feature (1768)..(1768): n equals a,t,g, or c
  misc_feature (1787)..(1787): n equals a,t,g, or c
  misc_feature (1811)..(1811): n equals a,t,g, or c
nncngcacgagcncggtcctgtcccgtcagcgtcccgccagccagctccttgcacccttcgcggccgaggcgctccctggtgctccccgcgcagccatggctcagcacttctccctggccgcctgcgacgtggtcggattcgacctggaccacactctgtgtcgctacaacctgcccgagagcgccccgctcatttataatagctttgcccagttcctagttaaggagaaagggtacgataaggaattgctcaatgtgaccccagaggattgggatttctgttgcaaaggtttggcattggatctagaagatgggaacttccttaaacttgcaaataatggcactgttctcagggcaagccatggcaccaagatgatgactccagaggtgctggcagaggcatatggcaagaaagagtggaagcacttcttgtcggacactggaatggcttgccgctcaggaaagtattacttttacgacaactactttgacctgccaggagctcttctgtgtgccagggtggtggactatttaacaaaactgaacaatggtcaaaaaacatttgatttttggaaggatatagttgctgctatacaacacaattataaaatgtcagcttttaaggaaaactgtggaatatattttccagaaataaaaagagatccaggcagatatttacatagttgtcctgaatctgtgaaaaaatggcttcgacagctaaagaatgctgggaaaattcttctgttaattaccagttctcacagtgattactgtagacttctctgcgaatatattcttgggaatgattttacagacctttttgacattgtgattacaaatgcattgaagcctggtttcttctcccacttaccaagtcagagacctttccggacactcgagaatgatgaggagcaggaggcactgccatctctggataaacctggctggtactcccaagggaacgctgtccacctctatgaacttctgaagaaaatgactggcaaacctgaacccaaggttgtttattttggtgacagcatgcattcagatattttcccagctcgtcactatagtaattgggagacagtcctcatcctggaagaactcagaggggatgaaggcacgaggagtcagaggcctgaggagtcagagcctctagagaagaaaggaaaatatgagggaccaaaagcaaaacctttaaatacttcatctaaaaaatggggctctttttttattgattcagttttgggactggaaaatacagaagactccttggtttatacatggtcttgtaagagaatcagtacttacagcactattgcaattccaagtattgaagcaatcgcagaattacctctggactacaaatttacaagattctcttcaagcaattcaaaaacagctggctactatccaaatcctccactggtcttatcaagtgatgagacactgatatccaaataagttgtctttactgaaaaatgaagtgaagacccatatatgcagttaaaaaaaagttaattttcaaaaaatactgtaaaagactttaaggaacaagttttattgaccaataagttgatatttgtccataggtctcctttctataaatcatcttgatgtttaacaactcttattatattaaaatctcagtatcctaaaacttaggaaccttattggatattttctattacagtagttttgtggttgggattcacccgggggggccacacactcacacggcacagttcactctttacacatatggccncggtcccgtggggttctcnaaggtgtggttcccttggggcctnttgggcttgggccttt

SEQ ID NO: 3018 - DNA, 1048 bp, Homo sapiens
  misc_feature (13)..(13): n equals a,t,g, or c
  misc_feature (16)..(17): n equals a,t,g, or c
gatcccccgggcncgnngaattcggcacgagggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccaaaaaaaaaaaaaaaaaagggggt

SEQ ID NO: 3019 - DNA, 1029 bp, Homo sapiens
caggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcctggagtaagcagcgaggaagagcagcactggtcccaagcagaggccttgccctgctgggaccccgggagtgagagcagcccaaggatcccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctatagtgagctgggaggcgcttcctaagaccctttcctcagggctgccctgggaactcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggcttccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacataaaaaaaaaaaaaaaaaaa

SEQ ID NO: 3020 - DNA, 2119 bp, Homo sapiens
  misc_feature (1424)..(1424): n equals a,t,g, or c
  misc_feature (1438)..(1438): n equals a,t,g, or c
wgcaagctttgggagttgttcgctgtccctgccctgctctgctagggagagaacgccagagggaggcggctggcccggcggcaggctctcagaaccgctaccggcgatgctactgctgtgggtgtcggtggtcgcagccttggcgctggcggtactggcccccggagcaggggagcagaggcggagagcagccaaagcgcccaatgtggtgctggtcgtgagcgactcctacgatggaaggttaacatttcatccaggaagtcaggtagtgaaacttccttttatcaactttatgaagacacgtgggacttcctttctgaatgcctacacaaactctccaatttgttgcccatcacgcgcagcaatgtggagtggcctcttcactcacttaacagaatcttggaataattttaagggtctagatccaaattatacaacatggatggatgtcatggagaggcatggctaccgaacacaaaaatttgggaaactggactatacttcaggacatcactccattagtaatcgtgtggaagcgtggacaagagatgttgctttcttactcagacaagaaggcaggcccatggttaatcttatccgtaacaggactaaagtcagagtgatggaaagggattggcagaatacagacaaagcagtaaactggttaagaaaggaagcaattaattacactgaaccatttgttatttacttgggattaaatttaccacacccttacccttcaccatcttctggagaaaattttggatcttcaacatttcacacatctctttattggcttgaaaaagtgtctcatgatgccatcaaaatcccaaagtggtcacctttgtcagaaatgcaccctgtagattattactcttcttatacaaaaaactgcactggaagatttacwaaaaaagaaattaakaatattagagcattttattatgctatgtgtgctgagacagatgccatgcttggtgaaattattttggcccttcatcaattagatcttcttcagaaaactattgtcatatactcctcagaccatggagagctggccatggaacatcgacagttttataaaatgagcatgtacgaggctagtgcacatgttccgcttttgatgatgggaccaggaattaaagccggcctacaagtatcaaatgtggtttctcttgtggatatttaccctaccatgcttgatattgctggaattcctctgcctcagaacctgagtggatactcttcgttgccgttatcatcagaaacatttaagaatgaacataaagtcaaaaacctgcatccaccctggattactgagtgaattaccatggatgtaatgtgaatgcctccacctacatgcttcgaactaaccacttggaaatatatagcctattcggatgttgcatcaatgttgcctcaantctttgatctttcntcggatccagatgaattaacaaatgttgctgtaaaatttcccagaaattacttattctttggatcagaagcttcattccattataaactaccctaaagtttctgcttctgtccaccagtataataaagagcagtttatcaagtggaaacaaagtataggacagaattattcaaacgttatagcaaattttaggtggcaccaagactggcagaaggaaccaaggaagtatgaaaatgcaattgatcagtggcttaaaacccatatgaatccaagagcagtttgaacaaaaagtttaaaaatagtgttctagagatacatataaatatattacaagatcataattatgtattttaaatgaaacagttttaataattaccaagttttggccgggcacagtggctcacacctgtaatcccaggactttgggaggctgaggaaagcagatcacaaggtcaagagattgagaccatcctggccaacatggtgaaaccctgtctctactaaaaatacaaaaattagctgggcgcggtggtgcacacctatagtctcagctactcagaggctgaggcaggaggatcgcttgaacccgggaggcagcagttgcagtgagctgagattgcgccactgtactccagcctggcaacagagtgagactgtgtcgcaaaaaaaaaaaaaaaaaaa

SEQ ID NO: 3021 - DNA, 2296 bp, Homo sapiens
  misc_feature (2280)..(2280): n equals a,t,g, or c
ggcacgaggttttcggaagggaggatcagggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaagggctcttcgagctcgcgccctggccgcggctgccgccgacccggaaggtcccgaggggggctgcagcctggcctggcgcctcgcggaactggcccagcagcgcgccgcgcacacctttctcattcacggctcgcggcgctttagctactcagaggcggagcgcgagagtaacagggctgcacgcgccttcctacgtgcgctaggctgggactggggacccgacggcggcgacagcggcgaggggagcgctggagaaggcgagcgggcagcgccgggagccggagatgcagcggccggaagcggcgcggagtttgccggaggggacggtgccgccagaggtggaggagccgccgcccctctgtcacctggagcaactgtggcgctgctcctccccgctggcccagagtttctgtggctctggttcgggctggccaaggccggctgcgcactgcctttgtgcccaccgccctgcgccggggccccctgctgcactgcctccgcagctgcggcgcgcgcgcgctggtgctggcgccagagtttctggagtccctggagccggacctgcccgccctgagagccatggggctccacctgtgggctgcaggcccaggaacccaccctgctggaattagcgatttgctggctgaagtgtccgctgaagtggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaagcatatcttccccttctccttgattcgctatgatgtcaccacaggagagccaattcgggacccccaggggcactgtatggccacatctccaggtgagccagggctgctggtggccccggtaagccagcagtccccattcctgggctatgctggcgggccagagctggcccaggggaagttgctaaaggatgtcttccggcctggggatgttttcttcaacactggggacctgctggtctgcgatgaccaaggttttctccgcttccatgatcgtactggagacaccttcaggtggaagggggagaatgtggccacaaccgaggtggcagaggtcttcgaggccctagattttcttcaggaggtgaacgtctatggagtcactgtgccagggcatgaaggcagggctggaatggcagccctagttctgcgtcccccccacgctttggaccttatgcagctctacacccacgtgtctgagaacttgccaccttatgcccggccccgattcctcaggctccaggagtctttggccaccacagagaccttcaaacagcagaaagttcggatggcaaatgagggcttcgaccccagcaccctgtctgacccactgtacgttctggaccaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtcttntgaaaaaaaaaaaatc

SEQ ID NO: 3022 - DNA, 1827 bp, Homo sapiens
  misc_feature (1)..(1): n equals a,t,g, or c
nccttgtggcctgacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcctctgtcaccacatgaggttcaacctgaaagaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgtcccgatgcaagccccctcttcgctgggctcccagcagtgcttccctcctccac

SEQ ID NO: 3023 - DNA, 4412 bp, Homo sapiens; identical to SEQ ID NO: 584

SEQ ID NO: 3024 - DNA, 3248 bp, Homo sapiens
ggcacgaggtctcggctccctccggcacccgcccggcccggctgctcccggctcctcccggccatggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagaacctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcagggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtagcattaagatggatagcacataatggcacttgtctatgtacaaaacacaaactttagagcaagaagacctcagacaggaaactggaattttttaaagtgccaaaacatatagaaatgtttgaatgcatgggtcttatctaatttatctcttctggacccatgtttaaatacagttttatttcatgaagagaaatgaaaacccctacactgatatctgttttctatgggactgattctgaaattcttaactattaagaatattttaatagcagcatgacatttagcagtaatccattaagggcagtacctctaacaaggacgccttccagcttcagctatgttacttacgtttgatgctacttaaagtaatgaatgacgttttaaggaatccctaaccctactatcagaaaaggtgtttgttaaagagccttctcttgtgtgttacgcatgaactttggtctgtaggtgttaaatggaacctctccatgtgtatatagtatttccttgtataaagcactttactacctaccacttgtgttgtgaacgtttggtgactgctgttgaaagaaggaaaagggtgtgtgagaaagcctactgaagcagcagcactgccactacatgtggacaaaagtgaacatataaaagaagttgtgctatttaactctgaatacttggagaaactaggtgaagatgcaaccagaaaggagaatatgtatgcgtgaagtctcagctttgagctggaggctagattccaagatgacagccatgatgaaactttttaaaaaactaaaccagaagagactttaaaataagagaaagaaatcataaatgtagacatatgcttggctaaaggggaaatggactttaaattttaaagagctcatttgcaatgcacttgtatacacttcaaaaattattgtagacacagaatttgttatatttttgtgcttagtatttaaacctgaacattgaaacagttttcctccttgtctttcttaacagtaatagtcattatatttacctgttttttaacacaatgtatgtgatagtcaaaaaatcacagtttttcattattattcatcttctgtacccacgcataaccactatacatagtttcttttgtacttgaatatacaaaacatgaacacagtgccatatgaataatttcacatacagaacctttttttctctgaagtcctgtggacttgcaaatatatatatatattgctttgttaatttgtttttatatttcatatatgtaataaaggaatatgatctgaaaaaaaaaaaaaaaaaaaa

SEQ ID NO: 3025 - DNA, 664 bp, Homo sapiens
gaagctaccctgcctccactagatagagcagggagagttctgtgatccccaataggtaaggactatgccccaagccagcatgaagcagttaccaaaaaagatcatcggtccctctgcctcccataaagatttatgggatcacatctctcagggaggagatgaggcaggaaaatagggtctggaggcagggaacataaggccaattcacacttcagctatgacaggaaatatcctctccatgaggcatacaccaagtaaatgactttgtaactttacttcatcctcttcatttacacagggcatacatgaagtaaccaatggaatcctctagggggtatttaaactcccaaaaattctgtaacggggcccttgagcccctatgcttgggtccattcccaaactgtggagtgtactttcattttcaataaatttctgcttttgttgcttcattctttccttgctttgtttgagcgttttgtccaattatttgttcaagacgccaagaacctggacaccctccaccggtaacactcttacaattatgcagttgtgcagtgcatagcccgtgccactatatgtggcagtgttgcccacttagcaatgaggagcgcatattttcctgcattatcaccaaaacaatgttatcatcttttatttattatta

SEQ ID NO: 3026 - DNA, 798 bp, Homo sapiens
ggaaaaatgcagctaattcagctcataactttaacaattacacaagtgcttttcctggataccatcatgtctacatatgtagcagatacggattatgtggttcttcctgtttcatcccataaaawattctaaagacattcaaaagttgagatttaataaaataatttttagtactttatcaagggcattctaagtgaattcgtgctcttttttttaaaccataagtacatagcagtaaagaagacaataaccacatttttgtgtctctgcctttatctgtggtaagctgacagcagttttacccaccattgcttctgcaccatcagtgcaaatgtcaaaatagtgaaaaggccaggtgcaktggctcacacctgtggtcctagcaatttgggatgctgaggcgggtggtttacctggtcaggagtttgaggccagcctggccaacatggtgaaaccccatctctgctgaaaatacaaagattagccgggtgtggtgggcgcctgtagtcccagctactcgggaggtagacgcaggagaatcgctggaatccgggaggcggaggttgcagtgagccgagaccgcgccaacatggtgaaaccgtgtctctactaaaaataaaaaaattagcgagacctggtggtgggcgcctgtaatcccagctactcgggaagttgaggcaggagaattgcttaaacccaggagaccgaggttgcagtgagctgaaaccacgtcattgcaatccagcctgggcaacagagcgagactctgtctcaaaaaaaaaaaaaaaaaaactcgaa

SEQ ID NO: 3027 - DNA, 3300 bp, Homo sapiens
  misc_feature (1)..(1): n equals a,t,g, or c
  misc_feature (3)..(3): n equals a,t,g, or c
  misc_feature (15)..(15): n equals a,t,g, or c
ncngcagccggacgnccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaacaaaagctggagctccaccgcggtggcggccgctctagaactagtggatcccccgggctgcaggaattcggcacgagaacacatcttaagggaaccaagtctcaagagaaatcaagtaattatgaatgaacagctctaaaaaagagagagagaatattttcttaaatcaacttagttgctgttatgaccaaagaacagatgttgtggtgttcaccccagagaagcaagagattttcccttaaacctcagcttataatgaatggaagtgaatgacagggagagagtttttctctcgtttcccagaactctatccttttcttctcaaacagttggaaactgtagccaatacagtagacagtgatatgggagaaccaaatcgtcatccaagcatgtttctcttacttttggtgttggagagactctacgcttccccgatggatggtacttcttctgctctcagcatgggaccttttgttcccttcattatgaggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccttcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggattgggatgggggtatgtgtggatttttcctccactaaatctgcaggaaacatgttgaacataaattcaaaaattttatcccaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagctgtctctt

SEQ ID NO: 3028 - DNA, 2565 bp, Homo sapiens
ggcacgaggaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatggtttgtatttgaacatggtgattcctccttcacttcaccttaacggaatgtctttatttgaattttatttgtaaaatgtgtcctgtttaaatttttcaatctttaaaaataatttttatgtacttttttttttttttaacctttcttgcactctgggtcatgggtaccactgcaatggcttcccctttttttatgggataccaactgcaatatggtcctcaatgctgttctggccatttcaatgactaatgccaaacatctgtatgactaatttttttatgttaaaaaaatactgtttaatgctggctctatggtgatttggttttactaaattgggtttctcgttgggggtggtcttttgaatactgggttttatatattctgctatttttaacgtgtggtttttttcgatatctgggttctaaaagaaatctttggaattaagagaaaaacaagctgaaaaggaagaaaagcagaaaacaaagaaaatagaaacaagtgcagaaaagttgcgtaagctcttaaaagaagagaagaggtaaactataatattcagtatttttaaacttaaggcaactactgaattgaacccaaagtgccatactggaggtaaagtaaataaaaatatgaaagtatttcaagtgccaatcagtgactgttaagaatctttagcaaatatgtgttccatgtattttcttattaaagagatgaagtggaatttaaggctagaattctacaaaaaaagagtatcttagaattaaaatatagaataagttactttaattatgttttaggaagaaatattttagaactagagcagtggttctcaactaggggtggatttattcacccggggacatttgacaagatgtggagacatttttgattgccataactgatagggtgctactgcatctagtgtataatggtcagggatgctcttaaacattctgtaatgcacaggtcagctcccacccgcacccccaccccctaccaagaattatttggctgaaaataccaataatcaggtgaagaaaccatgaactagaggtagccaaataaaaaagttgagttctcctttatgtgttcagtagtcttaagtttttaaggtagtgttgaaaaaagtctgtctttcagagatgatggatttgcttacaatgatacctgtctgcaagcattttttcccccaaaagtgcttaatagtaaaattagatcttgtagtagccgagattattgatcatttatctgaaccacagcttttataaaatctttaaaggaaacaaatagggcccacatctttatgaataatttagaaacatttttgtatatatatgacaaatgaactgttttttttaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaaaaaaaaaaaaaaa

SEQ ID NO: 3029 - DNA, 810 bp, Homo sapiens
  misc_feature (1)..(1): n equals a,t,g, or c
  misc_feature (295)..(295): n equals a,t,g, or c
  misc_feature (709)..(709): n equals a,t,g, or c
  misc_feature (761)..(761): n equals a,t,g, or c
ntggtcttccacatgtactcaagaaaatgtctattcctatggtctctgtgttactctgccaggcaccattgttaatccaagtagctctgccaagaacagtagctataaggaagaagagattgtgcttagtggacagcattcttcaaacatggcatcttttcaacttttttttagtaggctttatttttcagagcatctttaggttcacagcaaaattgagtgaaagtacagagatttcccatttattctttgccccaacacaagcaaaacctcacctgttaccaatatcccccanccagagaggtacatttgttataatcaataaacctacaatgacacattgctatcacccaaagtccatagtttacattagggttcattcactcttcgtgttgtacattctatgggttttgacaaatgtcataacatgtatttataattatagaaatatgtagaagagttttattgctctaaaattcctctgtgcttcatccattcatccctttcttctcccagtctcttgaaaccactgctactgttacggtctccatggttttgccttttccagaatgtcatatagttggaatcataccgtagaagccttttcagattggcttttttcgcttagtaatatgcattttaggtttctccatagcttttcatggctaaaataagctcaatttccttttaggtgctaatattccattgncctggatgtaccataagcttatttatctgcttatttacttgatggcatcctnggttgcttccaatattttgcagttattaataaaagctggctataaacag

SEQ ID NO: 3030 - DNA, 1820 bp, Homo sapiens
ggcacgagaaggaatgagagataaagaaagagacaggtgacatctaagggaaatgaagagtgcttagcatgtgtggaatattttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctctgtagacagggatccattttaaagagctacttagagaaataattttccacagttccaaacgataggctcaaacactagagctgctagtaaaaagaagaccagatgcttcacagaattatcattttttcaactggaataaaacaccaggcttgtttgtagatgtcttaggcaacactcagagcagatctcccttactgtcaggggatatggaacttcaaaggccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactaccatggtaaggccagaaatcttctaacctaccagagcctagatgagacaccgaattaacattaaaatttcagtaactgactgtccctcatgtccatggcctaccatcccttctgaccctggcttccaggggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacccgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctggtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtacaataaacttaaaatgattattaaataatcaaatatatctactacattgtttatattattgaataaagtatattttccaaatgtaaaaaaaaaaaaaaaaaaaaaaaaaaaaaaaaaaaaaaaaaaaaaaaaaa

SEQ ID NO: 3031 - DNA, 967 bp, Homo sapiens
ggcagagttggttttggtgcctcttccatgagcttcagatcagaactagctatgtggttccaggctgccttggtttcatcccttgtcttgcctactccaccaggctcaggagggacatcaaggaggaagaaatggataaagtcctggagggacttcaaacagtatttgacccattccagccgccatgactcccaccagcttcgcagcagcaatgccttcctctttgatgcacaggaaggcccctcggctgtggatatagccaaagatgagatccagagacagcggtagcacctgaaggaaacccttttcatcaacaactgcctgtgagaaaagctggaatgtcatctcagcagctttgatgaagaaaatggtgggagaggcccaacatgcacctctaaactctacaggcacatcatagattccatcgtccagctgtataatgaaaacagagttctcagagaacaccggagactcccccgacttgcctgaatcaagtttctagaggtaacaactgatgttggaactatgaaaagctcttctctacttttaacaaagcttagtcacaaacagttccccagttgacgagaacaactaaaacaacagaacaattgaaagtccaaatttgaaagctccatctccgagaagcaaattttacagccactccagatttgtattccaaatggatagtttgattataaaaatcacatcccttcagcctgcaaatgtgataactgcccaagagacagtgatgcctacatccatagataatcccctttcccccaacctatatataactggagtcaacagcagctggaggaaaatggcaaggacttgtaatcaagattaagttagaaaaacactgctgtagactgtttatcagctcttcagcatatgtccgttttccttgaaggatgagcgtttagaaacctctgacaataaagtttattttacacacaaaaaaaaaaaa

SEQ ID NO: 3032 - DNA, 1564 bp, Homo sapiens
  misc_feature (796)..(796): n equals a,t,g, or c
gaattcggcacgagattttcctaaccattgaaagcttttgcccaagtgcacctcgtggtgaggatgatgataatttattaaggacttctcgcgtgccagacatcatgctaagtgctttgtctgcattatatttaatcatcacaatattcctaaagggtagttgctgtagttgtcatcattgctttacaaatgggaaactgtggcttagaaagttcatcagtggttcccaaccctagctgcccatatttagagtcacttgggaacctttaaaacttctcgatggcgaactacaccccagcccagttaaatcacagtctctgaggtgggttccaggcatcggcttttttttcagttcctcatgtgcggccaagtttgagaaccagaggtcacacaggtgcyaagtgyagagctgaccttccaacccaggaaggcgggtgccaaagtcacagctggcaaaagtcaccatcaggttattcactgggaatttgaaattatgctgtcaagctactctacagatgtacccctttggtttctcaagttcttttcatcgaacttgccacagacttattttcctcattcaggagtaaagaaatggggctcctgcttctcattaccttggagggattctcccccactcacgtttatatctcttttaagctctcatttgacgacgtttcacttatatcacttgcaccatggcatcatctgcctagggttttctgtttattttcacagagcatacacatcactgtgtattctagaaacagctgtaggctcgtattaacaaagtgataanaatctggggctwtgaagacatgtaggatattagctaactgaactgtgctatgagattgtttccctttcttcttggcaaaccatttcagagcagcctggtgtggagactgtgttactgaaatggggccataggagcctccagactcctttctccctgccagaggctgattaggtagatcccatagtgcagaactccatgtcaccaccacatacgtgtatggcacacgtgggccaatggaaagggtccaggagttcttactttctaactggtcatgtgtaaggaagagagcaccttcctcccttaacaccaagggtttcaatagagaccactgagctgctacattaaatgaaagatgcattttcttgtgccctgggatgctgccccttattcacccgtgtttagttttatcttctgtgtaaaagatactcgagtttaaatggcttaaaaatgaagcaaggggctgggcacggtgctcacgcctgtaatcccagcactttgggaagatgaggcgggtggatcacctgaggtcgggagttcaagaccagcctggccaacatggcgaaaccccatctctactaaaaatacaaaaattctctatgaatggtggcacatgcctgtagtctcaaatactagagaggctgaagcaggagaattgcttgaacctgggaggtgaaggttgcagtgagccgagatcatgctactgcactccagcctgggcaacagagtgagactctgtctcaaaaaaaaaaaaaaaaaaaaaaaactcga

SEQ ID NO: 3033 - DNA, 941 bp, Homo sapiens
  misc_feature (864)..(864): n equals a,t,g, or c
  misc_feature (897)..(897): n equals a,t,g, or c
  misc_feature (938)..(938): n equals a,t,g, or c
aattcggcagagagccaaccgagggcgttcctgtcggggctgcagcggcgggagggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaatgtatgtacagaagaaaaagcgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtyctggactgcctggggccctgccatctgcttcccctgctgtcacctggstccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatggcggcggctggtagacacctttgctttctctagccctcctgggctgggcttgggcacaaatccccaggcaggctttggagttgtttccatggtgatggggccagatgtatagtattcagtatatattttgtaaataaaatgttttgtggctaaaaaaaaaaaaaaaaaatcnaagggggggccggtacccaaattccccctatantgaattcgtattaacaattcacttggggccgtccttttaanaac

SEQ ID NO: 3034 - DNA, 1516 bp, Homo sapiens
ggcacgagaggaattgatgctttaatttttggatactttttcagaatttttaatttactatggtccggcctaagatcctctgttgtatcaggttttgtgcacaaaagaaaagcacaaaagttgaatgcacatggggcatgtgctttctgtgcaccaaatatctggatgaggttcttttttcaggcctacagtcaaatctgtgtccagaattttttgacttttttgctttgtataatcatagaattcattgctgctgatttctataatgattcatgttgtcatgtgtctcttaataactgagggctgtcagtaacctgtgattttgccttttctatagtcttactcccatgaagaaccttggttctgatggagaaagtgaaaagctttatttcttcccctagatatctttatatttctattatattttttagttgtgtactgtgtactagagatttttttcagtttgttatgaacacaatttggtaagccctaaattggttctgcctgtctccaaacagaaacatctgtacaaatcttgttggtatagactactttctggaaaatggtcaagataagttcatgttttcttgaaatttctaagatagtatatggtatcacttgtttaaagcaaatcagactgagtttgacatttaattcaatatttctggtattcagtaacgggtatatatgtttgttcttccagtttgggtcagtttaaaagatatgttgcaaagtatacatagaaaatgtgagcaatgcctctctttgccttttgatcagaaacttcagcagagcggtaaggattccacatgatttaaactgaaatgcttttctttgttgctgtaagaacttaaaatgtaaaatacctttttcagtttaagtcctgtaaacaacattgaagcatggagatgaggcaaggaatagtactcactgaagttgaaatgactgcccacttcaaaatcttcattgtgtttacacaccagtgtatttatacaaatcagaggcattttgtagatgctttgctgacttgttcagctctgtaaaaacacagaaatcagacccattttgtaaagcggaaaatcatgttacatggaacatgtcctgtatatatcacatacatggtaatggagtcttaatgataagtgcaagataataatttaatgatgggattagtctgatcgcttaatatgcacaatcctggaagtgaattacttgcatcagatatagtgatatttattattctgtacagagagaaaaatacatataaaacatatgcttacattacatgcacgcggatttcatgctccataatcttttctattttttaatttacctttctgtaaatgatgtgcatggaatatgccttatagaaaaatgctgttcataatttgactacgtggaaaagtgcctatatggtggtaatgctagtaaggcaaataagacaaattatcatgttggtttactacatcaccagttaacattttatattgtgatgtttaaaaaaaaaaaaaaaaaa

SEQ ID NO: 3035 - DNA, 1730 bp, Homo sapiens
ggcacgagctttgttgagtcacaaatcttgagccagtcagaatttgaacctaagatttttgactgctggttgtcacacttcccgccccacactcaactgttgtgtgaatgagccagacacattgcttaacctgagtccgagatggacaatggtataggaaagatattcggtatggagaatcagatgttaacttgtgttgctatttttgttttgttttgttttgttttgtttttgagacaaggtcttgctctgtcacccaggctagagtgcagtggcatgatcagggcttactgcagcctcaccctcgatttcctgggctcaagcaatcctcccacctcagcccccaagtagctgggcctacaggtgcgtgctaccacgcctggccaattttttaaattttagcacagatgaggtctcactatgttgcccgggctggtctcgaactcctgagctcaagggatcctcccgcctcagcctcccaaagtgctggtgttacaggcataagccaccacgcctggcctgtgttgctattatatttggcaggaacccagagtccagaacatttcatctatgatgggttagataatgtgtctagttgtttgcatgccaatttcagtagcctcagttattcaacctaggagatttttctacctctttactaccctgctgaagttgctcttcagcagaaaatctttgtggaacacattccacactttgaaatcttcgtggaacaaaagatatttgtggaaccaatctttgtggaacatattccagctttttgaatgagtgcatatccagtagtacctttaaagtaacactttgtacataacaaatactcagcaaatgtgaaactttatttgctcttacttcaaaattagtccaaaatgttggaaataaaatataagacattgatctagatatgaggtttttctccttcattctcagctgtcgaagaaatcaaagtagcatatgcacaaggttaaaaaccacatatacaaatactatagaacagcttataatgaaaaccttgcctgcctttataaaaaatgtgattatcttcttctgttaatgtcaataaaagatggtttgtcctagaaggtctataaatggtattatgttctggaggaaacctagcaaaaactttgctagtttagtacttgtctctaaattgatgttcacccatttcaatattgcacttattaatggtctttatttttctagcatagataacaattgattctttagattcatatatggaggtaattcttgctttctaaagaaaggaatatggcacattggaaccattttattcaccagtggatttacccttagagtatttttagatctgagctgatgacttgtgagagaaaaagggaacagagtaaagccatggaagccatgaacagtaagagactgccgcctggcatggtttcttcttctgcagaagatgaaactgaggagaaacaagacaacatccttcataccaggaatggtcaagataatgcaagaagaaaaaagctttcaaacaaatcagaaggcagtcaacaaacagaaagggggacattccttccctggcagttactcaaaactgaaattgcttattgtgtacaccggggcttgtacttggggaatttaataaaaatgctcattaccaagcaaaaaaaaaaaaaaaaaaaaaaaaaaaaaaaaaaaaaaaaaaaaaaaaaaaaaaaaaaaaaaaaaaaaaaaaa

SEQ ID NO: 3036 - DNA, 2163 bp, Homo sapiens
  misc_feature (8)..(8): n equals a,t,g, or c
  misc_feature (15)..(15): n equals a,t,g, or c
acctttgnatccctngctcgaaactaaccctcactaaagggaacaaaagctggagctccaccgcggtggcggccgctctagaactagtggatcccccgggctgcaggaattcggcacgaggctgctgcaggcgtccggcttggacgaaccgccgttcccagtgctgggaccctttaagtatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaa

SEQ ID NO: 3037 - DNA, 2852 bp, Homo sapiens
aattcggcacgagggcgagctgaaacccgagctcccgctcagctggggctcggggaggtccctgtaaaacccgcctgcccccggcctccctgggtccctcctctccctccccagtagacgctcgggcaccagccgcggcaaggatggagctgggttgctggacgcagttggggctcacttttcttcagctccttctcatctcgtccttgccaagagagtacacagtcattaatgaagcctgccctggagcagagtggaatatcatgtgtcgggagtgctgtgaatatgatcagattgagtgcgtctgccccggaaagagggaagtcgtgggttataccatcccttgctgcaggaatgaggagaatgagtgtgactcctgcctgatccacccaggttgtaccatctttgaaaactgcaagagctgccgaaatggctcatgggggggtaccttggatgactcctatgtgaaggggttctactgtgcagagtgccgagcaggctggtacggaggagactgcatgcgatgtggccaggttctgcgagccccaaagggtcagattttgttggaaagctatcccctaaacgctcactgtgaatggaccattcatgctaaacctgggtttgtcatccaactaagatttggcatgttgagcctggagtttgactacatgtgccagtatgactatgttgaggttcgtgatggagacaaccgcgatggccagatcatcaagcgcgtctgtggcaacgagcggccagctcctatccagagcataggatcctcactccacgtcctcttccactccgatggctccaagaattttgacggtttccatgccatttatgaggagatcacagcatgctcctcatccccttgtttccatgacggcacgtgcgtccttgacaaggctggatcttacaagtgtgcctgcttggcaggctatactgggcagcgctgtgaaaatctccttgaagaaagaaactgctcagaccctgggggcccagtcaatgggtaccagaaaataacagggggccctgggcttatcaacggacgccatgctaaaattggcaccgtggtgtctttcttttgtaacaactcctatggtcttagtggcaatgagaaaagaacttgccagcagaatggagagtggtcagggaaacagcccatctgcataaaagcctgccgagaaccaaagatttcagacctggtgagaaggagagttcttccgatgcaggttcagtcaagggagacaccattacaccagctatactcagcggccttcagcaagcagaaactgcagagtgcccctaccaagaagccagcccttccctttggagatctgcccatgggataccaacatctgcatacccagctccagtatgagtgcatctcacccttctaccgccgcctgggcagcagcaggaggacatgtctgaggactgggaagtggagtgggcgggcaccatcctgcatccctatctgcgggaaaattgagaacatcactgctccaaagacccaagggttgcgctggccgtggcaggcagccatctacaggaggaccagcggggtgcatgacggcagcctacacaagggagcgtggttcctagtctgcagcggtgccctggtgaatgagcgcactgtggtggtggctgcccactgtgttactgacctggggaaggtcaccatgatcaagacagcagacctgaaagttgttttggggaaattctaccgggatgatgaccgggatgagaagaccatccagagcctacagatttctgctatcattctgcatcccaactatgaccccatcctgcttgatgctgacatcgccatcctgaagctcctagacaaggcccgtatcagcacccgagtccagcccatctgcctcgctgccagtcgggatctcagcacttccttccaggagtcccacatcactgtggctggctggaatgtcctggcagacgtgaggagccctggcttcaagaacgacacactgcgctctggggtggtcagtgtggtggactcgctgctgtgtgaggagcagcatgaggaccatggcatcccagtgagtgtcactgataacatgttctgtgccagctgggaacccactgccccttctgatatctgcactgcagagacaggaggcatcgcggctgtgtccttcccgggacgagcatctcctgagccacgctggcatctgatgggactggtcagctggagctatgataaaacatgcagccacaggctctccactgccttcaccaaggtgctgccttttaaagactggattgaaagaaatatgaaatgaaccatgctcatgcactccttgagaagtgtttctgtatatccgtctgtacgtgtgtcattgcgtgaagcagtgtgggcctgaagtgtgatttggcctgtgaacttggctgtgccagggcttctgacttcagggacaaaactcagtgaagggtgagtagacctccattgctggtaggctgatgccacgtccactactaggacagccaattggaagatgccagggcttgcaagaagtaagtttcttcaaagaagaccatatacaaaacctctccactccactgacctggtggtcttccccaactttcagttatacgaatgccatcagcttgaccagggaagatctgggcttcatgaggccccttttgaggctctcaagttctagagagctgcctgtgggacagcccagggcagcagagctgggatgtggtgcatgcctttgtgtacatggccacagtacagtctggtccttttccttccccatctcttgtacacattttaataaaataagggttggcttctgaactacaaaaaaaaaaaaaaaaaaaaa

SEQ ID NO: 3038 - DNA, 2617 bp, Homo sapiens
ggcacgaggaggccctcacacccattgggtccctgctagcccagctgcctgtggacgttgtgattgggaagatgctgatcctgggctccatgttcagcctggtggagcctgtgctcaccatcgcagccgcacttagcgtccagtcgcccttcacccgcagcgcccagagcagcccagagtgcgcggcagcacggcggccgctggagagcgaccagggtgaccccttcacgctcttcaacgtcttcaacgcctgggtgcaggtgaaatctgaacggagcagaaactctcgcaagtggtgccgccgccggggcatagaggagcatcgactgtacgaaatggccaaccttcggcgccagttcaaggagctgttggaggaccacgggctgctggctggggcccaggccgcgcaggtaggggacagctacagtcggttgcagcagcgccgggagcgccgggccctgcaccagctgaaacgccagcacgaggagggcgcggggtgcaggcgcaaggtgctgcggctgcaggaggagcaggacggcggctccagtgacgaggacagggctggcccagcccccccaggggccagtgatggcgtggacatccaggatgtgaagttcaagcttcggcatgacctggcgcagctgcaggccgctgccagctcagcccaggacctgagccgcgagcagctggctctgctgaagctggtgctgggccggggcctgtacccacagctggccgtccccgacgccttcaacagcagccgaaaggactcagaccagattttccacacgcaggccaagcagggcgccgtgctgcaccccacctgcgtcttcgctggcagccccgaggtgctgcacgcacaggagctggaggccagcaactgcgacggaagccgagacgacaaggacaagatgagcagcaaacaccagctcctcagcttcgtgtccctgctggagaccaacaagccgtacctggtgaactgcgtccgcatccctgccctccagtccctcctgctttttagccggtctttggacaccaatggtgactgctcccgcctggtggccgatggctggctggagctgcagctagcagacagtgaaagtgccatccgactcctggcggcgtccctggcggcttccgtgcccgctgggaaagtgccctggaccggcagctggcgcaccaggcccagcagcagctggaggaggaggaggaggatacgccagtcagccccaaggaggtggccaccctgagcaaggaactcctgcaattcacggcatccaagattccttacagcctccggcggctcacagggctagaagtccagaacatgtatgtgggaccccagaccatcccagccaccccccatcttcctggcctctttggcagctccaccctgtccccccaccccacaaaggggggctacgcagtcactgacttcctcacctacaactgcctcacgaatgacacagacctgtacagcgactgtctccgaaccttctggacctgcccccactgtggcctgcatgcgcccctcacgcccctggagcgcatcgcccatgagaacacctgcccccaggccccacaggatgggcccccaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccttcagcccaggactaggggcaggactcttgcctgaacccccagcctgggcttagccctgtggtcctgtcccagtgcagagggcctggagcacggattgtgaataaagcctcacatgctgatacacactgttaggcctgcacctgcccatccagaaagcagcagctgccttgttagtcctccccagggtctagctttccttcttcctgctgcagggtgctgcctgaggggtcctgggtaggaggggcgttagagccagcagggacctcccatgtctccagattccaggtgcaggttcttagcacctccgcagccgctctctcttgagtccatcctcagtctctcctaccccttgaagtagggggaccctgaatttgcccatccacctgggtcactttgagagttgtgcaggggggctgggagcactggtgttcacgtgggaccacaggctgcaccataagacccactcacaataaaaaaataaaaggccgagccgggcatggttgctcactcccgtaataaaaaaataaaagaacaggctgagccgggcatggttgctcactcccgtgatcccagcactttgggaggctgaggcgggtggatcgcctgaggtcaggagttcgagaccagcctggccaacatggtgaaaccctgtctctactagaaatacaaaaacttagctgggtgtggtggtgggcatctttagtcccagctactggggaggctgaggcaggggaatcacttgaacctgggaggcggaggttgcagtgagctgagatcgtgccattgcactccagcctgggcgacaagagtgaaactccatctcaaaaaaaaaaaaaaaaaa

SEQ ID NO: 3039 - DNA, 1860 bp, Homo sapiens
  misc_feature (1855)..(1855): n equals a,t,g, or c
  misc_feature (1857)..(1857): n equals a,t,g, or c
ggtgatttcacaccttcattcactcctgcagtccctgaacacttacttggggtcctcattgccctatctggtgaaagatggcatccagcctgacttgtactggagtaatctgggctttgctgtcttttctttgtgctgccacctcctgcgtggggttctttatgccttactggctctggggatcacagctgggcaagcctgtgtccttcggtaccttccggaggtgctcatatcctgtgcatgatgagagtcggcagatgatggtgatggtggaggaatgtgggcgctatgcctccttccagggcatccccagcgcagaatggaggatctgcaccatagtgaccggcctgggttgtggcctcctcctcctggtggcgctcactgccctcatgggttgctgtgtttccgacctcatctccaggacagtgggaagagtggctggaggaattcagtttcttgggggcttgttgattggtgctggctgtgccctctaccccttgggctgggacagtgaggaagtccggcagacttgtggctacacttctggccagtttgacctggggaagtgtgaaatcggctgggcctactactgcacgggagcaggtgccactgccgccatgctgctgtgcacgtggctggcttgcttttcgggcaagaaacagaagcactacccatactgagatggagctaccaagagcagacagaggagaagatgggccaaaggggcttggagaggtcaaaacatccacctaccttcaaaaggtgggatagtagttctaatccaatacaatgctaataaaatgaaacccgataaaatcaggaacatgatataggaaggaaggattgtaggagatttgtgggggaaaaaaaaggagagtatagaatgatggagaaaaatggaccaaaggctaaaaatattgcagggcatcgggtgtttctattccacagagtattgttaatgtacaacacacacacacacacacacacacacacacacacacacacacacaacaaatctacatatacaaacaagggtttgggttttagttttttttttttaaggtgaggactcagaaaatcaaagggctagtagaaacagtgttatgttgggaagcagggtacccccaaagatgttccctgtaggtcacggcactcccaaaagcacacaagcacatacagacatatgcatccccacacacgcctatgcacaaacgtggattatcgcacagactgggaggtttagtggtgcatttctcctctgttttctttttaatatacatttaaaatacagtattatcactttataaaacatacattaagcctaataaatggaccaataagccaaactatcagtattttgtatatcctgcataaactctaatttagttcctcaacatattttcagtgtttatgcagacctttagagttaagcctttgtatttccatgttattccacaatatgcaatatttctctgagtagcttctgctatgatattcttatgaagaaaaggggcaactttctgtccactataggagagaattcagccgaagatatgagagtaatgagagacattttccagtcattggatcgtgttttcttttgtccattattgtactgtgctgtaccacatttatttctatattcattttgtaaaaaatttaaaagtgctattttgtttgtatttgaaaatctctgtgaataaattctctctttgatcaataaaaaaaaaaaaaaaaaaaaaaaaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggncnccc

SEQ ID NO: 3040 - DNA, 1183 bp, Homo sapiens
ggcacgagattcaacatggcagccatgcgctggcgatggtggcagcggctgttaccttggaggttgctgcaggcccgtggctttccacaaaattctgcacccagcctgggcctaggagcgaggacttattcccagggcgactgctcgtattcgcgcacggcgctgtatgatctgctcggcgtcccctccacagccacgcaggcccaaatcaaggcggcttactaccgtcagtgctttctctaccacccggaccgcaactccgggagcgcggaggccgccgagcgcttcacgcgcatctcccaggcctacgtggtgctgggcagtgccaccctccgtcgcaagtatgatcgcggcctactcagcgacgaggacctgcgcggacctggcgtccggccctccaggacgcccgcacccgaccccggctcgccgcgtaccccgccgcccacctctcggacccacgacggttctcgggcctcccccggcgccaaccgcacgatgttcaactttgacgccttctaccaggcccactacggggaacaactggagcgggaacggcgcctgagggcccggcgggaggcccttcgcaaacggcaggagtatcggtccatgaaaggcctccgctgggaggatacccgagacacggctgccattttcctcatcttttcaatcttcatcatcatcggcttttatatttaatcggagagagaagggaaggggagtgtccccagccaaccccccagaaacggccttttttcctgcctctgaacccttggccattgatagtctacctttgctgggatccgaaggaactgtactccccctgccctccccgacccgcccagcttagccgatgacctgcacatcgctccactgtggtccagaaaaggaggcctttcgatgtctgagaaagaggccccacgctgtagagtcccgaaagcccaggagtgaagggggttcctggagtctctagggtgcttcttccagagtctgtcttcttgcttccagatgtggtcaacttctggaacactcgctgtagctttattgtttagccccaagcaagatttatctcctcctgccccgcatgtgtatggtgggcctctgtaaccttgaaatgtgcaatgtgaccaattgttgactaccaaaagaaaaggtctggggttgtacgaaaaaaaaaaaaaaaaaa

SEQ ID NO: 3041 - DNA, 1088 bp, Homo sapiens
  misc_feature (1)..(1): n equals a,t,g, or c
  misc_feature (4)..(5): n equals a,t,g, or c
  misc_feature (9)..(9): n equals a,t,g, or c
  misc_feature (11)..(11): n equals a,t,g, or c
nttnnaacngnaaatctccccttactattgggaacaaaagctggagctccaccgcggtggcggccgctctagaactagtggatcccccgggctgcaggaattcggcacgagattccccagaattggttcatcttgggaaaggaaggcctaggaagctgatgacctacttgttttgttcatccatttctctactgcttcttaaagtgcactcaagcggtcaccaggacatcagaaaagccaaatccaaggtcccaaggctcttgatcatccagtgcccacaacagagggagtaagctagacggagaagctgaagtgaaggaggaaagagagaagggggtgcctgttccacccccttcctagcagctgcctctgtgggctccataatccccatgccctctcccccaccccaccctccggccgmccacctctcctccacccaccccattcatcagtaggagggcactgtatcagcacagcctttcaaggcctgacagttcctttctgggtgccccccacatgtaaccacttaacccccagcacaaagggccagcctgaatgggcttggagccggtggctcgtgcgragggggaggcctcaataggatttggggagctgggtgtataaaccgctctgctccagcagccctcaatggaggagctggagttggggcatgtgccgaggggaggagctcggcagctgcatcccgsccctgaacaatgatttattcattctcctggcacgcacagagaagacaggctggggaaacatggccccacaaatcgccctcagcctcagctgattcccacggcaatcattgcagttcagagtgccccctcccacttgtaatgttttgcctcaagcttgcccttcctcttcctggtaaggaagtagactacattacgggaggccttaagtagccttaaattcaggcaagcatcgttctttgagttggttgcacccaaactcaatctcactctctcaaagctttctggccaggttttcctcacacacccatagaaacagatgcagacaaaaaaaaaaaaaaaaaaaactcgagggggggcccggaacccaattcggaagatttg

SEQ ID NO: 3042 - DNA, 2702 bp, Homo sapiens
  misc_feature (2)..(2): n equals a,t,g, or c
  misc_feature (4)..(4): n equals a,t,g, or c
ancnggacttttactgcctactcaggtgacactttagaaggtacgcctgcaggtaccggtccggaattcccgggtcgacccacgcgtccggaggaaacggaagaaggagcaagctatggaggggaacagggatgaggctgaaaaatgtgtcgagatcgcccgggaggccctgaacgccggcaaccgcgagaaggcccagcgcttcctgcagaaggccgagaagctctacccactgccctcggcccgcgcactattggaaataattatgaaaaatggaagcacggctggaaatagccctcattgccgaaaaccatcaggtagtggcgatcaaagcaagcctaattgcacaaaggacagcacatctggtagtggtgaaggtggaaaaggctataccaaagaccaagtagatggagttctcagcataaacaaatgtaaaaattactatgaagtacttggagttacgaaagatgctggtgatgaagatttgaaaaaagcttatagaaagcttgctttgaagtttcatccaaagtggatccccccacctggagcaatcggacgagtttccttcaggtagtgtacattctttttcaaatggaagagctggttatagccaacaacatcagcatcgacatagtggacatgaaagagaagaggaaagaggagatggaggtcgacccacgcgtccgagctgatgcccataattgtattgatcctcgtgtcattattaagccagttgatggtctctaatcctccttattccttatatcccagatctggaactgggcaaactattaaaatgcaaacagaaaacttgggtgttgtttattatgtcaacaaggacttcaaaaatgaatataaaggaatgttattacaaaaggtagaaaagagtgtggaggaagattatgtgactaatattcgaaataactgctggaaagaaagacaacaaaaaacagatatgcagtatgcagcaaaagtataccgtgatgatcgactccgaaggaaggcagatgccttgagcatggacaactgtaaagaattagagcggcttaccagtctttataaaggaggatgaactggaatttttatttataccttttagcgtactctttattttttctgtaagtaagtttggtttcatcatgagggatgaaggaaaagatttgatactgaaaactaaactgaatagttggttcctgaaatcttggactgtttatgacctactggctcctttaaatagtaactgaaaactaaaatggaatattttagttaacgcttctacaagtattttcattttaaaagcttacatgattcctaactaaagtgtcatgagaaaggattatcacacctgtagcaatttccagttttagtgattctccattttttcccttgtcatgtaaatatttatggaatgatcattttgtgtacatacaggttactgcttttttatttaaattcttttagtgtttagctccatgagtcacttcagtttaaattgatggaataaatgttatatgacacatttacattttccttatcaaggtgtcaaatatgtggactttaaccaatgaaactttttcaaaaagaaaaaccaaaaactttaactttgtgtaaaatcttatagtattatcagcttagagggaattgatatttttaatattgccgttatattccaaaatatatattgagataaatgaactggtgtagaatatcagtttgctatttagttttatgaattactatacatatacatgcatagaaatgaaatgctatactgataaattttaaagaaaatatgaggaaatggctataaatattaaactaaaagggtcttcaacagtaaagtgcagttatgtcatttaaaattccaatactttaaaggccaccaaattttgatgtatatgtccttgaagggctgctaaaatttatgaagaggactcacattttcccccatagaaattgcagtttcttggtgatcatttaagcaggatccaaagaagttcctttacaaataagtaataagaaaaatgagtactaaaatacagctttgtgcttttaaccctatgccaactcctaaacatataagtagattacagtatacttatctgatcagagcatgatctgtttggccacatgcaagtgtgagcagaaatagagcagcacgtagaatagtaacttaaagcaagtcatcctttaaaaattctgagctaaaatctatttaccattgagtaattgaattaatcccataggaataagctccttgtaagtaaatccatgatatgaattagaaaaaaaaaacagctggaaattgaagtttttgatgcctgtatactggatatgaaactatttgatttctagtcttctgtgtttagcagttgtaatattttaatgattttgcttcatactcggttaatggaacataaacatatctttgatacttctttgtgagtgagagaatgctagatagggtggctttgttctttgtttaagttttttttcctgaatgtagttaatttatggcatctgttgaataaaactgctaaaatgacctcttaaaaatgttctgttgtatccccttttccaggtgaatcaatagaaatgcctgattgaattagtaggttaaactaaacaacatactgtcataggaaaactggagagcttaaccaacttgctcttagaaatgttaccttaaaaaaaaaaaaaaa

SEQ ID NO: 3043 - DNA, 722 bp, Homo sapiens
  misc_feature (251)..(251): n equals a,t,g, or c
gaattcggcacgaggaaagtttcaaccctctgacatgtgggttcagcttatttttttctttgttcagtatggagactctcttacttctgctttttttcctttctcttctaatttttcgcttcagaattctggtttctcaatgcataaactgaagtaatttcttccattctacttttctctgccccaggcttgagatagaactagggagcccagtgaggccttttctttcctaaattaacaggcatctgtgncataaatgctacctttgaactatgtgatttaagataatgtgcagaagtacttctctggtctttcaggttgcytgcataactawgtacttggttgaacttgtaattcttgctgacaacagtcctgctgttttccagtaaggttcgtgatcctcgggccaattttgatcagtccctacgtgtactgaaacatgccaagaaggttcagcctgatgttatttctaaaacatctataatgttgggtttaggcgagaatgatgagcaagtatatgcaacaatgaaaggtaaagaaattgaaaaatgaaaaatctttcccatgtaatttgagtaatagccaggaacccactcactttgaaggcccttctaagaacaaagaaaagtatatggttatagatggcagcatgaaaaggaaaccaacttgcacatgcaccctcaaatctaaaatacaagttaaaaaaaaaaaaaaaaactcga

SEQ ID NO: 3044 - DNA, 838 bp, Homo sapiens
ggcacgagaaacacaatactgtttctgcgtcataacaaagatctagttgcgcaaactgcacagccagaccaacccaattatggttttcctctgggatctcttacgctgtgaaagccttcttggtttggaccctgcaacttgcagcagagttctaaacaaaaattacacgctgcttgtttccatggctcccctcaccaatgaaatccggcctgtcagcagctgcacccctcagcatattggaccagctatcccagaagtcagctctgtctggtttaaactgtacatttatcatgtcactggacaaggaccaccatcccttttattgtccaaaggtacaagacttcgaaaactgccagatatatttcagagttatgatcgattgctaataacatcttggggtcatgatcctggagtagttcctacctcaaatgtgctcacgatgttgaatgatgctttaacacattctgcagttttaattcaggggcatggtctgcatgggataggagaaactgtccatgtcccatttccatttgatgaaacagaactacaaggagagttcactcgtgtcaatatgggtgttcataaagcattgcagatactaaggaacagagtggacttacagcatctctgtggatatgtcaccatgttgaatgcttccagccaacttgcagatagaaaactcagtgatgcttctgatgagagaggagaacctgatttggcttctggctcagatgtaaatgggagtacagagtcatttgaaatggtcattgaggaagcaactatagattcagcaacaaagcaaacctctggtgccacaacagaagcagattgggttcct

SEQ ID NO: 3045 - DNA, 510 bp, Homo sapiens
  misc_feature (380)..(380): n equals a,t,g, or c
  misc_feature (396)..(396): n equals a,t,g, or c
gatcccccgggctgcaggaattccgcacgagtgaaaaccgcctccaccaacacccccgtttgcctacaccaccccccttttacttagtatgtttattttttgtgtgtctcttgccttcctcccacgttttatttcccctcagagctgtgaatgggcaggtctgtctctggtttggcatcactgagtttttcccatgcattggccccagggctgctaggatgtgagacaaatctccctacaatgggcttgctcccattgtctgtacagtttaatagatgctggcatgtcggaggttacccatgagtcaaaatccgctctccatgcttactcttgacaccccattgaagccactcattgtgtgtgcgtctgggtgtgaagtnccagctccgtgtggtncctgtgcttgtactgyccctgctttgcagttcctttgcacttactcatcgagtgctgttttgaaatgctgacattatataaacgtaaaagaaaaaaaaaaaaaaaaaactcgta

SEQ ID NO: 3046 - DNA, 611 bp, Homo sapiens
  misc_feature (17)..(17): n equals a,t,g, or c
aggatttcggcacgagntcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagcctccccatggccacccatggaccagtcggcattcacttcctcccttctgcggcccataaaagccctgggttcaggcagagctgagcagacatcaggtgaccagctgcagaaaggagctacccactccagggcctcatctctgctgagagctgcagagatgaccagaagacctgcatccagagaggagcttcctgatccagggctattctgtcactcaataaagcttctctttgtcttgttaaaaaaaaaaaaaaaaaaactcgta

SEQ ID NO: 3047 - DNA, 1201 bp, Homo sapiens
  misc_feature (1192)..(1192): n equals a,t,g, or c
  misc_feature (1197)..(1197): n equals a,t,g, or c
acccacgcgtccgaagtacaagtactggtttagctttatggttaaaagcattggctctagagcagataacacaggctcaaaccctagttctgccgtttactggttgtgttaccttgggtaggttacttgacctttttgagcttcagatttctaatctttatttaatgagttttaataatagaataataggattgctttgaggatcaaataagttaataaaccacttagaacagtgttcaataggctggatttttgtttgtttgtttgtttgttgctattctttttgtgttatgttttgtatccagcagaagtggttatttagcttcctattttatgaggtaggactgatgggaattgacagtcttaggaaaaagtacaactgtaagtcagtggaagtttttcctagtcaagatgtcaaatgccagaggtcggattcatgtggcaggatggggtccaaactgtacaaaagcttggagatgaatgaggtgagacagctaagcttaagacaaaaaacaatgtgaagttatgtccttgggcagtgtttgcagtagtatagtgccgctttggaaaacttagaagatgatcctcaactgtgtccactcaaaatagattgtgcatctcaatgtcatagagtcagaaatttctaccactatctgtttaaatcatcgtttatttatattccttaaatattcatacctttcacataagtgagatacattatttttaaaaacgcagttttccttcttgattttttcatattgtcccattattctgagaagagtttattttatgagaattaagttattatcttacagaataaatckgattacygactagatacaagataaccacatatttttcctagaataatttaattccaattttacttatttgkaccttatatgacttattttcaggttagaaaaatgtggtcctacagttttgttttgaagtttgcctgggccatgtgaagccaccattatcatttacgtcaaaaatgaaggttatctgttgcccaagagaaaaatacagcattctgaatttaaaacactaaaatagtgagggtttcataagctgtttcagtgatttctgaccttgggttggaaagctctcatgtctcagttacctcagtgggtatagtgacattgtcccagtctgcattaccaaattgtttcaaatcactttaattaanaaaantaaa

SEQ ID NO: 3048 - DNA, 930 bp, Homo sapiens
ggacaaaattgacccattttcaaataatgtttataaccaggggctgttactgttttgtttttttttycctagctcacaattgtaaagcagcgagaacaaccagaaatggttttccgacagttcctggtagaagacaaaggactttacggaggctcttcttatgtggatttcctttgttgtgttcacaaggagatctgtcagctgcttaattaattgaaacttctctgtcattgatgttgcatttccaaggagataatctccttcttggtgcctaattttctagatgataataggctagttttgatttcttgctcattttcagaataactttccaggaagagatggcatttagaacttcagctttggtgctcaggtataaagccaattaaggtacaattgtaccataaagggaacaatctgtttctgattgcacagtttctaatttttaaaactgatgtggtttgcatttcataaaaggcaaagtttacagaaccataaacattctcaattttctttatgctagacatataaattatttttcaaactgtatagatttggggtaaaaagttgtctcagttcctctcccaattgcaatgagaaaaaaaagcttaatttttacattatacttaattttctaaaaccatgtaactccattgaacacatttttcaacttaaggtctgcatagcagacttttaataaccttgggatttatctggtagaacaatatgtgttctacatttttttcataattatatattgtgtatgttaaaactattttccagttgttttgtctgtaaaactgtctttatcaatatgcttaatggttctttgtacaattttgaaagtttctacctgtatataatggatgttaaccagtatcaataaatcattcgtataatcttaaaaaaaaaaaaaaaaaaaactcgtag

SEQ ID NO: 3049 - DNA, 642 bp, Homo sapiens
aggaatgccaggtcgcactccaccttgctggccggcaagtcctcttaacctgttggtctgctttctttgttacaaagttggtctggcttatactgctgaaggtcatgggatttttgctagcatattattgaaatgagacatttgtggcactggcgttgtattgtttctgctaataggagcccgcgtgtctttcacatatggttagtctgattgctttttctagcctgggactttgccttggagagagtcctagcaaaataccattcacagccttcttccacagggaaggatgactaagagtttagtgctggaagagcagaagaggaaagctggaagatcagaaatgaaattggagctgttgatgcgtgtgtctctatggtacagtgggcaagccctagtccttcttgggttgatcactaacttgtcatgcagtgtcttgggcaagtcctttcacctctcaggacctctgtctgtctccctatagaacggggaaggtggccgggcatggtacctcacaccaccagtgctttgggaggatgaggcaaggggatcactggaggctaggagtttgagaccagcctcagcaacagagcaaattcgtctcaatttaaaaaaattaaaaaaaaaaaaaaaaaactcgta

SEQ ID NO: 3050 - DNA, 512 bp, Homo sapiens
  misc_feature (483)..(483): n equals a,t,g, or c
  misc_feature (487)..(487): n equals a,t,g, or c
gtggatcccccgggctgcaggattcggcacgagtctgactggaaggggtgaggtgtgcagataattttacttttcaactacagaaaagatgtatctgggtaaagaaaatcatgcatttaactacatcaatgcagcctatgaacaatagcctgtgaccataactagatatctcaccaacgtggcagctcttcctaaccaaaagatcaaatcaaaactctagtggcattttcctatcactcacagaacaggctaagcttcccacctggagtagacccggagcctagaactcataaaaatttttaaaaatcaaacaaaacatgaaagtacaaagtttctacaaaactcttatccctctcctgacaatatttatgatggtggcattagtgaattttactggaaaaaaaaattcccaaaactatccagctggraatataagctcacttccaaaggataaaacagttaagacgagattaggataaattnactnacaaaaaaaaaaaaaaaaaactcga

SEQ ID NO: 3051 - DNA, 1188 bp, Homo sapiens
  misc_feature (577)..(577): n equals a,t,g, or c
  misc_feature (1022)..(1022): n equals a,t,g, or c
  misc_feature (1052)..(1052): n equals a,t,g, or c
gaattcggcacgagtaattttgtatttttagtagagacagggtttctccgtgttggtcagactggtctcgaactcccgacctcaggtgatctgcccacctcggcctcccaaagtgctgggattacaggcgtgagccaccgagcctagccctgtttaggctttttatagcctatgttcttatgagcagtaaacattatgaatggtttagttagacctgttgaattgaattcacttcttctgcctgtggtcaggtatcaggtagcacagccacagaagttactgaatgtctttgttggtggactttaggaaagtggtttaatttatgtggtattcctatctgggaattgcaacagtattgttagattgcattttgtcacagggaggaaattacctggtaactccctgattaggaacaaaatgaagcttcccctttttacaaatcctggctaacattccatttggatctcttctgttgaacacctctctctctcccctccctcctcactccattttctcagttattttattgtttactattggaagtcacctcccaactcaggatacttgttagtccatnttaggaaaaatatcaccattctttcactattattctctgttgaagttgaagaacagaatattactttttttctttccattattggttacaccagctagttagagacttggggtaatactgtgggcatgggttggatcctgatatctgtgtcagttagtgagagttggttctatgaccctagagctctttgtgtccttcaaacgagggtgctgaaacaagacgaacatagaactgtctataccaagcaaaaaactcctgaaagcacatgcccactgcaggtgaattggtagcatagtgtggagataagtgggcagtgcttggtcctgtttctgcctcctagagagtacctctcagcatccagggatgctttagtaactcttagttaaaacgaaatgaactataattaattaccttttttttgggggggacacagagagtttccacngcatttaccatgctttttttttttttttgnaaaggaaatatgataggatattaagattgacagagctggggatgggttggaggctgaattatgatgtgtgtatttctttatgcttggattatttcataattaaaaaccaaacatataaaaaaaaaaaagaaaaaaa

SEQ ID NO: 3052 - DNA, 3186 bp, Homo sapiens
  misc_feature (24)..(24): n equals a,t,g, or c
  misc_feature (666)..(666): n equals a,t,g, or c
  misc_feature (682)..(682): n equals a,t,g, or c
  misc_feature (3181)..(3181): n equals a,t,g, or c
  misc_feature (3184)..(3184): n equals a,t,g, or c
gggaggtcgagaagccaataagtngtttttcattgaatcctgcattgcactctttgtttccttcatcatcaatgtctttgttgtctcagtstttgctgaagyrttttttgggraaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttytgaatgttctacagagcttacagcttccctttgctctcatacccatcctcacatttacgagcttgcggccagtaatgagtgactttgccaatggactaggctggcggattgcaggaggaatctggtcctatcatctgttccatcatatgtactttgtagtggwttatgtccgggacytaaggcatgtgscattatatgtggnggctgctgtggtcaancgtggcttatctgggctttgtgttctacttggrttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccattgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttacatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttccaaaaaaaaaaaaaaaaaaaaaaattnctngg

SEQ ID NO: 3053 - DNA, 711 bp, Homo sapiens
atagggcgattgggtacgggccccccctcgagtttttttttttttttttttttagagacagagtcttgctctgtcacctaggctggagtacagtggcgtgatcatagctcactgtaaccttgaactcctgggcttgagcaaccctcctggcacaatctccttgaatgatgggtcccaagagccagacagaacggacttcctcccttatgcctcatcaagttagagagagaagagctcacatcccccaaatgcctatgaacacataactctactgattcctgacctgacctgccttggcctcaagagggccaaatgctcaattccttgagttcaaatctttttccctgtattttctcacctgtggggtccacctctgtccctctgactcacagaatgtgactgcccccctccttcttatgatagtccttcagaggtctgaagacagaaagcatatcttccttgagtcttctctaagttgaatactcccaatcaccccaaacagagtagtgcagtgcaggaaaagtatagttttgtgatcagagttgtattcaaaattccatatcacaacttactaactacatgacctagagtatgttctttcacctcacagaggcaggagcattgtgaggattaaagcgcctagccaggaataggccatagtatgtgctcaataaatgatacttctcaagataacaatctcgtgccgaattc

SEQ ID NO: 3054 - DNA, 762 bp, Homo sapiens
  misc_feature (10)..(10): n equals a,t,g, or c
  misc_feature (12)..(12): n equals a,t,g, or c
  misc_feature (42)..(42): n equals a,t,g, or c
  misc_feature (219)..(219): n equals a,t,g, or c
  misc_feature (747)..(747): n equals a,t,g, or c
cgagtcagtnancgagaaagcggaagagcgcccaatcgcaanccgcctctccccgcgcgttgcccgattcattaatgcagctggcacgacaggtttcccgactgaaaagcggccagtgagcgcaacgcaattaatgtgagttagctcactcattaggcaccccaggctttacactttatgcttccggctcgtatgttgtgtggaattgtgagcggatancaatttcacacaggaaacagctatgaccatgattacgccaagctcgaaattaaccctcactaaagggamcaaaagctggagctccaccgcggtggcggccgctctagaactagtggatcccccgggctgcaggaattcggcacgagcacaaatgcctatacaaaacttttttccatgtcctcaatactttgtatcagattatttatatttctcatggtttggtttctttttcttgtcttcatttttctgaaggtaaaaggggattttttccccccttttctgatctgtaacttgttttgtatttggatgattacaggcgtgagccaccgcctccagccacaaatactttttagtcgccataagcataatcaagaaatcattttgcaaatggtaagcttttcatgttgtgtattctttcccatgattagagaggtaaaaagtgscctgggatgcataaagatgtcgtagacmtmtgcaatctgccacattatttctttaaaaaaaaaaaaraaaaactcgagggggggnacggaacccagggcg

SEQ ID NO: 3055 - DNA, 1570 bp, Homo sapiens
gatggttttactgaagttgctaaaagtttacagaaaaggaagtgcaggaacatttcacaaatctacaatctgtgagtatcacatcctgtatagctgtmaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttraccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggawctctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtcatttaagatatgtgttcattggggatctcttgatttgcctgacattgacttcagcaaaagcacggggctgtaaattaccatttactagattagccaaatagtctgaatttccagaaaacaaggcagaatgatcattcccagaaacatttcccagaaaatgtttcccagaaaactagacagmatgatcattcaatggatcacagtgaagcaaaggacacaactttttattgtaccccttaattgtcaacaggagttaactgatttgttgtggtgctcagacttttttatacaggtgctagtgttttatcctatgtattttaactcattagtgcataaaggcaagccccatataatgaagtctcagggtatatgaaagtagctggcttcaaaataaaatttttgagtgcaaaaaaaaaaaaaaataaaaaaaaaaaaaa

SEQ ID NO: 3056 - DNA, 1808 bp, Homo sapiens
ggcacgagatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgtataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttctatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcaaaaaaaaaaaaaaaaaa

SEQ ID NO: 3057 - DNA, 378 bp, Homo sapiens
tcgacccacgcgtccgtaagattaaatcagataatgcacacggaaatacgttacaaatggaagtgttgttgttcttccaagtttgcaaggagaggcagcggcagtgttcttgcagtgtgtctgagttccacgtgacttatattggattattatataaatcctgtaattgatctgtcatacttttatgtccattctttatgtcatatttctctctcacatatacatacacagttgtatacatacttaaatctctatgtattagcagtctgcacaacatataccttttaatatttatatttctgttcagttctgttcataccacagaatatgtgttataaactcttttattaagcttaaaaaaaaaaaaaaagggcggcc

SEQ ID NO: 3058 - DNA, 611 bp, Homo sapiens
  misc_feature (19)..(19): n equals a,t,g, or c
  misc_feature (21)..(21): n equals a,t,g, or c
  misc_feature (47)..(47): n equals a,t,g, or c
  misc_feature (607)..(607): n equals a,t,g, or c
  misc_feature (610)..(610): n equals a,t,g, or c
atgaattaacgccaagctntnaatagggactcactatgggggaaagntgggtaacgcctgcaggtaccgttccggaattcccgggtcgacccacgcgtccgatggggctttagtaaatcaggcttgcaggctcaaagctgcaatctgcccactctcaggtactgagactttgtgggcctcagacaccaggaagaaagttgggatacagtcatttgagttaaaaagggaatgacccctcagaaacccgcattagcagtgttactcttggaagtgcctttacttttaacgctctctgttctgaaaaagaggtgtttggttacgtgtgagccaacatcacgttttgttagctgtgatttacctttgtccgtttaaaagacttcacggagccattctgtatacaaggtgtgctctttccaatgtagaaggggttatggaaaagggtgcgatcctttgctgtaaactggagagaccagtcccaaacagaggggaattttaagcccttctcatcacccaattggatgtttttgcttatagcaaattcctgcaaaataaataaataaatatttgcaaaactaaaaaaaaaaaaaaaaaaaaaaaaaaggggggnccnc

SEQ ID NO: 3059 - DNA, 669 bp, Homo sapiens
ccacgcgtccgctgattctggccccagactgagcctggatcctagtcacagactgagctttgatgccagttattgactgagccttagtcttggtcacagaatgagccccaaccttggtctcaaatggatatccatgattctgatcacatattgggccctgaacctggctccagtagtggcctcaatcaatcttttcacatctaccattgttctgaaggagggtgaggggaatgaagatgagtcagtgccaggtgctaatgaaagaccccaaaccacaggtgccagtttcttcttcccaggacttaaaccgcatggggtattgtgggaaagagctgggacactggagccaggtcaacttgggtcccatcaagtgcccagtggatgactgacagctgggtgtaagggcagcctagcagcaaatgtcctaacccccttggtctcattccagattggttcccagtggcttgccccacccccttatagcatctccctccaggaagctgctgccaccacctaaccagcgtgaaagcctgagtcccaccagaaggaccttcccagataccccttctcctcacagtcagaacagcagcctctacacatgttgtcctgcccctggcaataaaggcccatttctgcacccttcaaaaaaaaaaaaaaaaaaaaaaaaaa

SEQ ID NO: 3060 - DNA, 2053 bp, Homo sapiens
ccacgcgtccgggcatgggggtttacttttgcagagctcagaggcacccccaggccctgtctgcttctgacaggccgtaccctttatttcctcctccgtttcatttggctcccagtggctgctctgcggttttgatttccctccagctatggcactgaattcatttatggaaagagacccaccacctaattggcggatgagcttgggcttctgggtgtggcttccttcttgctgtcataagatgctggtggtgacctgcacatttggccactacctcccgctggaatccagccaccatctgtgagatggggcatgacgcggtccagtggagggtgcgtgctggagtctctcccgtctccaccacctttgttacagatgttctttccgaacgtaggtctctgccgtctcttacttgtttaaaacgcccagaacccgagtcagccttggcagtgagcttacggcccgcaccaggaggggccagcctgctgccaagatggggacggttccctgggccccgcggtctgcggtgccgcctcccgcttcaccgcacggtgctctctttcccccaccccccctcagaagcgccggcatattccagaggagtcaacaaacaaatggaagcagagggttaagacagccatggcgggggtgaaattggtacttttctattttgcgggcagcgcgcgtcttgactgtttgcaggcaatcaaagtcgattgtgtttttcctcaacaaactgttgtatattttttttttaacattcacatccgtgtttctctgtcttccttcggcacccagtgagcccagcatgttgcgatggcactgcatggctatggtgggtctgcggtggcggggacgggggtggggctctggcttgacttggagctcgtgaaacgtgcttgtcacaactgcctgcaagtgtttcttggtctcctcgttaacatgcatgccacccaccccagaacgagtggcctccggtgtcatgcccgtctgcattctgtgacctaatacatgcattttcccatggaaaaatccacccccatttgaaacatcccggattagtgatgagcttctacctagggtttctccagaccaagccaaccctgggttctgagagccttcaggacatgtgtcaccgcagacgacgttttaacttgtagtgctagctgcttgtttcaacttgctccacaaaggaaaaataactattatggtctgggtggcactgggaaaacatcttccatcttctagacttagaagtgagacttttagctgaagaaatggactccaagtccaggtttctcccagacgtgggtccaacagtctttagaaaggcagctggcattacaatgtcctacacacagaggaatcacagtgttaaacggttcttgctcccgttatcctgtgacataggtgataaaccccgaaatgcttcttggaaccctatgcgtttgcactggctcatcacctgtgggcatttttgaggtttttctgagtatttctgttgttcaagttgtccctgggcccatgcacgcacgcacatgcacccacgctgacacacagagatgtctcatcgtgatggttccagacagtgaccggcattgttttgtgttgtagactgacaaagtgaagctgacatggagagatcggttcccagcctacctcactaacttggtctccatcatcttcatggtaagttccagaaggttaaggccagacgaagtcaggggaaaccgcaaggaagtgattggcttcagccgggcgtggtggttcacgactgtaatcccagcactttgggaggccgaggcgggcagatcacttgaggtcaggagttcgagaccagcctggccaatatggtgaaaccccgtctcttactaaaaatgcaaaaattagctggtgtggtggtgcatgcctgtagtcccagctactcaggaggctgaggcaggacaattgcttgaacccgggaggcagaggttgcggggagccaagatcacaccactgcactccagcctgggtgacagagcaagactctgtctcaaaaaaaaaaaaaaaaaaa

SEQ ID NO: 3061 - DNA, 2349 bp, Homo sapiens
tcgacccacgcgtccgtctatttctgtgtctgtatgtatgggatgtgtctgattgtgtgtctgtggtgtatttctgtgtctgtatgtatggggtgtgtgtgattgtgtgtgtgtctggtgtatctctgtatgtatggggtgtgtctgtgtgtgattgtgtgtgtgtctggtgtatctctgtgtctgtatgtatggggtgtgtctgtgtgtgattgtgtgtctgtgtttatgtgtgtgtgtctttgtgtgattttttgtgtatatggcaaacccagaacagaacattatcactcacctcacctggcaaaacaaaaagctttcagagagatgtgtggccgtcatgatgtctcagctgcaggcatttttcaaagttatgtttgatgcagctggcacctttcttctcggggacaaatgtgatctttgatcattgagttgagaatgagtttactcaataattttaaaatgcctcggtgtgagaggatgggctgctagtaaacatttgtggcaaatatgcgttgccttttcctccttcaagtgcatggggcaggctgcttctctgcacgtccatctgtgggtcagtctgtcctgccacctcccttgccccagggcttagtgccctgtgtggatcacggctgccccagggatgctggggaaggattcagcccaacaaatagattcgttgacgtcctctcaacgaatgtgtgcttttaaaaatgtctttaattttgcactccatttcatacaacaggtgcacatttaaaacatttatttttaaacagctctgtcttctcagcactgcagactatttctcgctcacttgacaggcagacgttgggactatgttcttttcctgccaagaatccatcagccccccaatgcctgcacctcgagtccagactccttagcgttgcgttgggacgtaattccccgttagcatccccagccccttctccccctgtgagccagcctgggttcttttctttttcctttcttccctgttttccttctttcttttttgggtttgtaataagtaatatacagtcttgtggttaagaaatcaaaataataaagaagatacggcttgaggattcttgctctgcactggtccttccgccaggacctggtgcgtcccccaagagggccttgccatgtgcgagctgagacacatgttcacactttcctccttttttgtacaaaaggtagcacatggtaaatagcgtctgcacgcttctcccctcgctctgtcttcgggactactccacatccatgaagaagcagcatccttattctcttgcacagtgggcagtggctacactgtattcactcgtctctgctgatgggcactattgtagtggtgcaattagtaacctagtatacatgcccttcagcgtgtgtactggtgtatggatctcacattcccagaggctgagtgaaagaataaaggctttttgacagtattcctcaggtactcacacactcgctctgtgagccacgtgatcatgggagcggctccctgcagaggtgtctgatgggagaggctgatgtccttgtctgatggttgctccaacctgagaatggtgagctgctctcccaatgcagactttcatcacttgcatctcatgcgtgagattgaactgcttctcatttatgtttttatctttgtttgcccatattttagctgggttgctaatcttttaatgttttctaggcgcttttcataaattagggagtttagctgtagtgatgtgagttgaaagtattttttcaaatcgtcattgtcttgactttcctttttttttttcttttgccacttaaaatatgtagttgaatctcagtatttgggggcttctggattttgagtcgtagttgaaaaggtcttcctattctgaggttatacaggaattcacccatttttttcctaatattttatttccatttaaacttttgacccacttggattgattttgttgtatggtgtcaagtatgggtccaagtttgcttttctgacctggggatcctaacatcgttcatcaaaatctccatgttggccgggcgtggtggctcaagcctgtaatcccagcactttgggaggctgaggtcggtggatcacaaggtcaggagatcgagaccaccctggctaacacggtgaaatcctatctctactaaaaatacaacaaattagccgggtgtggtggcaggcacctgtagtcccagctactcaggaggctgaggcaggagaatcgcttgaacccgggaagcggaggttgcagtgagctgagattgcgccactgcactccagcttgggtgacagagcaagactctgtctcacaaaaaaaaaaaaaaaagggc

SEQ ID NO: 3062 - DNA, 842 bp, Homo sapiens
tatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactactaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaaaaaaaaaaaaaaaaaaaaaa

SEQ ID NO: 3063 - DNA, 1559 bp, Homo sapiens
attcatgccaaaacataggctttcagtgcctattacatatggctttcagctctctctactgagggatgtaggagtttatttctgaggtctgagcctcttttcctttacttcctttactctttcctaagccttctttataaaaactatgcatgttctattgttttcctttttgattccctttcttttattatccccagtaggagtgacttgtaattctcatatgttagaaaggcaggtctcctggttgaagaaaagatccacccaagcaagtcagcagtttaataaatttttgagggggatctcaaatgtgggaaggattgttatataagacaaccaaatgatgacatgagacaataaatgctataggaattatggaggaataattagctatttattttcttggttagggaagagatattattagttgtagaagtaattactaacttctacattttttattgtggaaatcaaaaatatatatatgaaaataaaatgttataattgacttcagtgtcccataaaccagcttccaacaattaccaaattgtgaccaatcctttacacacatgcacaggtgtccctccagtatctgtggggcattggttctaggaccacttatggataccaacatctatggatgctcaagtccctgatataaaatggtggactatatgcatataacccgtgtacgtcccgtattaaccaaatcctccctagatcacttacaacacgtaacacaatctaaatgccacgttaacaaccgtcatactgtattaagcgaataaccccgccaaaaatgtacttctctcagtccagacgccttttttttttgtgtgtggaatatcccagcccccaagtccccttcaaccccctggcacataggaggctgactgcgtgtgtgtgtgtgtgtgtgtgtgtgtgtgtgtgtgtgtgtgcatacagacacacatatctctgaaatgtaaatattctctctttaaaaaaattattatcacagctaaacaaattaccagtaattctcttatcctcatatacccggtgttcagattttctagattggctcctaatttttttacagattatttgaatctgattcaattcatgtactgtaatgtttgataacttaagtaccctttataggttccctttaccacttctttattaaattccttgtaatttgttgtactaaatggattgtcttcctagaatttcctgtagtctgaattatgtggtaattgttcacatgttccagtgtcctcttatttcctgtgagttggtagttagatctagaagcttgattaaattcagattttctctctttagatcatcaactttagatcatcaacttggatcatttgtttcattttgcttttgatatgttgttttttagaattacctcttaaaattttgatttaattttataatcatgtaaaatgtttataaatttccaaattcagatcagcaaaacacaataaaatctattcagagaaggcaaaaaaaaaaaaaaaaaaaaaaaaaaaaaaaaaaaaaaaaaaaaaaaaaaaaaaaaaaaaaaaaaa

SEQ ID NO: 3064 - DNA, 1037 bp, Homo sapiens
aattcggcagagcggctgtgggcactggacctagctgctagcttgctacatctaaggtcgaccagacggttctcaccaccggcagtactgctcagggaataaggtgaaggtggactcttcttgttcagtggagcacatgtggtcctggagaaagctgtcacacagtggactcagagatgtggtctacgggcactaatttcctctcagtccctgcctaagcaagattcatcttcctctgcctgctgtttcatttttttcttctattgtctggtatatcttaagataaaaacttgtttccaaagggaaagtttcagaaatgtttctaagaataataattcaagttggatttccaagtagtattcctgggcaactgattaaattcttttgtcaataatcaaaatctggaatgtcctggattagttccaccatttcatcatgataactccctcttctataatccctaccagaaatgattgctttgcttaaaagcttttccctgagaagacactggtgtgttatttctttatcagcttatgaaaattaattctggttgggtacagtggctcatgcctgtaatcccagcactttgggaggctgaggtgggcggatcatgaggtcaaaattgagaccttcctarccaacatggtgaaaccctgtctctactaaaaatacaaaattagctgggtgtggtggcatgcgcctgtagtcccagctacttgggaggctgaggcaggagaatcacttgatcctgggaggcagagggtgcagtgagccgagagagcgccactgcattgcagcctggcgacagagcgagactccatctaaaaatatatgtatattaattctacatatctaggatttttactgtgcctttgtgtttttttaagctactggttttctcaagttaaacattaaaagtattatggaagtactgatgatgtactcagaggaaaacaatagagcatataatttatttgttataaaatgtaaaagttcaaaaaaaaaaaaaaaaaaaaaaaaaaaaaaaaaaaactcga

SEQ ID NO: 3065 - DNA, 2541 bp, Homo sapiens
ggcggaaggggaggacgtgggatggtggcggactggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctattgcagcctgttcccggggcgcttgcttcctctgcccgttctctatacagacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagaygggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggaggacgccctgaagcagcgggcggaacagagcatctytgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgaractggaccctcaccccctattcactccaagcccctaacgcctgctggccacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaaaaaaaaaaaaaaaaaaaaaaaaaaaaaaaactcgagggggggcccgtacccaatcgcctgtgatgtatcgtat

SEQ ID NO: 3066 - DNA, 995 bp, Homo sapiens
  misc_feature (7)..(7): n equals a,t,g, or c
  misc_feature (16)..(16): n equals a,t,g, or c
gatttcngcacgaggnaacagctttattcttggttattcctaatgtccacctagtcctctttwactttycttggtagggttagggtggcatggggaaatgggacggtatcattttgtctttttaactttttttttttccacctacagcagctgtttttaccctgtggtcagtcaggtactatatttagtttgcagttgcactgctgatcgacccttgatggccccagttggaagttgtttggggggaaggaaytaggagaggccaggscctccatttaaaccatgtctgtaatgtctccttggaaagaaaaaaagatactgttccagtcatggtttcctggtagttgacgtttaaaatgggcctcatttaaaaatttcaataattcaggctaattttttccctttatatggtaactccaccaagtttgtctaaatgtatgatttttatcatgattaagtttttayttccacatcatgtgacaactggcctgggatgggatataagctcagaacacaaagtcattcacctcttaaaaaaataattctatctgtggcgggttatgttatttttgttcaaagaggacacaatatgatgcagaatacaccattgaaggattttttggtttggcaagttcttatttttttaaatggctgtaaaacctagcagtgtttctgaaattgcataccttacctgatgttcagagatccgatttacttcttgatttcccagcaagtgattttgaaaacatttaatctaatcattccccccaccgtctgttcaaatcaaaggaagtggcatccagcactaattttcatgcatttatgaaaggatgcctgaggacccttaagtataattcaaaattttgtttaatgtgtgttccttgatgaagttctttaggagtcgtagaacgaactgattgcccactgatcatcaaatgcaagttatgaacatttaataaaaatttaaaaccaaaaaaaaaaaaaaaaaaactcga

SEQ ID NO: 3067 - DNA, 704 bp, Homo sapiens
ggcagaggaaaggctgtcagggtgaaaatactcttcttgcccttcggctgagataattctgaagcatattttacttagttttctagagttcttcttggtaattaatgcaatcaagctccagtctcctgctgtgatgactgccttcataacataccctttattatttatctgtcttccctccgtatctcacttcctacctgttcctacttgtctatttccctgtgagggactgaactgtgagcccctcagattcaacgtacgaagcccctaaatttatttgttcgagtctgaagccaaagtacctaagaatgtggctttatttggagatacagctttaaagaggtgatgaaattaaaatgagatcatgaaggtacactctaatccactatgactggtgtccttataagaagagattaggacacaacacacacagagggaatcccatgggcagacacagggagaacacagacatctgcaagccaagggcaggagcctcagaagaaaccaaacctgctgacaccttgatctcagatttcagcctccagaaatgtgagaaaaataaatttctgttgtttaagccacctagcctgtgatactttgttacggcagcccaagctaattaattcactcccaattaaactgttcgcccttgaaaaaaaaaaaaaaaaaaaaaaaaaaaaaaaaaaaaaaaaaaaaaaaaaaaa

SEQ ID NO: 3068 - DNA, 931 bp, Homo sapiens
ggcacgagcggccgcgggacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatgcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtataaaacaaagtcacttttctccaagttgtatttgctatttttcccctatgagaagatattttgatctccccaatacattgattttggtataataaatgtgaggctgttttgcaaacttaaaaaaaaaaaaaaaaaaa

SEQ ID NO: 3069 - DNA, 880 bp, Homo sapiens
aaaacatcaagcaatgtttattgtgcaattccaatcattatttgcagaatcttggtttagagtcagtctttatagccatttcaactgcttggtttaaacaaaaagcaacaatctggttatctacctataaatttcacggtatttctttaaacactgaagtactaaaagcactgatgatttgtattataatttttaaaatatttaaaacctacacagatttcatagatcattccttttataaaataatcaaaataatttgattatctggaaaaaaaaattcttgaaacagagccctttccaggtatcttcaatctctgtaaaaccccaaaccccaaacagagtagatgatgaaataaggatttctcagttgcccaagactgtctgaaatttaaggttgagaaatggactggcgtttttcatgtttcctgtgaattcagagcttacaggtggcatcagaactcaaatctctgggatggctttacatggctttcactttgatttgtttcattttcatttgcttcttttccaacttcttttgctcacgcctcaatgcagcctcctccagcctgcgctgtttctcaggatcttcctcattcatgattcgctccttctctgctctttttttctcctcccgccgagactgtgctgcttcctgtctttgcacatgtgtcagtttcaagaagttctcttctactcgggcacggttcttatctgctttttgtttgccttctctgttgagtcggaactttttggctttatcaatagaataaatcaccatgttcatcaggggtagcagtgcctccatatcctttgggtaagtgttacctgagccaggcacattaaatgtaaacaacagtgtcctcttagtgtcactcgtgcc

SEQ ID NO: 3070 - DNA, 4155 bp, Homo sapiens
  misc_feature (1258)..(1258): n equals a,t,g, or c
  misc_feature (1925)..(1925): n equals a,t,g, or c
  misc_feature (1969)..(1969): n equals a,t,g, or c
  misc_feature (2838)..(2838): n equals a,t,g, or c
ggcacgagtcgcgagcatcaagatgctgcacaacgcgttcctgttcgtgttgttcgcgctggtgtcgggttacggcaactacgcagccaccgcgcatgactggctttacgaaaatggccagctcagccgcaaggaagcggacgcggtgctgtaccgtgcgctgcgcgctgagggtgtggcgcgttggcgagcttggctgatgtatgcaggtgtccgtttaggcggtgccaagcaatacaagaccccgacaagttcggggttttcttcgtctggagattgaaaagacgaagccccggcgagctgtaatcaccagggcttctattttctctgatcgggacatatcgagaacgtcctgcaatgctaccagcgcgccaggaaaagcaaaaccctgacggtactcagtcgtcagggcttctattccctcctgcagggtgtgctataggggggcgtgccgggatgatatcaacgatgcctcggcaaatcaccccacctatcgaccacaagtttcagctatccagctcgccaagtgcgggttttttttcgcctggaggaaagtatgcacacatcacaaaagggcgtaagccttatcaaatcgttcgagggtctgcggctcaactcataccaagactcggtcggagtgtggaccattggctacggtgcaacgcgcggcgtcaccgccggcatggccattaccaatgagcaggccgagcggatgctggtgaacgatattggccggtttgagcctgagattgagcgcctagtgaaggtggcgctgacccagggccagtgggatgcactggtgagttttacctacaacctgggcgccgccaacctcgggtcttcgactctgctgaagctgctcaatgccggcaactatgctggagcggcagatcagtttccgcgctggaacaaggcgggcggccaagtgctgacaggcctggtcaagcgtcgcgctgctgagcggtcgatgttcttgggggcggcatgacgcccgggaacaagctgatcgtcctgtgcctgggcgttcttctgctattggtcatcggcgccggcggcggtgcctggatcgcctcacggcattaccgtccgctgctcgatgccgccaacctcgacttgtccaccaccaggtcagcacgggacaaccttgaggcgctggcaggggagcagggcaggaagctcggagagctggtgcaggccggcgatctgcgggagcggaatgccgcgctggcccaggagaaagcaatgcaagaggcccagncagactactccgcagccaatcagttgctgcgggagcgaaccggcggtgatcctgcccaggctgccgccgccatcattgatcaggagttggggctatgaggcgaattaccggctttacacttggtgtaatgatggttatttggtgttttgcactgaccggctgtgtggcccgagagcccgaggtgcgcaccgttcgggcggaagtgccggtgctggtaccgtgcaggacgaaggcggtagcggtgccgccctgggctgcggagggcctgaagaagtccgatagtctggagctgaaggtgcgcgcgctgctggctgagcgtcgacagcggatcgggtatgagcgggagttggtcgcggcggtgagcagctgtcaataacaggcgaccaaggtctgatcgcactgcgggcttgccaggcgtacgttatgtcgcgttaagctgtactacacggaatgaaccacgcataaggaaaggctatgagtgaggattttgtagggctgggagtgctgctggtcatcccctggatggttgccattgcgcttatcatttacgtagcggccaagtagaaaagcaaagccccggaggttcgcggctccagggcttctattttcgcctccatcccttaatggctgacgaacgtggctgggagattaccagcgactttcgganatttcactacgactataggagattgtaatcggtcggcgggacgncgggggatgggtgtttcaggcacggaacgaaagatgcgcacgttacttactgagcgccggcagcagatcggataaaaaaaggggagtcgttgcggtggtgagctgccagtaacacgcgatcaaggtctgatcgcgctctgagggtgccgggcttatgatggcgcacagagtcagctacgctcagttggtcggcctacagtgagagccatcaacatccatccaaacgggaagggccttgtggataaaaaactggcggggctatcgttcttgttgactctctgctgggtaattgcggtgattggtgttatgtggatcttcagctgaccggtctgcctatcactcaggagtcatcaggacagcaagagttagcttgatgaattcgtcattgtaatcaagtatttctagtgcgccacggacgttcgcggttgcttcgacgccgccgtgtcgctcgacccattgcgcgagttccatgatggcggctcctagggcgacttggttttcgttgagcttggaaaaaagggtaggtagtaaatctgaattaggcatggctggtactcacttggagtgagcagcgtagcactaagagttctctgggagctgtgttcggtcggcaggacgccgggggatggcgaatcaggcgcgggacaatcctgggacaccagatgtcccaaatagccatgaatgaagatgaatcattatcaggcgaaagccaataaatacaggtggttgagtcagcccgcccaataaaatggcagattgaaaacggattgcaaatccgcctacgccggttcgattccgacctcggcctccactcttaaagccccgtagattaacgtctacggggttttttattgcctgcggtttggtcnttgcctccgcagctttagggatcgctgccgcatacctagctttttttgggagatttaagacgcctctatcggtgtgtctattcctgattggacgtggagttgtactctaagactaaggagtctgagcgtccactaacggccaatagcggactgtccgctcggccagaacttggccgcgcttttcatctggcgactcggactgacaaccttcgaatgcttcgttaaccccctaatgccgtcacattcatcttgtctgggtcgctggcatccgccggcgttttaaaccttgcggcgtctctggcaggcggcaacccgaataagcgtgcgtactcccggctaaattgcgaggcgctttcgtagccgacagtgaatgcgatggcggccgcgttgtgtgtttcgaatagcaggagccatcgcgctctgagtaggcgcaggcgcttttggtattggatcggtgtcatcgccgtaatggctttgaagtgccgatagaacgccgcgacgctcatgtcggccatggccgctaaaggttctacacgaaagggctcggtgtagtgctcgcgtatccactgggtggctcggcggatctgtgaaagtcggccatccgggcgagctatctcgcgcaacatctccccaaagggtccttgaagcgcacgaaacaaaatctcgcgttcgatcatcggggcaagcaccggcgcctcatcgggatggtcaatcaggcgcagcatgcgcaaccaggcatcgagcatttcaatgggcgccaaaacaggcgcgaagcaactggggtgaggctgactttccgcttttggtctatccgccaacagcgaagcgatgatgctggggtccagggtcaagctgatggcgaggtagggattgtccggcccgccagggtaaatctccccggtcgccggtacatcaatgggcaccacaaaataggtggccgctccgtaactcagcacctggtcgccaattgacaaggctttcgagccttgcagtacgaggtgcagcatcggctggtaaacctggctggcacaagcctcggcattcaccatcgccacacgtggcaacccggttcccgtccactggctttgagcacgcatcacgatactgcgcagttcattcatggtgtcgttcatgtgagcgacgatggcgtagaccgatgtataaagcaatgcagatgagaagaataggcaagagtgcgagaggaaccggcaacggctttacgcggcgcggacccaatactgatggcaagcagcgttaggccttcgggactgatcggaggtcaataacggacgctgcgtcacttgccactttagacgg

SEQ ID NO: 3071 - DNA, 944 bp, Homo sapiens
  misc_feature (13)..(13): n equals a,t,g, or c
  misc_feature (486)..(486): n equals a,t,g, or c
  misc_feature (934)..(934): n equals a,t,g, or c
tcccccggactgncaggaattcggcacgagcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcanccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagtgtgagcaacctggaccacaagcccagtggtcacccctgtgtgcgcccgccccagcccaggagtagtcttacctctgaggaactttctagatgcaaagtgtgtatatgtgtgtgtgtgtgtgtgtgtgtgtgtgtgtgtgtttatgtgtattttgtaatatgtgagggaaatctaccttcgttcatgtataaataaagctcctcgtggctcccttaaaaaaaaaaaaaaaaaactcgagggggggcccgtacccagcttttttccctttngtgaggttgg

SEQ ID NO: 3072 - DNA, 2933 bp, Homo sapiens
  misc_feature (43)..(43): n equals a,t,g, or c
  misc_feature (1237)..(1237): n equals a,t,g, or c
tctacctccgagtagtattagactgtaaacacagtaatatagncgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcawtccgttgatccagaaattatagctcgaggtactgttggcttttccggagcagagttggagaatcttgtgaaccaggctgcattaaaagcagctgttgatggaaaagaaatggttaccatgaaggagctgggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggnacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagsggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatayaagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccagggaatatagccttttggcatggtgccatggctcacatctgtaatcccagcacttttggaggctgaggcgggtggattgcttgaggccaggagttcgagaccagcctggccaacgtggtgaaacgctgtytctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaamaaaattaaataaattattataacctttcagaaatgctgtgtgcattttcatgttcttttttttagcattactgtcactctccctaatgaaatgtacttcagagaagcagtattttgttaaataaatacataacctcaaaaaaaaaaaaaaaaaaaaaactcga

SEQ ID NO: 3073 - DNA, 1296 bp, Homo sapiens
ggcacgaggccactggaatctgatcctgattgtcttccactactaccaggccatcaccactccgcctgggtacccaccccagggcaggaatgatatcgccaccgtctccatctgtragaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagataaaaaaaaaaaaaaaaaatttgggggggggggccccgtta

SEQ ID NO: 3074 - DNA, 1593 bp, Homo sapiens
  misc_feature (1522)..(1522): n equals a,t,g, or c
  misc_feature (1557)..(1557): n equals a,t,g, or c
ggcacgagcctcggcctcggtggcggtggtggacacgtcgagccgggtagaagtggaggggccgttcgaagagtcgtgagggggtgacgggttaagattcggagagagaggtgctagtggctggacttgacctggaaagaatcttctgctgactctcaacttttcctggaaaaaatggatcattcccaccatatggggatgagctatatggactccaacagtaccatgcaaccttctcaccatcacccaaccacttcagcctcacactcccatggtggaggagacagcagcatgatgatgatgcctatgaccttctactttggctttaagaatgtggaactactgttttccggtttggtgatcaatacagctggagaaatggctggagcttttgtggcagtgtttttactagcaatgttctatgaaggactcaagatagcccgagagagcctgctgcgtaagtcacaagtcagcattcgctacaattccatgcctgtcccaggaccaaatggaaccatccttatggagacacacaaaactgttgggcaacagatgctgagctttcctcacctcctgcaaacagtgctgcacatcatccaggtggtcataagctacttcctcatgctcatcttcatgacctacaacgggtacctctgcattgcakkagcagcaggggccggtacaggatacttcctcttcagctggaagaaggcagtggtagtggatatcacagagcattgccattgacatcaaactctatggcgtggccttatcgattgcagtgggaagttgttgaagacttgaagacgtgattcctgctccaatcatcccttcttgctcctctttgkgcacgtacacacacacacacacacacacacacacacacccgtgytcaaacagaggtttagtttacagtctctgaactaaagtagtaacctcccaaattgttttttctaataagctgagattcccatttctcttaaggagaagccacccatgagatgtcttttccttctccatcatcttagagccaagttatatgttcttgtctaatccatgtagctttttgttcaatgacttgatcatctgcttcctttttgaatttttaacagatagtaagtaaatttggtggttttttcccctgggtcagtgatggaaaggggttaacttcagccaggattgatggcagctgagggaaattcttgcccaactaaacccagaactcaaacttaacattagaaaataaggtccagggccggacacagtggcccaagcaagtaatcccagcactttggggggccaaggcaggctggatcacctgaggacaggagttcgagaccagtctggccaacatggggaaaccccgtctctactaaaaatacataaattagccgggcatggtggtgggcgcctgtaatcccagctactcagaaggctgaggcaggagaatcacttgaacataggaggcggaggttgcagtgagccaagatggcgccattgcactccagcctgggtgacaagngtgaaactccatctcataaaaaaaaaaaaaaatantcgagggggggcccggacccaaaacgccggaaagtg

SEQ ID NO: 3075 - DNA, 2351 bp, Homo sapiens
  misc_feature (593)..(593): n equals a,t,g, or c
acccacgcgtccgccacgcgtccgggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggrttcctttcaacagwtawtgagcttcagtccccaagatctgcgargacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgnttcttacatcaatccagatcacctgaaatattttcgttttattggcagatttattgccatggctctgttccatgggaaattcatagacacgggtttttctttaccattckakaagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcatykaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcmatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatgtgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaatcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaaaaaaaaaaaaaaaaactcgagggggggcccgtacccaatcgcctg

SEQ ID NO: 3076 - DNA, 1557 bp, Homo sapiens
  misc_feature (1541)..(1541): n equals a,t,g, or c
  misc_feature (1549)..(1549): n equals a,t,g, or c
gcaaaggtgaagctggttttcatggtctcctgagggcccctggcccctgggagatgggtcacactccctgaatgctgtgctgttggtttccctggaggattcttgctgcaggccaggtcccgtattctccacactcaccacaagtggctgggtgtgacttgacacggtgtgaaagtggaggggcgcgagcactcagtatccagcgagcagcattggtggtcctagaaaattactacaaagatttcaccatctataacccaaacctcctaacagcctccaaattccgagcagccaagcatatggccgggctgaaagtctacaatgtagatggccccagtaacaatgccactggccagtcccgggccatgattgctgcagctgctcggcgcagggactcaagccacaacgagttgtattatgaagaggccgaacatgaacggcgagtaaagaagcggaaagcaaggctggtggttgcagtggaagaggccttcatccacattcagcgtctccaggctgaggagcagcagaaagccccaggggaggtgatggaccctagggaggccgcccaggccattttcccctccatggccagggctctccagaagtacctgcgcatcacccggcagcagaactaccacagcatggagagcatcctgcagcacctggccttctgcatcaccaacggcatgacccccaaggccttcctagaacggtacctcagtgcgggccccaccctgcaatatgacaaggaccgctggctctctacacagtggaggcttgtcagtgatgaggctgtgactaatggattacgggatggaattgtgttcgtccttaagtgcttggacttcagcctcgtagtcaatgtgaagaaaattccattcatcatactctctgaagagttcatagaccccaaatctcacaaatttgtccttcgcttacagtctgagacatccgtttaaaagttctatatttgtggctttattaaaaaaaaaaraaaaatatatagagagatatatatctatgccagaggggtgtcttttttaaaaattcttcttcattgctgactgaaactggcagatgattgaccagtatcctttgaccatctgcactttatttggaaggaagcaggggctgtccaccctgaaaaagagtgactgatgacatctgacttttgtcgatgggacttctcaagaagccattccttggagcttctgttacagctgtaaaccaaagtggagctggtgcttcttgggagcctcgccttacaactagttcctgcctttcgtccagtaccaagtcccccgttgcttctggtcagcccacttgtagacttccaggggacacatctttattctgtttcaggaaaccagtcacracacgtccacatatgtatttgtgtatgttaatgccagtatcacatcacccatgaaagtcgtgggcagttcargagatacctgscttcgtctttgktctttgttgccttaggttcttcagagaaagatcmcaacaaaaaatgtacmctgtcgtttacagctawaagngatttganttgttttt

SEQ ID NO: 3077 - DNA, 550 bp, Homo sapiens
gaattcggcacgagggttcagattagaatgggtctgtttaatcagtgtgattacagtgatccaagtttgcagttagttttttttttaatggctctattccacattttgttttcattaactactttgatcatgtaaacctataggttaataaatttctcccccttactgttcctctttcctctctaccactttttttcataattggttttcattctagaatggaaaagaaaatggtgtagtaacatgagccatggatttaggggcagaaatatttgggttcctccgtttattagtaaagtgtctttggactattgtctcgaccttttttaaaaaaaataggctatcatttttactaagattgtggtgagatttccatgaaataatctaggggaaagacttcatactgttcttcattcttgtgctttacttatcctcaattttgaaaaatgtttttaaaaataaattttattggctgggtgcaggctcattgcattgcagcctttgtgacaagagcgagaccctttctcaaaaaaaaaaaaaaaaaacacga

SEQ ID NO: 3078 - DNA, 2588 bp, Homo sapiens
ggcacgagaaggtttgatgccagaattgatggctctcttccggccgatccttctcccagcgccaggtgcatggtggtggccctgtcaccatgctctgtgtccttctggctgtggctttccagagcagccccattccaggtgcagcagcttagaattgcagtcagcctccagacagtgctggttacagtggcttggtgacattagacctttattgttgcaaggaagagaagtcacttgagtcagcagcccagggcatttctctgctgccatcctcctgccatttgctgtgccttccatcctaaggtcacctcttgggctgaggaggtagttggaggcttagtcacctctgccttccaggcaagagaagggaaggatgaggccagggcacccgccggctgtcctgttcccgtattgaacgttcccaggaattccagccgcaacttccttcttcacatcatggaccagaactgagtctgaggccacctgggtgttaggggagggctgtctcctcgaagaatgctctgctgcccaggcaggatgtggggctttgtcccaagggagaaggagggaatgggggggtggctgcaatcctgcctgctgggggctttgggtcctgctggtggcctctggggaggggctgagacaagcaggtggctgaggctagagcactgagcatggttgggactttctaggaggtcagggcagagctggctccgggccttgccaccaccgacctcactcttggttctcccctcagtcaatgccgtgtgccccgaggctgagctcttcgtggatcccaagatgcagccgcccaccgagagccaggtgacctacctgcgacagatcgtgacggcgggcctgggggaccacttggcccgcagggtccagagcgaggagatgctggaggacaagtggaggaacgcctacaagacccctctcctcgacgaccctgtcttcatccaccccagctccgtccttttcaaagagctccccgagtttgtggtctaccaggaaatcgtggagaccactaagatgtacatgaaaggcgtctctagcgtggaggtccagtggatcccggccctgctgccctcttactgccagtttgacaagcccctggaggaaccagcccctacatactgccccgagcgggggcgggtgctgtgtcaccgggccagcgtgttctatcgcgtgggctggccgctccccgccatcgaggtggattttccagaggggattgaccgctacaagcactttgctcggttcctgctggaagggcaggtcttccgcaagctggcctcataccagagctgtctgctgtccagccccggcaccatgctgaagacgtgggccaggctgcagccccgtacggagagccttctgcgagccctggttgcagagaaggctgactgccattaagccttgctggctgcttggaagaaaaaccccaaatacctgctggctgagtactgtgagtggcttccacaggccatgcaccccgatatcgagaaagcctggccccccaccactgtccactgaccagaaacctggctgcagggccgaggactggtttggggactggagggctggcagcagcctgtcaccgtgcgaccgtgaccacctggcatgggcttcgtggcctgctctcaggaagtgggtcaagccctgggaaccctcatccatgagagctcgatcccgtatgaagggtgctgccgcccgtgccatctggcccgggggtgactttttgaactgtttattatatggtggatgatgatttcatctcacgtgctggacgctgttctgttcagtgtgctctttggactacattagtcccctgtggagcagcagggctggagatctctgcagtcccttccccgcccgccctgccagaaggccgaggaggcacgtggagggcctccttcctgcaattcttccctctccagagtcagggagggctgcccagccctggcctcacagccgtcccagatgttaggtgagccactgagctctgtgttgaccttgaggggcctggctgggggcccccaggctccatgccttcttgggagggtggccgccaacgcctttcctgtgttatggcaacagggagtgggcatctcatctgcctgtggtcagctctcagacggcagggagcggagctgacgttggctgtgcttggtcaccgctgccatgccgcagaggatgcgcctagctgggctggggccacacgactattatgttggccttgaacggggactgcagagccctcagtttgtctcccttgttcctctgtggctgaggtgggagggggagggtggggtaggtcccccagcaagaaagagggacaggagcaccccaggcaggaccaaggagtcgggaggcccctgccttctgtcctccatggtgagggcacagatgtctccccagagcccagcgctggcagaatggattctgctcctggctttgcttctgcggcttcggtggagacagttatggaataaaatgttccttgcacccagaaaaaaaaaaaaaaaaaaaaaaaaaaaaaaaaaaaaaaaaaaaaaaaaaaaaaaaaaaaaaaaaaaaaaaaaaaa

SEQ ID NO: 3079 - DNA, 602 bp, Homo sapiens
tggatctccaccgcggtggcggccgctctagaactagtggatcccccgggctgcaggaattcggcacgagattgtatccaggaagtaactaacctgcttttgattttacaggctcataggtggaagggacttgccttgtctcagatgagactttagactgtggacttttgagttaatgctgaaatgagttaagactttgggggactgttagaaaggcatgattggttttgaaatgcgagatcatgagatttgggaggggccaggggcagaatgatatggtttggctgtgtccccatccgaatctcatcttgaatttctgtgtgttgtgggagggacaggtgggaggtcattgaatgatgggggcaagtcttttctgtactgttcttgtgatagtgaataagtctcatgagatctgatggttttaaaaagaggagtttccctgctcaagttctctctctttgcctgctgccatccatgtaagatgtgacttgctcctccttgccatctgccatgatgtgaggcttccccagccacgtggaactgtaagtccaattaaacctcttttctttgtaaattaaaaaaaaaaaaaaaaaaaaactcga

SEQ ID NO: 3080 - DNA, 646 bp, Homo sapiens
aggtctttgtttcaaattggttagatggaaggagaaaagtggtcaccattttaattctcagaagaggaagttaatcggtgttctgcatctgactttcacctccctccttcctttcctttgtcagttaggataggtgacacttcttttcttttacggctattatcagagattttgtgtttaatagttgctgggtcacattttacaagtgcaaatgactttgatgacctccatttactttttcttagctatcttcatgtctacaaggagtgaaaggctataaagcattcaggcaggctcctgttttgatcagcctctccaggtgatcattatacccaagtcaaaaagtcaatgcactccccaaatgagaaacatatatatatatatataggaaatctcccttttacaagatcgtagtgcatctcctgggttttttcccatccttgtgagtcagttagtttgtaattgactctctaaccagccttccaccttctgttaacctttattacctatagtcaaagggacctcaggaatgcgagagaccccccccsaaactccctgcggcttttaagtctcatcttacagcattccccctcaaacctaaaaaaaaaaaaaaaaaaaaaaaaaaaaaaaaaaaaaaaaactcgta

SEQ ID NO: 3081 - DNA, 2523 bp, Homo sapiens
ggaattcggcacgagtcacagctgaggaagacctcagacatggagtccaggatgtggcctgcgctgctgctgtcccacctcctccctctctggccactgctgttgctgcccctcccaccgcctgctcagggctcttcatcctcccctcgaaccccaccagccccagcccgccccccgtgtgccaggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggccattcctgttcgggggccgtggggaaggtgtggacccccagctctatgtcacaattaccatctccatcatcattgttctcgtggccactggcatcatcttcaagttctgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggtgagggcaggggcaatgggatgggagggcaaagagggaaggcaacttaggtcttcagagctggggtgggggtgccctctggatgggtagtgaggaggcaggcgtggcctcccacagcccctggccctcccaagggggctggaccagctcctctctgggaggcacccttccttctcccagtctctcaggatctgtgtcctattctctgctgcccataactccaactctgccctctttggttttttctcatgccaccttgtctaagacaactctgccctcttaaccttgattccccctctttgtcttgaacttccccttctattctggcctaccccttggttcctgactgtgccctttccctcttcctctcaggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagataaaaaaaaaaaaaaaaaaa

SEQ ID NO: 3082 - DNA, 3240 bp, Homo sapiens
  misc_feature (1835)..(1835): n equals a,t,g, or c
  misc_feature (1974)..(1974): n equals a,t,g, or c
  misc_feature (2005)..(2005): n equals a,t,g, or c
ggtgggtgcttcaacagcacacggcttgcttcttccgctgctacacatccatggtgggtcagctaacagctctgctccacatcaccccaacccctggccccaagctgatagagcatggtctcattatttataacactggcaactggtttgatagagggagagaaagaggttgtgatggcacactggctcttgaagtgccctcttggggatgacacatcccagtcttactcaatttcaaagttgcgtggatatacgtaacttccaagcaggggagagaggtcatcctaccgtgattctggaagctagaaccagaaatatttggtgagtagtactaataacctcctgttttagttatctgttgctgtgtaacaaatgactccaaaacctagcggtttaaaatcataaccattcatttttctcacctggcaacccgggagcagcttagctgggtgattctggctcagaatctctcatgaagttgtggttaaaatgtcagccagggctgcaggcatccgaaggcttgactggggctggagggtctggctccaagatgccactcacatggctgctggcaggaggcctcattgctttaccatgcagatctctccaatgagctgcctgagtgtactcatgacatagaagctggtttgtcccagagctaatgatatgagagagagagaaggagaacaagcaggaaactgcagyactgtttaggacctcacacacatgacctctgctttattttatgcatgagaagcaaggcactaaatccagcctacatttaagcagagggaaattaagctccacctcttgaagaaaggagagtcaaagaatctggggtcatatcttaaaaccaccacacctacaatagttccccaggtgaccatcacagggctgcagacccatctggccctggttcagcccaggctcttcatttgtatccgggggcctctgcatctgtccctgtccctctccaattgagacaggaggagaagccccaggagggtaagaggaggagagtgcacacctttcaaaacagtctcatggtaaacagagacaaagagagagaaggaagggaagcacatgagcctttggcgtctttaaaccttaatattctgtggccccctctccaaactgaggatgccctctgacagctgtgtgggctgtcaaggaagatttgaaactcttcctacccataagaacttcctccctggctgagcacacttcaccactggtgggtgtggcctgttggagtcaggggtctctgcccgggcagacagaaatgctccttgtgcagaaagtgagtgagcaggtgggctcctcactacctaagtacacactaaacacacaagcttcccaggggatgggaatcgattttgcgctacaacaaaatatacctatccctttgagttatgagtgaaacttcaggactaaggctctgctatccatcctggtatatgtagactcccggcagcaatttgaaacgatcagagccagagacagagaggacagagtaaaggccctaagagaaagcccaacaggaagtcggcaaattgagtgagggagtcaggagatgggcaaggctcgcctggccacgggcttgacccagaggctctagcttgcgatgggcaggaaagttttcacacacaccctkkgatggcccacacagacgtcagtggggcatcctcagtttggagagggagcccgtgagaataccacatgtagaaaatgaccctgccctggttgtttagaaaagctgtcaggaaggtcagwggtcttytattaacctycatctcctgtattkctagaacagctggggtagacaggggaggtgntttgggttctcacctttcctggaattctggcctagtgagagctcagtgactgaaggctcccttctgggaccctcagggggctgcatgtaagtggggagggccggggcagtgctggcccagaggacaggcacmcagagtncagtgggsccactgtggsctkgggagggttnctgsccacaagscarcagatttcctgacatagccttactatttactttttggtcaataattggaaaaagtattggaaagagagaacatatggaatttggcctaaagaaaagttcaggggacttactggagccagtagtctcgtcctacaagtgatgctctatgtggctgagaactgggctggagggtgctggaggtggcctgaccccaggaaagccttgtctgtccatgtgcatgaggtggaaagccccaagggactgagcttcccctccagagccgttgcccctcctcctgggcagcaagggtgggaaacggttaccacagcaatgccccagggctgccagagcttgttcagcctgggccaggtcctttcttgggggtagctttttcccttttaattattttttttctatctctcctgctactaagtcttcgtgtcccccttttgcgaacagttgagactttgctttcaatgatgagattgacccctggttgcccatcaaaaagtggtgaatgaactcctggtgggactgatgattggtacaactcatgggaaatggtttgggagaatctaccaaagctgcacatcctctgtggcccgggaagttcactcctaggttcaccaaggaagaaagtgctttcacccagagatgtagatgagaatgttcatggtagctttattcctaagagccataactgggaaagaccccaatgtccgtaaaaggcagaacagatacataaatattcacacacaggaacactaactgcagtgaaaatgtaagagcacaactctacagagcaacacagatggacctcaggcacgcacccttgagaaaaagcgcctgccagccagagtgtatgtaacattcatagttccagttatggaaaatccaaggacaggcaaaaccattctgggggatagaaattagcacggtggctccctcaggtggggtcttgacagggaggggtctgagagccttcaggggcaagaaatgttctatttcttgatattggtggtggttacacagatatacacacagatgaaacattcatcaagatatgcctttcagatgtatgcactttaatgtacgtgtgtgatatttagacagtaaaagaaaggtaaaagaaggggcaaacaggttttctatatgttctgggctttttggagtttttaagcgatgcttccttaacaatgaagaattggccattccataaaaaaaaaaaaaaaaaactcgag

SEQ ID NO: 3083 - DNA, 1573 bp, Homo sapiens
ggaattcggcacgagcgagaaaccgcgcttccgcttctggtcgcagagacctcggagaccgcgccggggagacggaggtgctgtgggtgggggggacctgtggctgctcgtaccgccccccaccctcctcttctgcactgccgtcctccggaagaccttttcccctgctctgtttccttcaccgagtctgtgcatcgccccggacctggccgggaggaggcttggccggcgggagatgctctaggggcggcgcgggaggagcggccggcgggacggagggcccggcaggaagatgggctcccgtggacagggactcttgctggcgtactgcctgctccttgcctttgcctctggcctggtcctgagtcgcgtgccccatgtccagggggaacagcaggagtgggaggggactgaggagctgccgtcccctccggaccatgccgagagggctgaagaacaacatgaaaaatacaggcccagtcaggaccaggggctccctgcttcccggtgcttgcgctgctgtgaccctggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccagggctcagcaccaggctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacaaagaaaaaaaaaaaaaaaaaa

SEQ ID NO: 3084 - DNA, 738 bp, Homo sapiens
gaattcggcacgagtgacaagaaagacggtgtcagatgcacattaatctttagcctgatgtccttcatgatgtccaacctccagtttcatctcctgccacactcatcccccatacttccactcttcacactggccttactcaaaatgcagattccaggactcaggctatctcactgccttcttacttacaattcttataccagaacacccttcctcctcccctcatctgaatcttacctggtttttgaaatttaagtcagggccttcttaggaagatttccctgattcagatccaagttgaattatgataaccctcctttggctcccataaaatcttataacttcctaactgtgttttatgaatagttgtctagtttagcactatgtcaggagctattgacagcagggctgggcacagtgactcacagctgtaatcctagccctttgagaggacaaggtgggaggactgtttgaggacacctcaagcccatccagcctaggcaacagaatgagatcttgtctgtacaaaaaaacaaaagattaattgggcgtggtgacgtgcacctgtagtcccaactacttgagaggctgaggcaggaggattgcttgaccccaggagatcgaggctgcagtgatccatgatggtgtcactgcactccagtctgagcaacagagcaagaccccaccccccaaaaaagctattgagggtagcagtttactttcattgctctacctcga

SEQ ID NO: 3085 - DNA, 820 bp, Homo sapiens
  misc_feature (784)..(784): n equals a,t,g, or c
aattcggcacgagatcacaagctactagcgcttccattaacaattcaaatccatctacctctgagcaggcctctaatactrcttcagctgtcaccagtagccaaccttccacagtgtcagagacttcagctactcttacaagcaatagtaccactggcacttctataggagatgactcaaggagaactacatctagtgctgtaacggaaactggccctcctgcaatgccaaggttaccttcctgctgtccccagcactcaccatgtggagggtcgtcacagaaccaccatgcattaggacatcctcatacaagttgctttcagcagcatggtcaccattttcaacatcatcaccaccaccaccatactccccactcagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacartctgctccttttttttgtccgccacacgtaactgagatgctcctttaaataaagcgtttgtgtttcaagttaaaaaaaaaaaaaaaaaaaaaaaacyccggggggggncccggtacccattggccctwtagtgggtcgtttttc

SEQ ID NO: 3086 - DNA, 1046 bp, Homo sapiens
  misc_feature (20)..(21): n equals a,t,g, or c
agtgaatcctgagtggggtnntctttagcctaaacctggagtcaccacagagcttttataaacagtgagaaacctactacttcctacagaaactgtgctgtctgcaaagctcagcgtctgctccagcctgaatccccaggccctgtccctgtacacacctagttttgaggtcaggacatcacaaaacatctgccaacatcgaaaagtcatcaggagccacccagacgtggggtgtattggtgggaagaaggagcatcttagtctgcttccttctgaggcccacagttccagaaggactagcgtcctcagagcatgtggtagtggctgttcttgtcttttcctggtggtggggcctggtgacccctaacaccaacggagctgttcccaggttcatttcgtccctttttctgtggtgagatgaggctcctcctgccctccttgctgggtggtctttctgttttgaccacatcccttggaagcgtggctgggctgcgtaactccagagcagcctggtggtagctggggctgccttctgagtttgggctggtggatgctgagtatttgcattcagagccttaggcattgaccttggctttctgggaccctacgcccctctgtttgcctttgtcagtagagaccttctcacattagggattcattttttccaagactgtttgctaaggtgtgtgtcaaacttcctcccagagcagtgacatggatgggaattgtgagtgtgttgagagacctaccctaaaagatggggctgcagtcatcctcaggggacctcctgttctcagctccacctcagccacacttggctgtgggtcagcttcttctgaatcagcatccgcaggacagcgccacccagccctgccacacttgcttcctccgcgcttcttcagaggctggagcccacccccatgctcgtcgtctgttctgcttttttgatgcacttacttgtccctttcagcgtattgcttatgtcctatgttggttaaaaaaaaaaaaaaaaaactcgagggggggcccgtacccaatcgccctat

SEQ ID NO: 3087 - DNA, 966 bp, Homo sapiens
gacagtacggtccgaattcccgggtcgacccacgcgtccgggagaggacatgcagtgggcacagaaagttcaatggaacagatgccactgtgggcaccaagactgtaatgactctgtgtggtaggtagttttaaaggactgcatgccttggaaatgattcttcacttggagaacatacttgcctctagatatgtttgtcactctaagcatcctgaatataacaatagagaaagataagtcaaccaacagatttagggatgtgtttcttcagcacattttggtcattttgatgccaagtttgacatactgtttaattgggcagcacctttgctcctttaccaggtatgtatcactttgttactccaggtgccattcttggtgatgacagaatgtttatcactatcgttgttagcaagaggaagctttcaatataggaacttaacatcttcccatgagtataaatgaatttaagacatttgaatcaaaacttcagtagagggaggttttagaattcataaaactggtttaaggaaattctttttacttttcccaaggttaatctttttaaatatctctagacatcaaatactttctgtatgtattagctgtgtctgtctatgatgcaagtaactctcctcctatttgggggatagttcagagaggtaggagcattatctcccatttttctggtgacttcttggagtatagaattcaccattttatccgtaagtcttcaaaggattatggtggactagaacttacatagtgcaaaatagtcttctatttttaataggaacttagaaaaaacttagaattatatatagagttgtttcctttagaaaccagagctatttatttgtatttaaagcactgtttattatttgtactgattcttatccctctgtgtgaataaatgtaagacggtgaaaaaaaaaaaaaaaaaaaaaaaaaaaaaaaaaaactcga

SEQ ID NO: 3088 - DNA, 3407 bp, Homo sapiens
  misc_feature (1896)..(1896): n equals a,t,g, or c
  misc_feature (1910)..(1910): n equals a,t,g, or c
  misc_feature (1924)..(1924): n equals a,t,g, or c
  misc_feature (3088)..(3088): n equals a,t,g, or c
ggaggaatgaaagtggcggtctcgccggcagttggtcccgggccctggggctcgggagtcgggggcggtgggacagtgcggctactcttgatcctctccggctgcttggtctacggcacagctgaaactgatgtaaatgtggtcatgcttcaggaatcccaagtttgtgaaaagcgtgccagccaacaattctgttacacaaatgtgcttatcccaaaatggcatgatatatggacacggatacagatccgagtaaatagttccagattggttcgagtcacccaggtggagaatgaggagaaactgaaggagctagagcagatttgatcccaaactctttcttgttttccttcttggacttatgctatttttttgtggagacttgctgagcagaagtcaaattttctactactctactgggatgactgtgggaattgtggcctctctgctaatcatcatttttatactatctaagtttatgcctaagaaaagtcccatttacgtcatcctggtgggaggctggtctttttctctgtacctcattcaactagtttttaaaaatttacaagagatctggaggtgttactggcagtatcttttaagttatgtcctcacagttggattcatgagttttgcagtatgttacaagtatgggcccttggagaatgaacgaagtatcaacctgctgacctggaccttgcagctgatgggcctgtgtttcatgtattctggcatccagataccacatattgcccttgccattatcatcattgctctttgtactaagaacctggaacaccctattcagtggctgtacatcacctgcagaaaggtgtgtaagggagcagaaaagcctgttccccctcgtctcctgacagaagaagaatatcggatacaaggagaggtagaaacccgaaaggctttagaggagctccgagaattttgtaacagtccagactgctctgcttggaagactgtttctcgaatccagtctccaaaaagatttgctgactttgtggaaggctcttcccacctcacgccaaatgaagtttctgtccatgagcaggagtatggattagggagcattattgcccaggatgaaatctatgaggaagcatcctctgaggaggaggactcatattctcggtgtcctgctatcacacagaacaactttctaacctaggtagtggtcagttatctttacgtggactggcttggtgccttggtccatgttgcatgtgttgtgcaattgctttcaaccctttgaaacagagtgagatagatagggtagaaattctcctactgaaataagaggcctaaaaaggcctccctttggaaatgggaggtctctatgggatccctgaggaaggagagtggataaagtagtgaatgctgggtagttcacttcccattggttaagctaacagcccacttttatgtttccagagaaattggatggccacagctagcatggcattctagctccttcttgaaagttgattcaatcatggcatttctgtcactggctggctctccaaagtaagaactgttgttaagtgcaggaatgcttttagactataggctgcaacttccagagagaaatccacaaatctgagcctccttcactccagcttttatttcrgtgactttagaataattattgatttaactgttttgggaggaaaatagatttttattgttttgttttttaaatgaatgtcttttaaaaamcwtamcaaactcatgttccagaaccagcaagtgctccagagtgacacaccccctaggcccctacatatttattaatatggattatccattaaagccccaggagctgttgttttaagctttgatttagttctcatacatatgatagaaagtcctatttgcctttangaacatgcctgtangctcttctgcaggntgagatgttctgggctttttattatattcaactttcaattccatcttaaaaaacatttgtwttcttctcttcccattcttccttaccctgcctttgscctttcaggaagggtcagttcccttacctgtgaactatgtatgttcagagtagcattattcctgctagctaggagaagtcatcttgtttaggggatttggatgctttttatacgttctccattttcctgtcattgggtcatgttatctttgagttgctatgaaatcaggaaactgtctccttttcctttcccttcctttgtctacatgctctgtccattcctttcagccttttctcaccacccatactcccccaaatctgggtaatttttaagccttgaaactatgtagtttcttgatacacaatttgtagttatgcagcagccacaatttgcattgccaggaaataggctccaggttatcttcatgcctctgggtgctcattcagctgtcaagtttccatgaacttacacttatttatgattgcgtttctgacctgagatgtatgctgcctgttattgcagtagcattagtttcagattcttttgccattgcaaagtaccccttataaaccagcaatgtcatctgtgaggaagcaaattctcaagtgtctgtcatttacttggttctttttctttgtggtcttcacccttataccctggaaaagtctgtaattaccttagccaggaagatagatggtcatggcaagcgcacagcaccagacttactggctcaccaagatgatggaaaaaggcagatgattttttaaaaagccgtaatgactcctttagaccagccatttagcgtggtaattttgaaaggcctagctccattgcagacttccaaagggtcagctctgagactgccctccaggtgggcagttgattatttccaccagtgttttccagagccttaaactgtcctaagtgacaactacctcagttggcaggaaagagacatatagtagaaagtgaaaaatgagcagtatttgggcagatgctatgggttacagttgaagggtaaaaggaactttacattgggaaacctttatacccttgtgaattatgtacatggtaaaatgttctctctctacaaagaactattaaaacttctgaaatatactattttntaccttatttatagaaattgagacctagcatatttaagcataagtttattttaaaaaataattcaactcgtgcaagtggtctcaggattctctggagattttggtgcctcccctacttagggaggtgatagcttgcctataagggtgacttttcctgatcatgtctttatttcaatgagaaagcactgtgaaattgtgaaagattctcctctttctctgtttaataaacccccatgaaatataaaaaaaaaaaaaaagggcggccgctctagaggatccctcgaggggcccaagcttacgcgtgcatgcgacgtcatag

SEQ ID NO: 3089 - DNA, 3992 bp, Homo sapiens
ggcacgaggagggacgcgtgccgcggagccaggcttactacgtgacccggacaccaggcatacgctaggggcagtcagctgtgccttctctttcggagttgttccgtgctcccacgtgcttccccttctccactggctgggatcccccgggctcggggcgcagtaataatttttcaccatgcatcggaaaaaggtggataaccgaatccggattctcattgagaatggagtagctgagcggcaaagatctctctttgttgtagttggggatcgaggaaaagatcaggtggtaatacttcatcacatgttatccaaagcaactgtgaaggctcggccttcagtgctgtggtgttataagaaagagctggggtttagcagtcaccggaagaaaagaatgcgacagctgcagaagaaaataaagaatggaacactgaacataaagcaggacgacccctttgaactcttcatagcagccacaaacattcgctactgctactacaacgagacccacaagatcctgggcaataccttcggcatgtgtgtgctgcaggattttgaagccttaactccaaacttgctggccaggactgtagaaacagtggaagtggtgggctagtggtcatcctcctacggaccatgaactcactcaagcaattgtacacagtgactatggatgtgcattccaggtacagaactgaggcccatcaggatgtggtgggaagatttaatgaaaggtttattctgtctctggcctcttgtaagaagtgtctcgtcattgatgaccagctcaacatcctgcccatctcctcccacgttgccaccatggaggccctgcctccccagactccggatgagagtcttggtccttctgatctggagctgagggagttgaaggagagcttgcaggacacccagcctgtgggtgtgttggtggactgctgtaagactctagaccaggccaaagctgtcttgaaatttatcgagggcatctctgaaaagaccctgaggagtactgttgcactccagctgctcgaggacggggaaaatctgcagccctgggattggcgattgctggggcggtggcatttgggtactccaatatctttgttacctccccaagccctgataacctccatactctgtttgaatttgtatttaaaggatttgatgctctgcaatatcaggaacatctggattatgagattatccagtctctaaatcctgaatttaacaaagcagtgatcagagtgaatgtatttcgagaacacaggcagactattcagtatatacatcctgcagatgctgtgaagctgggccaggctgaactagttgtgattgatgaagctgccgccatccccctccccttggtgaagagcctacttggcccctaccttgttttcatggcatccaccatcaatggctatgagggcactggccggtcactgtccctcaagctaattcagcagctccgtcaacagagcgcccagagccaggtcagcaccactgctgagaataagaccacgacgacagccagattggcatcagcgcggacactgcatgaggtttccctccaggagtcaatccgatacgcccctgggggatgcagtggagaagtggctgaatgacttgctgtgcctggattgcctcaacatcactcggatagtctcaggctgccccttgcctgaagcttgtgaactgcactatgttaatagagataccctcttttgctaccacaaggcctctgaagttttcctccaacggcttatggccctctacgtggcttctcactacaagaactctcccaatgatctccagatgctctccgatgcacctgctcaccatctcttctgccttctgcctcctgtgccccccacccagaatgcccttccagaagtgcttgctgttatccaggtgtgccttgaaggggagatttctcgccagtccatcttgaacagtctgtctcgaggcaagaaggcttcaggggacctgattccatggacagtgtcagaacagttccaagatccagactttggtggtctgtctggtggaagggtcgttcgcattgctgttcacccagattatcaagggatgggctatggcagccgtgctctgcagctgctgcagatgtactatgaaggcaggtttccttgtctggaggaaaaggtccttgagacaccacaggaaattcacaccgtaagcagcgaggctgtcagcttgttggaagaggtcatcactccccggaaggacctgcctcctttactcctcaaattgaatgagaggcctgccgaacgcctggattacctgggtgtttcctatggcttgacccccaggctcctcaagttctggaaacgagctggatttgttcctgtttatctgagacagaccccgaatgacctgaccggagagcactcgtgcatcatgctgaagacgctcactgatgaggatgaggctgaccagggaggctggcttgcagccttctggaaagatttccgacggcggttcctagccttgctctcctaccagttcagtaccttctctccttccctggctctgaacatcattcagaacaggaacatggggaagccagcccagcctgccctgagccgggaggagctggaagcactcttcctcccctatgacctgaagcggctggagatgtattcacggaatatggtggactatcacctcatcatggacatgatcccggccatctctcgcatctatttcctgaaccagctgggggacctggccctgtctgcggctcagtcggctcttctcttggggattggcctgcagcataagtctgtggaccagctggaaaaggagattgagctgccctcgggccagttgatgggacttttcaaccggatcatccgcaaagttgtgaagctatttaatgaagttcaggaaaaggccattgaggagcagatggtggcagcgaaggatgtggtcatggagcccacgatgaagaccctcagtgacgacctagatgaagcagcaaaggaatttcaggagaaacacaagaaggaagtagggaagctgaagagcatggacctctctgaatacataatccgtggggacgatgaagagtggaatgaagttttgaacaaagctgggccgaacgcctcgatcatcagcctgaaaagtgacaagaaaaggaagttagaggccaaacaagaacccaaacagagcaagaagttgaagaacagagagacaaagaacaaaaaagatatgaaactgaagcggaagaaatagtgaagagaaactcgggcatctgtgtttgatcatgggaagatactctcactaactgaaccctctctggctggactgttaaaagcaacgagaggccccggcacacctggaagctggccgcgaattcggcctctgggcctgtgtgtctgtgagctcaacctggctaaaggcagagtcactcccaaatgggtctctttagaacttgatggctgggcactgccatctctagaattgccacgagtctctctcttcctgcccagtccagggccctcctttcctataagttcatattttgctttgagccagctttttagtctcattcccacacatgtggaagccacgttgcctctcgaccgcctgaggcccttaagtacatcgctttctggtggtgcccaggaggctgctgctgggccgctgggtctctctttgtggacttgtacctggagcaggaggaactccagtccgtcccggcatccatggcagcccgcggttaggtgcgccagggtttgctgatgttgtcttgtgctgttccactcttggctccagcagacccactgtcccagaaaagcctgatcctgtagtttatgtagaatgccacatctgcgtcctcaagacctgtttcatccatttgggaaaagatgttgggaaggccactttgctcgcaggggtgaggggaaggatagagaatctatttttaataaataacattctagaaagaaaaaaaaaaaaaaaaaaaaaaa

SEQ ID NO: 3090 - DNA, 987 bp, Homo sapiens
gttttgcctcgtggacccaaaggtagcaatttgaaacatgaggagtacgattctactgttttgtcttctaggatcaactcggtcattaccacagctcaaacctgctttgggactccctcccacaaaactggctccggatcagggaacactaccaaaccaacagcagtcaaatcaggtctttccttctttaagtctgataccattaacacagatgctcacactggggccagatctgcatctgttaaatcctgctgcaggaatgacacctggtacccagacccacccattgaccctgggagggttgaatgtacaacagcaactgcacccacatgtgttaccaatttttgtcacacaacttggagcccagggcactatcctaagctcagaggaattgccacaaatcttcacgagcctcatcatccattccttgttcccgggargcatcctgcccaccagtcaggcargggctaatccagatgtccargatggragccttccagcaggaggagcaggtgtaaatcctgccacccagggaaccccagcaggccgcctcccaactcccagtggcacmgmtgacgacttwgcagtgaccacccctgcaggcatccaaaggagcacacatgccatcgaggaagccaccacagaatcagcaaatggaattcagtaagctgtttcaaattttttcaactaagctgcctcgaatttggtgatacatgtgaatctttatcattgattatattatggaatagattgagacacattggatagtcttagaagaaattaattcttaatttacctgaaaatattcttgaaatttcagaaaatatgttctatgtagagaatcccaacttttaaaaacaataattcaatggataaatctgtctttgaaatataacattatgctgcctggatgatatgcatattaaaacatatttggaaaactgaaaaaaaaaaaaaaaaaaaaaaaaaaaaaaaaaaaaaactcga

SEQ ID NO: 3091 - DNA, 783 bp, Homo sapiens
gaattcggcacgagctaaaacttacaatgacatgttgttgcttgctctgtaagctccaaggcattttttttttcagttttaattcaagtgttctaaaaagtattttgggtacaaccagaactctctctgctccttggattggagtcagtgtgaaaggaacacagtgggctctggggtcagctagacctggatgtggatcacagctcacctcttcattgggaggcctcaggcaagttatttgccaacctcacctacaaaagcatgatgctaagctcwtttcagtttagttgtggatatcagagcatatgtatacaatgcctgccatagtgagtgcctggcccttggcagactgtcaaatggagctatggagcagcagcgggagtaatattattatctagaccttatctgtccttttaaactcagttcagattccttctcctttttaaattactgcaacctgattttacctgcccctgcctccaagttgctgtatcagttagcctctgaacaattcatttagcaattttaattatatattgcttcttgacactgctttgtgatcttaaaaactctgcttcaaatacgtacttggttgcttttcctgagtgctgttaattcctgctctaacggactaaagtaatttgaaggcaggactaggttttatgcatggcacacagtctggtgccttacatgtaactactcacaaacttttttgatccaaaatttagaaacttcacacgcattcataagaaatcaataaaaaaaaaaaaaaaaaactcgtag

SEQ ID NO: 3092 - DNA, 1316 bp, Homo sapiens
  misc_feature (7)..(7): n equals a,t,g, or c
tcaattntcaggccagcgtgaggccatcactgtgccgttcactgtgaaaagaaaaccaccctggcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaaagctggtacgcctgcaggtaccggtccggaattcccgggtcgacccacgcgtccgcccacgcgtccgtgaaaatccgaagtgccgcggaaagtggaggtgagggccgcccgccctagaggtgcccgtccgagaggcagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctcctccccaacttctgtcccagccttgaaggctgaggcacttctttttcagatgccaataaagagcactttatgagtcaaaaaaaaaaaaaaaaaaaaaaaaaaaaaaaaaaaaaaaaaaaaaaa

SEQ ID NO: 3093 - DNA, 1366 bp, Homo sapiens
  misc_feature (1176)..(1176): n equals a,t,g, or c
gggaatacctattctcctttaccgtgtgtcttttccccctggaattgagccagcaagttcttggcatggcaggtgtttctgaaatatcagtgtgtttttytttgctttctttgttttccttgttttgctctttctattttcctaagcaggcaactccaaaaagagatttgtttgtgcaggagtcaggaaaagggaagaggaatactgaaagctgggagtagggcaggacagaagagggggaggagtctattttcattgtgtaagtkttgaacttccaccaatgccaaagtcacggacatgtgtgcagttggatgtkcgagttagagcagccccaagggcctgtaacctgaatagcaggcactcacccagctgataactcaagttccaaatggaccacagctgagttgtaggggatgtgtgtgtgtgtgtacgcgtgcgtttgagattcctggaacagatttcctctgagatctcaacaggctttttcattatcattggggagctatggtttctcttatttcacaaggcccatttcttccttttgagatgtgcaaggagatgactccatccatgacttggctttacactctccctccttggctttttatcatcagtgcagragarattcttgctcgttcttcaaacaatctcattcgagctttataaagattattggartttaaataatattcatatctatggcctagaacaatgttcctcaagtatgcgtcagaatcatgagtggtagagggaggattataatgtagtttcctacatttctacctcccaccaccctggagtctgcattttaacgtacttctgtytgaggatcagaytttgggaagcgttgggcttgagatgttttctkgacattgatttatgttgagaccagaccaagaagcagatggatggacatgatcagttcataaacatgttcctttcttagggtcaaattggaggaggctctagagaagcactgtccaatagaaatataatgccaacaatatatgtwattttaagtcttctattggtgcatttaaaaagtaaaagaaggctgagtggctgggcatggctcctcgtgcctgtaatcccagcactttgggaggccggggtgggcagatcacctgaggtcaggagttcgagaccagcctgcccaacatggtgaaaccccatatntactaaaaatacaaaaaattaaccgggcatagtggcaggtgcctgtaatcccagctactcgggaggctgaggcaggagaatcgcttgaacctgggaggcagagactgcagtgagctgagatcgtgccactacactccagcctgggtgatgagcgaaactccgtctcaaaaaaaaaaaaaaaaaaactcga

SEQ ID NO: 3094 - DNA, 1240 bp, Homo sapiens
  misc_feature (1)..(1): n equals a,t,g, or c
nctgggtccggtcaaccgtcaaaatgtccaaagaacctctcattctctggctgatgattgagttttggtggctttacctgacaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccagctgcacttccaacaacagtcgtgaccacacccgatctcacaaccggaacaccactccagatgacaaccattgccgtcttcacaacagcaaacacgtgcctttcactaaccccaagcacccttccggaggaagccacaggtcttctgactcccgagccttctaaggaagggcccatcctcactgcagaatcagaaactgtcctccccagtgattcctggagtagtgctgagtctacttctgctgacactgtcctgctgacatccaaagagtccaaagtttgggatctcccatcaacatcccacgtgtcaatgtggaaaacgagtgattctgtgtcttctcctcagcctggagcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaacaacgcagtagcatgttagattgaggatgggggcatgacactccagtgtcaaaataagtcttagtagatttccttgtttc

SEQ ID NO: 3095 - DNA, 1095 bp, Homo sapiens
  misc_feature (720)..(720): n equals a,t,g, or c
ggcacgaggaatgggtgggttttttttaagcagttattacctcagcattttgacatcagatatgcaaacttaatggcgttttgtttttttatattctatttgtattctttccccagtatttcccatggggatctccacaagtttggagttttttcctggtgcacacacgtgaggagatttaaggtactatatgcaagtgttttactaaaaagcactgaaattcttctggcaatacaagaaccattttcaggatcttggagttacttccttcttaatctttcttaaagcattcactgatgtttttgttttttcaaaatgaaacaaaaatatcacattgagaagctagtctatgttctgtcactaacatttaaactttgcagactctaacaaaaagcacaagaggtcacgtactattatacaaatttagcggtactggatttacctctgacattaacacactcaggcagagaccaggagtgatcagcaggtcttcagaaccaaaaaacctttctgttcacatttcatctgatttttaaactgaggcaggctttgattcttctgaaggatgccaagaatcaaactaagggaggactcactgttaaagatgtgttctgatgtcttatattaagaccaratgtgacatgatgtgattatcttccagtactttgcttttaggtaccatttcatgacattttaggaatgagtattggaaaatataangaattagaaaagcagcactttttttttaatggaaaagtcttcggtccagtgttacaccttatagtgtaattcagtccctaagcacagaatgaatgtctggcctgcatatggtagttacagtgtaacctctggctgcagaccacacaggacaaccctaacagcctagtcttgtatggtgtaaatatcaagagtacagcttcaatttcatttgctttatcttagcaacaatgccaactcaggagagcagacggccgatttcagtgaagtctggtagtcaacagatgttatttcagtctcagtgcatctcctctggctttctttgactgaaggtgtttataggaaggaagttaaaaaaaaaaaaaaaaaaaactcgag

SEQ ID NO: 3096 - DNA, 442 bp, Homo sapiens
  misc_feature (306)..(306): n equals a,t,g, or c
gaattcggcacgagtgacccagaagggtgagtcagttggtagtgtggggtgcatgagggccattgcaggttttgataattaccctttattttaatttgatcatacttttttgtttataaccttattctaaaaataattcaaggtgaccatgcttccattatacttcttgcaaccatacctatctttggtgatatttattatgttaagggacaattggcatcttttggcccttacctgtagctattctatcatctggagattatctccagacacaaatccatcgcccattgctccatcgaggcacantcagctckttgtagttgccattgcccctctcgagccttctccacatagccacatgcaatccattcccaaaaacctagctcaattttcctcatcacagatgttttccctgaccctccagttggtatatatctcctcc

SEQ ID NO: 3097 - DNA, 507 bp, Homo sapiens
  misc_feature (7)..(7): n equals a,t,g, or c
  misc_feature (10)..(10): n equals a,t,g, or c
  misc_feature (48)..(48): n equals a,t,g, or c
ctcgaantanccccactaagggaacaaagctggagctccacgcggtgncggccgctctaraactagtggatcccccgggctgcaggaattcggcacgagcttttccaaaatggctgtactaatttacattcccaccaacaatgttcaaggatttcatattcttgacattcttaccaaaattgtcacagtttgtaaaaggtagtctaataagtggcctaagtgaatgtgacaacacttcattgaaagcaatcttaggtttttccaactatagtcaataataacttaattgtacattctaaaataactcaaagagtgtaattggattgcttgtaacttaaaggataaatgcttgaggggatggatgcctcattctccatgatgtgcttatttcacattgcatgcctgtatcaaaacattacatttatcccataatatacacacttactatgtacccccaaaaaataaacattaaaattaagttttcaaaaaaaaaaaaaaaaaactcga

SEQ ID NO: 3098 - DNA, 1155 bp, Homo sapiens
ggcacgagtggaagtgtaagcagaaatacagcgagggctcaggaaatactagaataggcaacatgctcttcctctctgcttctatctgcacatctgctttatttctttgcctcagcagactcaccatctctgctcctcatcccgcatggtggggaaggatgcccacccacacctccccaggccatctgttagagctccaaccacgtggaatgacggaatccattctgttctctatctctgctctagtttcaaattcctggggaaaaatgacccagctcacttcaggctcccactcttggtccagtgggctgcaaaatttccaagcgtagcttctgtcagttccttgctttgggttaggtgaaaatgaagggaataattgtgagctgttcagattcaccaagaaattatctactattgttgggggagaatgcccaggggacagatgcatttgggtaagggacaataacaagacactagaaaggaaaatcccaattttattttcctacagagtcagcatcccacacattttccttcacagaaactgacaaataatccatgggggcagcttagcagatgggttgaaaaaagcgacaggctcatcatcagttttcaacaccttgatacatcaggcttggcccttgctacctcatgcattatttaagcacaatgcatctccctctaattgtgtcatgtgctggaggagaatgtgaagttctgtctgtctttagcaaacatgtttcaagtactgtctgtctgaaaaccaaatggaagagggtaaacttgatgatccacttgattttagttttaggacctggatgcataggcagatgtcagtttacaaggattctgtgtactttaaggaatgttttctgagcatgtccagtacaacagacgctctgttaggtagctgtagttaggattttttggttgtaagtatgtgaagatttaaatgtatcagctcacttactcagaaaatctgaggcagtgctagccaaaccaaatggttcaagcaaatgtcatcagtatttggcctcttccagtctttttactcctctatcctctgtgtctgcttcacttctacacaagctttctctatgtggtggctccagattttatatcttctagtagatatttttttaaaaaaaaaaaaaaaaa

SEQ ID NO: 3099 - DNA, 882 bp, Homo sapiens
  misc_feature (881)..(881): n equals a,t,g, or c
gaattcggcacgagatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattccacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttytttagwctaaaraaagttctgaacagaatatcaattaagcttacattgatattctgttcagaactttctttagctagaaana

SEQ ID NO: 3100 - DNA, 870 bp, Homo sapiens
ggcacgagaccacccgcgcctggcctatgtagctaccttctgatctaatttggtatgatggggtagagaaggttagtttagagagaatgtttcctgtcttatcttcttttacccatctcaacacttttacccctctaaaactgttcaacatgttttcctctttggaaatctttcttcatgtgcctttattcattgtattttctatgtctctacttcttgaacttaaacaaaacaaaaaaccctgcaattccacttctcttatttcccatgggccctacttataggtctctgccaaattatgctggctgttctgtttttttcttcatattcccttggtgaacttgcccacagtcttggcttgaactgtacttttatataactgattttcaaatcttgaactcttctaaatttctacctgctggagccgggcacagtggctcacgcctgtaatctcagcctcccgaagtgctaggatcacaggcaagataggtattttaaattgtcatttaacagatggcaaatagccacagaaaagtaaagccactttttcaaactcacaaagtcaaatgtttggcctagttctgtcagactgtaaagcccatgcttttaattggtatctaatactgcttcctatcagtagactatcagattatcattcctaaagatattaaaagaatgggtgctctagggttggagttcaaaacattaatagaattatactattaaggttgcatgtgatcactttgctgctgtgagagacctggatgctgtgtttgctggtcatttcaaaggctgaagagaaacagacatgcctgtccttaccaaaaaaaaaaaaaaaaaaaaaaaaaaaaaaaaaaaaaaaaaaaaaaa

SEQ ID NO: 3101 - DNA, 667 bp, Homo sapiens
  misc_feature (656)..(656): n equals a,t,g, or c
  misc_feature (660)..(662): n equals a,t,g, or c
agagactttggctgtgagccctcacctgggactgatactggctctttgagctttttagtcatgtgcttgtctcttctcttacttagcttgtcatgccttgctgtgccatggtggcctcattcagtgactgctcttcaactctcaccagaaagtgaccaccattcctgacttccaagatccttcttcaaggatatgatggagagctcagagctttccagcttcttagagtagctcagcatttccctcaaatggggtcttcccttttcccgtagtgaaactcatcagccactgttctgcacccttgcatggcctctggagatcttttaacaagtattgttgagcgtcacccttctgccaaggatatggatgtaatggtatgagcaaaaacaaaaatactcgccagtggagggtatgatccagtgagggagaaagatgtcaatcaaatgattataccaataaaaagtagcaaccatgactagtgctatgaagaggagaaatacaatgcagtgaatgagaacctagaatagggtgattctakccagttagggaaagatggaagatttttataaggaagtgactcttgggctgaggtwcacggtaaaaaaaaaaaaaaaaaactcgagggggggcccgtacccaatcgaccctgatgatgnatgnnncatac

SEQ ID NO: 3102 - DNA, 667 bp, Homo sapiens
  misc_feature (430)..(430): n equals a,t,g, or c
  misc_feature (666)..(667): n equals a,t,g, or c
attttcggcacaggccggaagctacctatctggtagggagctcccccagcaccgaagactgcgatgacttctgcrctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacanctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctccarmmmaaaaaaaaaaaaaaaaaaaaaaaaaaaaaaaaaaaaaaaaaaaaaaaaaaaaaaaaaaann

SEQ ID NO: 3103 - DNA, 478 bp, Homo sapiens
ttttttagcatttcacgctatttattccccaaaaccttctgccatagaagacagccaccatacagattggaaaatgtggacgaggagaaaaggggtgtatggtaagcaaaataaattgtattttccatccttggggaggataaaggaactctttgcactgctataatgaacagcccccaaatgccagtggtttaattcagtggagttcagacctcattcctatatcattgcagtgtggatgctcctggatgaaggctcttgtaggtaactctcctccagtcggtgattcagggacccagcctccttctgccttgcggctttgccttttaaaggtcctcagggtgctctccatgtatcttgccaatggggaacgagtgtggaggactcacaagcgggtcycacatcacgtcctccggggctaatacacatcccttctccccacactctgttggtcagaagtcactgcttggcgccctgc

SEQ ID NO: 3104 - DNA, 1725 bp, Homo sapiens
ctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatgtccctgggccagctgcagtcagcaagaggtgtggcatgtttgggatgcaaggggacgtgttcgggcttcgagccacattcatggaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactgggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccaccaacggcagtctcagtgacccgtccaaagaagtggaatacgtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtgacagcaagcaagtgaaataaacaatgatttgcttttcagtgagaatatatatatgagatatatatagatatatattctaggttgggtggtggtagatccttgagggtcagtagtttcaaaaccaaaaatattctaagaagtcttaggatggagttccttttctttctgttgttgtttcccagctacaaccaactaaagacacaaatggcgttctgcaaggggactctgggaggagttttccagaatgcaattccgagtgagcaaatcgcatagctgtagaatgtgcgtgcttttttgtggacacaggagctcctccaggagcaggctgggatcccaactatcgcttgttgcctctttttcaagtggaatttgaattttaaataaacaactttttttggcatgataaacagatcaataaaagttttgtgaattccac

SEQ ID NO: 3105 - DNA, 1169 bp, Homo sapiens
  misc_feature (1151)..(1151): n equals a,t,g, or c
  misc_feature (1160)..(1160): n equals a,t,g, or c
  misc_feature (1168)..(1168): n equals a,t,g, or c
ggggcgcaaatagggtcagtgggccgcttggcgktgttcgttgcggtaccaggtccgcgtgaggggttcgggggttctgggcaggcacaatggcgtctcgagcaggcccgcgagcggccgrcaccgacgcagcgagctttcagcaccgggagcgcgtcgccatgcactaccagatgagtgtgaccctcaagtatgaaatcaagaagctgatctacgtacatctggtcatatggctgctgctggttgctaagatgagcgtgggacacctgaggctcttgtcacatgatcaggtggccatgccctatcagtgggaatacccgtatttgctgagcattttgccctctctcttgggccttctctcctttccccgcaacaacattagctacctggtgctctccatgatcagcatgggactcttttccatcgctccactcatttatggcagcatggagatgttccctgctgcacagccttctaccgccatggcaaggcctaccgtttcctctttggtttttctgccgtttccatcatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcagctgtgatgttggtacctggtgcagacccaggccaaagttctggaaagctccttttgccatctgctgaggtggcaaaactataatttattcctggttggctagaactgggtgaccaacagctatgaaacaaatttcagctgtttgaagttgaactttgaggtttttctttaagaatgagcttcgtccttgcctctactcggtcattctccccatttccatccattaccccttagccattgagactaaaggaaatagggaataaatcaaattacttcatctctaggtcacgggtcaggaaacatttgggcagctgctcccttggcagctgtggtctcctctgcaaagcattttaattaaaaacctcaataaagatgccctgcccacaaaaaaaaaaaaaaaaaaaattcgggggggggcccgggnaaccaattngcccctana

SEQ ID NO: 3106 - DNA, 1148 bp, Homo sapiens
ggcacgagctcgggccagccaagaacactacaaagttgagccgtgtgtcctgtccaagctgtgaagtgcaacacacgtgcacacacacacaccatgcaggccaaaaagccaacaagagacagagagtgggctagcgtgtggccacgtcgggactgtactcacctcgctgtctcggccggtggggccaccctccaggggcagggcagcggtggccgtggccccggagagcagcagcagcaggaggccgggggacaatggcatcttgtgggctgactggagcttctctcccaccctgctgctgctcttccttcctggcagccctgaaatcaatgttttggggacttgggtctcttctttggagcttggtgggtattttaagcccaatctccagctgtttttgtgtctatacatgtctaacgcctggatcytcttccctcttccctcgcgcagtgacgcagaagctggagcaatcagtgcccacaaaagcgctctggggttggatgtaaccccttaattaaagcttcaggtcttttcctgtgtttagagcgaatttgctcttattttggaacgcatgtgcgcttgcttctggagaagttctgcttcctcgtaattatgcctatagcaggcaggaagccgtgagaacaaaaacaagtgatttaacataatataaaattagcctaggataaggagcttgaatgtgaaattgtgcccatgtgaaagtatgactgaaactcatccagtaatttcagagacattcttctactatgggcagagaaacaaggaggcaatgggggctcagagacgctacgatcgtatccgctggtttcacccaattgtcagcaaggaggccccaagaatcgctcccagtactgcctctcagcccagcatgccagacccactgtcctctaggccaggccttctcaaactgaagtgcagacggatcactttgcaggagaatggcatgaacctgggaggcagagcttgcagtgagctgagattgcgccactgcactccagcctgggcaacagagcgagactccgtctcaaaaaaaaaaaaaaaaaagtaattggcagtgactatgggcgcactgcctaacatttagccctgccccatatggaacatgttaaaaaaaaaaaaaaaaaactcga

SEQ ID NO: 3107 - DNA, 454 bp, Homo sapiens
ggcacgaggtcttgtctgcgaagagtttacgaggtttcacccactccttcattcttgaacatgctttttctctgcttattaccctccctgtttcctcctgggctgccaacaacacattatattacctccatctgcaaccagagctgctaccaccactgtgcccgagcctgaattttcatagttatattaaaaaaaatcaaggtgctgggattacaggcgtgagccaccgcgcccggctgtagcccctgtctttattcctcccctgtctaacccgtcctcagcatgaatgccagagttacctcttaaawtatgtcagggtgctaggcacagtggctcatgcctgtaatcccagctcttgggaaggcagaggcaggaggacaamttgagcccaggagtttgagacctgcttggggaatgtagtgagaccttgttctccacaaaaaggaaaaaaaaa

SEQ ID NO: 3108 - DNA, 680 bp, Homo sapiens
gttccatgtggcactgactactccagagtccctgggaacattatgctttttttgcacactcgtctccattttccacgctatacgctccttatatgcaaggtactcttagtagttgcagcatctgtccaccgtccttggctccgtagtatcaccgggtgcttctttactaaatgagagtattcctcagttgtgggagtcgagagagagaagagggagacagagagagagagagagttggggtgcttattttaactctggttctaatcatgctgcaggtcagcttgccaagaaacacttaaggctctgttttctgcatgtaggcaggtaatcctctgatagagaaacatagagttatcccatcaaaatgtgagcacagaaatgtatcaacaacatgccataagccagtcgatatatctaaaagccaaactgcaaaccggtccctgtgcccctgaaagggtgtcagaatatagttgtttttgcaggttttaacattaattggcactagacacacccagctgaagcaaggtctgtcgctggttttgagcttcctctgccttttactgatgctaaaatgtttaactttggctttggtagattttaatgcagaccaagagtgctatttttatgtataaaattttatatttataaaacaaaaagtacctaaaaaaaaaaaaaaaaaa

SEQ ID NO: 3109 - DNA, 372 bp, Homo sapiens
ccaagagttttattactagctggattatgatgttagcccgttgtgtatcttctatatcttatgttaggattcttttctcccatcttcccgcatcttcatcttttcttccccacagcatattcttggagagaaaggagtaggcaggagtttgctatttgaaggcaagtagggagagagatgtggggaggctggtcaaaagaggaaactcaagtttaaagcaatgaaacaccaacactaacttctttttcgaagttgctgatggctttgtgtttagtaatccagattaggtcatgaatcttttgatacagataggtttttttgtgtgttttgttttttatttttgtttttgtttggtacggagctcaatccagc

SEQ ID NO: 3110 - DNA, 556 bp, Homo sapiens
ggacagagttaygcaagctctaatacgactcactatagggaaagctggtacgcctgcaggtaccggtccggaattcccgggtcgacccacgcgtccgggaagttatattgaagcaggggattttttcaaagatgagaattctattacattttgcttggaagcatgtgaaaacattccagaccaaaggaaaagttgaagttccaagtgggcatttagtgtggtcttatctatgactgttaatttttttaatatgctttttctgtttcaaataaaatgctttttctgtttcaaataagctctttggttggcttgttttctgcaactctgttgggtgtttttggtaactagacaaccccaaactcctccaaatggtttctaggactctttctttccttaaatggtttctgggattttcttatttcccatttcatttcttttctttgcttcccttcctattatcatcacacttatgtggagtccagtgctcaggtcctaggagaactaaagtcatccctgcagtgtagttttgatctaaaaaaaaaaaaaaagggcggcc

SEQ ID NO: 3111 - DNA, 1627 bp, Homo sapiens
  misc_feature (618)..(618): n equals a,t,g, or c
  misc_feature (627)..(627): n equals a,t,g, or c
agctgtgacagtgcgggcggccttgttccgctccagtctggccgagttcatttccgagcgggtggaggtggtgtccccactgagctcttggaagagagtggttgaaggcctttcactgttgggacttgggagtatctccgtattctggagcagtatttcatggaaactccattaaataaatatacctctttcatttcctaattgactatgctgaattggtgtttatgataactgrtgcactcactgctattgccctgtattttgcaatccaggacttcaataaagttgtgtttaaaaagcagaaactcctsctagaactggaccagtatgccccagatgtggccgaactcatccggacccctatggaaatgcgttacatccctttgaaagtggccctgttctatctcttaaatccttacacgattttgtcttgtgttgccaagtctacctgtgccatcaacaacaccctcattgctttcttcattttgactacgataaaaggcagtgctttcctcagtgctatttttcttgccttagcgacataccagtctctgtacccactcaccttgtttgtcccaggactcctctatctcctccagcggcagtacatacctgtgnaaaatgaangagcaaagccttctggatcttttcttgggagtatgccatgatgtatgtgggaagcctagtggtaatcatttgcctctccttcttccttctcagctcttgggatttcatccccgcagtctatggctttatactttctgttccagatctcactccaaacattggtcttttctggtacttctttgcagagatgtttgagcacttcagcctcttctttgtatgtgtgtttcagatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatcctgctcatctctgattacttctatgccttcctgcggcgggagtactacctcacacatggcctctacttgaccgccaaggatggcacagaggccatgctcgtgctcaagtaggcctggctggcacagggctgcatggacctcagggggctgtggggccagaagctgggccaagccctccagccagagttgccagcaggcgagtgcttgggcagaagaggttcgagtccagggtcacaagtctctggtaccaaaagggacccatggctgactgacagcaaggcctatggggaagaactgggagctccccaacttggacccccaccttgtgctctgcacaccaaggagccccctcccagacaggaaggagaagaggcaggtgagcagggcttgttagattgtggctacttaataaatgttttttgttatgaagtctaaaaaaaaaaaaaaagggcggcc

SEQ ID NO: 3112 - DNA, 2593 bp, Homo sapiens
  misc_feature (1074)..(1074): n equals a,t,g, or c
atttatatactatacacacacattttaatgtatataaatatttgatacattctgtgtgttatataatgtggtacccagtcctctgctgggacatggatgtacataatgaaacatggaggtccagacgtatgataactctcctgtttcccttccctcattgcctacaggggcaatagtttcatatcttgggttttttattgtttaatttttttttatggggaggggttctttgggtgggtaatagtcagggggaaaggacagtgtctatactttttaaagatgtatataaatgtttcatgttattggttttgtacctagtcctttgcatggatatataggtacctaatgaaaatcgaggatcagtgtatgacaaatctcccatcctcccctttccttattgcctgtgtcggcaataggaagtagaatagttgtgtgttgtttacttacttgtctgttttagagagatttctatttttggtaggggaatattcttaatatgttttcatatctttatttcattttgtagtcttttgcatggctatgtagggacctaatgaaagtcgagtttcataatatgacagctcacttcttttcctacatatttcctcacttagcagtagctagtgtagttattttgtggttattttatttcattctctaggatctattccattaaggatgcaagtgtgtagatgcatatatatcatttgcttctttcttccgccattattttcctttaacacttagtcccttgcaaggggtctgactatacctaacaaaaataaagacctactaaatccctgccatctggctggaaggtgtagcagtgtattaatgtaactaatagcaacaggtgtgcagcagataagacaggagaagacactcagctatggttgagttgtgaaagctaattagatccagcatttcttatgttgattcagattgaatgaggtagtgaaaagggacctgtgcttttgtaaattctagaaaggcaagaggacaatattgaataaagctgtgtttaaacttcattgctcatatatcttttagtaactggtaaaccggcgagckgantaagccaataagagtgctgtctagaacgcatttgcaaaccgttaagagtagcttctttttgaggcctggacttctgattcatctatagaagtctattatgattccatcaattgcatagcttgtgtacctggtagaaattgtgtcttggaatgaccctttcgagttattgacatggctctgatgaatagaacatgagccccaaaactaaatccaaaaggaattttctatctttcatcccccacatgtggcaagacaagttggccctttcttacccagaggtcttttgtgtgactgcatctttctcctccgttctccattgtgtgctttccattttgtctttagtgcctatactgttaggtgttttcttcactggcattcacaaatttaagccattgctgcctcattagccttgtattttgtgtgcatatcatrtatccagacctgtatgttcgctttaagcattcttatatcacactgtctcctcatctaccatatggtaaatgttaaaactccacatttgtctgcatcagggaaaatgcatgggcacacatcctccctccctccctctctgctctcctcccttccttcaggcctcttagcattgtttgttttcccatttctgatactactactccatgctgaagatttgccatattactattttggaaacattgagtgatagaactcctagaaaatttgcaaagaaatgttacatactgtatatcaaactctcagattctagtgttgaaaaagtagcctatactttgctattacttatacctgctgccatagaaaaaaataagtttattcatgacacatttacatttgatcataaataaaagaaaaaagggcacctttttggagttagtcatggtagtcattagtgatatttctgaacagttcttaatttaaaatacttcaaaggaagtaaaggtcatggcttagctgaaggaaatgctccagaaattggactgtgtaaaccatcagtacaataatacgctgtgtatgtatgtgtatataaaatgagaattatggcataattggagcatttgcattaatcaacaaactcacattgagacaaaacttagttttacagctgtcttgattaaagccaagtgttccatgttgctgtgaagaatagcctctttcaaatactttggaaagtagttacttggaaacttgtaaaggtattacatttttatatttaaacacctatagagatcttcaattccttgagtctgagcttgtgggtggaattctaaatttgtatcataatctgtcttttgtgaaacattttgaaaatatgtatatataatattgtatatgcaaattgtgttgtttcacttgtaaagggaaaaggcttatttttctttatatttctgataacttgttttgcatatgaccagcactgactgaaaggcatgtgtagctgcaaacactgttgctttttttgtgaaatgaaaataaaagtatttaaatacaaaaaaaaaaaaaaaaaaaaaaaaaaaaaaaaaaaaaa

SEQ ID NO: 3113 - DNA, 1267 bp, Homo sapiens
  misc_feature (1248)..(1248): n equals a,t,g, or c
  misc_feature (1255)..(1255): n equals a,t,g, or c
gctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaaaaaaaaaaaaaaaaaaaaaaaaaaaaaaaaaaaaaaaaaaaaaaackcgcggccgnaagcttntttccctttagt

SEQ ID NO: 3114 - DNA, 802 bp, Homo sapiens
ggcacgagccctcctccctgctcgcccccagattcccctcccctccctggtgcttttgtctggagggtgttatgggtttgtgtgtgtatgagcgtgtgtgtgtttttggatttcagactaattttctggagtttctgcccctgctctgcgtcaccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccgggtgagcagcgcagatagtgccctcggtcgcctcggccctcactgtctccccctggggcggcctcggctactccccaggtgggacgtgccgcgccacctgcccgcgccaccggcacccagcggccgtggcggattctgcagcatcattcgggggccccgtcgcggagccaaagccgccggcagtctccgcattcccctttaaagggtccttcgcccggcctgtaccatggaatcctgtcttggggaccctttccctacctcccctcccttggcctcaggctcgaagagagagtgggcacactggtggctccagcggcgtcagtgccatcgcggggcaagttgattcctgggcactcatccatccacagtctccgggctggggtcggggtggggatgacgcgagcagagagggagagtgccccaattagtggtgttgggggtcctacgctcagtcttacgcgtgtctgtttgtcctcagc

SEQ ID NO: 3115 - DNA, 1792 bp, Homo sapiens
  misc_feature (1767)..(1768): n equals a,t,g, or c
gaaccccctttctcctggtaaagggtaaggggggggataatgtttaccacaggtacgaaatagtcactttaacattgagacctctgcctcattgaattcaggttttttaagtacttgaaactcttcagattctccttattttagtttctttttacatttatgaagtagaaagcattgttttgtaaactgttttgaaaataaatagcctagtctcttatcctctttagcgtggattaaaggtgaagttctgcaaatgggagagtgttcacagtagatagctcagattgattgaacacatttgaggaagagactcctgcatgagataccagcatttttacaaatactttttatgtacattctttattttgtcattttgtcaaccctctccccaagcacatcttctttccttttactatgtctatgtagggaaaaacaaaacaaaaaattgcacttacgttacactcccaaaatgtgggtaatccgtgtctttcaaaaaacatttctgttttttgttttgttttggtcagtccattgcataagtgacaagtttgggtgcttgtggcacgtatgtatgaagcgggagggggatgasaattgcctgtccttcagtargctgtaaaagtaatttacatgtaagtaaaaagggaaaatagaatagatgccaaagtcatttattcagtccttagttttcttatgtggcattactgcatctgctagttagtgagaaagcaccctcagcttttactgctcccctccctgcctgccaacacacttgatgtgtgcaaacagccctcaagtatctgtcagatgacctatataaggtattgaataaggtattcttgtcagtttagaaatggactggataaaacttacttggttgtcattattttatctcatttgtcctgttacatgccctatgttaagataattatattgccactaataatcaagatgctaaatgagtattacaactggctaatatcattttttatatacaagggtatgtgtatatttggaattgrtatgagaaactcatttgtacccatttgagtgatattgcacaacaaacacagatayctacagactccgttttcattttctcgtgttctttatgataatgatctttgtagattggttatttctgtactttatctgtaataaactttgtagatcctgtgaaccattactttgcctaaatcacttgagacttgagtctttaataacaaagcatcaatattcactaaagtcaatctcttttgagtttctgtgacttggctagaagctcttgacactaagggattagtgttaattttccctgggggtgttccactagggcattactgtataatgacttgatgttgccacatagacttcaagatatataatattttgaggattttgttgattggcctatgttttattgcatagtgtgaaacgtgtaaagcttggttaacctgtatatagatagcttattgttgactagttatagtgtatttagggttgcctgtaatatttaagcttctttactgatgtgtgtgctggtaggaacatataatttttgtacattatatttactgagatgttgccttttttattttacaaatactttggaattccaatgtgttttttgcttccgtgaggattaatttggaaaggtttttaatgacattccactgatttcagattttgcttgagattgacttcaataaattgtcctgtatgttccaaaaaaaaattaaaaaactcgaggggggcccggtacccaanncgccggatatgatcgtaaacaatc

SEQ ID NO: 3116 - DNA, 1457 bp, Homo sapiens
  misc_feature (879)..(879): n equals a,t,g, or c
  misc_feature (1397)..(1397): n equals a,t,g, or c
  misc_feature (1425)..(1425): n equals a,t,g, or c
  misc_feature (1448)..(1448): n equals a,t,g, or c
  misc_feature (1455)..(1455): n equals a,t,g, or c
ctgatcccctgctcatcaatgacttcaaggatgtgacgcacacatgccccagctgcaaagctacatctacacgtacaagcgcctgtgctaacggagctgggactcgggactcccccgcctgtcagtctggccccctgtgctttgctccctgygctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctgrcaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagttagccagttagtccccaggcctgtggcacaggcgttttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactytggccctcagaactctcaggtatagaagcccaggatgtctaataccctgtcccagtgcccgaragctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgangcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgcaaaaaaaaaaaaaaaaaaactcgagggggggcccggtacccaatcgccctatatgantcgtattacaattcatggccgtcgtttnacaaagtcgtgactggggaaaanctggcgnta

SEQ ID NO: 3117 - DNA, 896 bp, Homo sapiens
  misc_feature (6)..(6): n equals a,t,g, or c
  misc_feature (8)..(8): n equals a,t,g, or c
  misc_feature (870)..(870): n equals a,t,g, or c
  misc_feature (877)..(877): n equals a,t,g, or c
agttgnanacaacaggacctgagtccttgggcagcaccagtaggttgccccytgcytcytgccagcytcacytgccacyttytgcccctytcgggatgccttcgcagacagagytyttcgctgcctgtggtggccaytctttgcttttggttytcttgccccttggcctccctttttgtccccgggcagccttgtgtgacctgcccttttccctcccttcctttccaggacaagcacgccgaggaggtgcggaaaaacaaggagctgaaggaagaggcctccaggtaaagcctagaggccaaagaactttccaggtcagccggacagctccagcagctccacgttccaggcagcctcgmccgccggctgcgctcccagcactggggtttggggggaggggggtggccaaggggcgtttcctctgcttttggtgtttgtacatgttaagaattgaccagtgaagccatcctatttgtttccggggaacaatgacggggtgggaraggggagaggagagagtttgggaaagggagatggagaagaactcaaggacattgcaaccctgcccggcgcagatctgattttcacatctctacctggacattgagcctcccaggcaccatgttgaggagagatgaaaaccagggcggtagaacttcagggtgaaggacagagtcctgggtggggcagcggctgcagggcgcaccagagaacccagccagagggggtgtgagtaccagtggtgttgcttccaccctgcagcaggtgggatgaggtctgtgtgtgtgtgtgaaccatcattttttgatcatcatgaccaatgaaacattgaaaaaaaaaaaaaaaactggaggggggcccgtacccaantcgccgnatagtgatcgtaaacaatc

SEQ ID NO: 3118 - DNA, 2184 bp, Homo sapiens
ggcacgagaggaaagtggcagggattggaggctcctggagaaagggcaaggctgaaggttgtcccatgtattttggccagatttgattatgtaatcgagaatcatgagataattaagtgtgttcatgtctctggagccttcaaccagctcttttaacatcttgctcttcccagcattccttagggtctttggctgggctctgggatggatgccatgggagtacctttacttaagctctaaagttaccaatggagagactgggactcaaagaggaacttgattggaccccagagaggtgaggggtaagggctagaacctcacacatgctggttttgctgctgcctggcaggcccatgggaagaactttagaggttccaaggaattggaaaagggtcacaagatgggtggccaaactcccagctcaggcttgattcctactgtcaatgtggggatagtggagaagggggctgcaggaagggctgagaaaagctgagaatgagaagttatacaggaggtagcttggtgggagtgaaacaaaaatgagtggttcatgggccagccaggcatcctgatttccagctcacagcagcaggagcttcagagaggaagaaggagaggaggagaaagccaggttgatgttagtaaaggtcaaacaatttcaggagcacctctgacctccctccacacaggttttcttaccttgactatgcagagggtggtccatcttggcactgaagatggaaccccctcttccatggtctggggtgaccccatgcctgtaactgaatgtgctcagatccttggggtgcggggactgtagggggaggatttgaaggtgtgggactgtcctggctggagaccactgggtcaggagaactccagtagagggtttgggtgctgggaaccaggaagagtgggggaaggggcagagccaactccagaggcggatctcctggctgaggacagagggtgtattgtccaagctggaggttgctgtagctgggcggggagcagctcagctcgtctcttccaaatttcttttgggggagggtaagggaaggcaagcccccctttacttgtggccctgggggctacaatggttgctgagaaacaaggcttatttgacaaataatgcttcccaggagcagatgtgtagctctctcacttcctgagaaaccagatgctgtgagctcgcttagcacttgaggcgacgccctcagcacgaactgggaccctagtgccttgggatccagagtatagtgcttgattctattgagaagaaacgaggctaatgtggactgggagacacacgggacctaatcagcctcaagttagcccttttgaagtaggttgctgcacctgcactttccccctactcgtccactagttcaagatttacaagacgttgacaatgagggctgaccagtcctggttccactcctgcagctggggggcttctcggtggacccacactttttttttgagacagggtcttgctctgttgcccaggctggagtgtagtggtgtgatcacagctcactgcagccttgacctcctgggttcaagtgatccttcctcccaagtagctgcgactatgggcatacaccaccatacctggataatttttctatttttttgtagagacagggtcttgccatgttgccctgactagtctcaaacttctaggctcaagcgattctcctgcctcatcctcccaaagtgctgggattacaggtgtgagcaaccattgagacaagagtctcgctctgtcacccaggccggagtgcagtggtgcgatcccggtccactgcaacctccacttcccgggttcaagcgattcttctgcctcagcctcctgagtagctgggactacaggtgtacaccaccatgcctagctaatttttgtatttttagtagagacggggtttcaccctattagccaggctggtctagaactcctgaccacatgatctgcccgccttggcctcccaaagtgctgggattacagctgtgagccatggcacctggccacacacgtctttttaaatttaaatgaggatgtggccatattacagcccaggttttctctgactttagagtaccttttgggacatagggccttcctctctaccctttctgtacacagccatcataaacctctttcaacaaaaaaaaaaaaaaaaa

SEQ ID NO: 3119 - DNA, 2483 bp, Homo sapiens
cggcacgagctcgtgccgctcgtgccgggactggttaatagtgaagtccataatgaagatggaagaaatggagatgtctctcagtttccatatgtggaatttacaggaagagatagtgtcacctgccctacttgtcagggaacaggaagaattcctagggggcaagaaaaccaactggtggcattgattccatatagtgatcagagattaaggccaagaagaacaaagctgtatgtgatggcttctgtgtttgtctgtctactcctttctggattggctgtgtttttccttttccctcgctctatcgacgtgaaatacattggtgtaaaatcagcctatgtcagttatgatgttcagaagcgtacaatttatttaaatatcacaaacacactaaatataacaaacaataactattactctgtcgaagttgaaaacatcactgcccaagttcaattttcaaaaacagttattggaaaggcacgcttaaacaacataagcattattggtccacttgatatgaaacaaattgattacacagtacctaccgttatagcagaggaaatgagttatatgtatgatttctgtactctgatatccatcaaagtgcataacatagtactcatgatgcaagttactgtgacaacaacatactttggccactctgaacagatatcccaggagaggtatcagtatgtcgactgtggaagaaacacaacttatcagttggggcagtctgaatatttaaatgtacttcagccacaacagtaaaaactggaagagatggatttaaagaagaaatatctattgatatttcctatactctcaatgaagaggtatttcctaataggagaccttaaattgaacaaacctaaagtttacacttctaagagtacagttaaaagtatgtggacctgcagttcttgtaactctccactctgtgttaatgatatatttgtactaggatcttttacttgaatctaaatttactggttgatttccttctccagcctatcccctacagggaaaagctgatacttcccctatagtacaataaataattatttaaaagtcatagctccagtcactactgaaaacataattttggtgataaacataatttgagaaacttaatttctgaatgtttttatagaaaattactgaaaatctattactcatggaagacttttaaagagtaaccttttttcctgttttataaattcccattgttatatggtagtatttcagctacacaatattttagcttttagctagacatttataggttttcatttgttgaaatggtaatcatctgcatgtttttgtcacttatttcaggttagtgattgcctaacacttataagccaaaataatctttgcaaaattccatacctaaaattttgaaagcccctaatgttttcacacatctttctgtattagttatagttttgtgaaatctttgtgtgatcttcaaacattatcatttaatgtacaatactgtaaataaactgtgcatggcttttatacagctttagtaaatgtcaaataaagtggtacagactcattacaacaagtttctcataaaaatacaataaataggaaaatgaaattcagaaacccatagactgggaataggttccagttacagcttggatctggcataaaataaatttgaaataaaatattttgatgctccatttttttatgttgcttttcatactaaagaatggtgtagacttgtttgcaactgtaggtacccagttatcaattttatcaatgtttagagagaaattatttttttggtagaaatgtcaagaaatccttaattgaatgtcattaaatgatggtggccaaaataaaacctatttagaaatttaatcactttgcacatcacttggaatatgatgcctctagtagttacttttttatagttttctacttttggttttatttaaaattgttttcaaatatagattattgacttattcaactttgctgttttatattttcagtatcatttttcatttgtttttttttttttgtcttttcacttaccaagttctagggacatttaaaatatgtactaagtgtaggagtggttatgataccaaaaaatgtagctgggttgagattaatttcgttctgttttctcatgacagaaatcaggtttccctttccccacccctaagtgcctaacttaggtctgaaacagcctgtttattagtctgactctctcaaccataaaacataagctttatttaattctgcctttaaacacactcaggtttccccttaattttcatattattttctgcaggttttcttgagtatcttcaattcgttgaatgtggtttttggtttttttttgttttaacactagtcttcccttaattcattgctaactcaagccatccttactattaaacccaaatcagtcctttaagttcattatggcctttctagtatttaaaaaaaaaaaaaaaaaa

SEQ ID NO: 3120 - DNA, 1892 bp, Homo sapiens
ccagagcaggctgctaggcctggggccaccactgcccctgggtgctacacccagtgtgctgggtcactgggaacttcctgaagtggtgtcacctgaactgggcccccaaggatggggtgcgggcagtaccgcaggaagaggagcagcccctgtgaagattgagagctgccagaggctctgtgattggctgcggcacgatgacccgcgcacggattggctgcttcgggccggggggccgggcccgggggacagaatccgcccccgaaccttcaaagagggtaccccccggcaggagctggcagacctaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaaggggctgtggatgtcgtgcgtggtgcagagcaccgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcagcgctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgctgtttccataggcagagcgggtgtcagactgaggatttcgcttcccctccaagacgctgggggtcttggctgctgccttacttcccagaggctcctgctgacttcggaggggcggatgcagagcccagggcccccaccggaagatgtgtacagctggtctttactccatcggcagggcccgagcccagggaccagtgacttggcctggacctcccggtctcactccagcatctccccaggcaaggcttgtgggcaccggagcttgagagagggcgggagtgggaaggctaagaatctgcttagtaaatggtttgactctccaagaaaaagaaaactcgagggggccggtaccaatcggccaagtgagtgatacactcctggcgacgtcacgcctgatggcacctgggaccataatcctgagatcccttgaccgggataaaagtcaaaggctcacaggccactgaggactggcgagcgcatgtagcatacacgggaccatggtggcgccatgctggccattgcgggggtggtg

SEQ ID NO: 3121 - DNA, 2420 bp, Homo sapiens
  misc_feature (1654)..(1654): n equals a,t,g, or c
gccaacagtgctccctcatagatggacgaagtgtgaccccccttcaggcttcagggggactggtcctcctggagggagatgctcgccttggggaataatcactttattggttttgtgaatgattctgtgactaagtctattgtggctttgcgcttaactctggtggtgaaggtcagcacgwggccgggggagagtcacgcaaatgacttggagtgttcaggaaaaggaaaatgcaccacgaagccgtcagaggcaactttttcctgtacctgtgaggagcagtacgtgggtactttctgtgaagaatacgatgcttgccagaggaaaccttgccaaaacaacgcgagctgtattgatgcaaatgaaaagcaagatgggagcaatttcacctgtgtttgccttcctggttatactggagagctttgccagtccaagattgattactgcatcctagacccatgcagaaatggagcaacatgcatttccagtctcagtggattcacctgccagtgtccagaaggatacttcggatctgcttgtgaagaaaaggtggacccctgcgcctcgtctccgtgccagaacaacggcacctgctatgtggacggggtacactttacctgcaactgcagcccgggcttcacagggccgacctgtgcccagcttattgacttctgtgccctcagcccctgtgctcatggcacgtgccgcagcgtgggcaccagctacaaatgcctctgtgatccaggttaccatggcctctactgtgaggaggaatataatgagtgcctctccgctccatgcctgaatgcagccacctgcagggacctcgttaatggctatgagtgtgtgtgcctggcagaatacaaaggaacacactgtgaattgtacaaggatccctgcgctaacgtcagctgtctgaacggagccacctgtgacagcgacggcctgaatggcacgtgcatctgtgcacccgggtttacaggtgaagagtgcgacattgacataaatgaatgtgacagtaacccctgccaccatggtgggagctgcctggaccagcccaatggttataactsccactgcccgcatggttgggtgggagcaaactgtgagatccacctccaatggaagtccgggcacatggcggagagcctcaccaacatgccacggcactccctctacatcatcattggagccctctgcgtggccttcatccttatgctgatcatcctgatcgtggggatttgccgcatcagccgcattgaataccagggttcttccaggccagcctatraggagttctacaactgccgcagcatcgacagcgagttcagcaatgccattgcatccatccggcatgccaggtttggaaagaaatcccggcctgcaatgtatgatgtgagccccatcgcctatgaagattacagtcctgatgacaaacccttggtcacactgattaaaactaaagatttgtaatctttttttggattatttttcaaaaagatgagatactacactcatttaaatatttttaagaaawtaaaaagcttaagaaatttaaaatgctagctgctcaagagttttcagtagaatatttaagaactaattttctgcagcttttagtttggaaaaaatattttaaaaacaaaatttgtgnaacctatagacgatgttttaatgtaccttcagctctctaaactgtgtgcttctactagtgtgtgctcttttcactgtagacactatcacgagacccagattaatttctgtggttgttacagaataagtctaatcaaggagaagtttctgtttgacgtttgagtgccggctttctgagtagagttaggaaaaccacgtaacgtagcatatgatgtataatagagtatacccgttacttaaaaagaagtctgaaatgttcgttttgtggaaaagaaactagttaaatttactattcctaacccgaatgaaattagcctttgccttattctgtgcatgggtaagtaacttatttctgcactgttttgttgaactttgtggaaacattctttcgagtttgtttttgtcattttcgtaacagtcgtcgaactaggcctcaaaaacatacgtaacgaaaaggcctagcgaggcaaattctgattgatttgaatctatatttttctttaaaaagtcaagggttctatattgtragtaaattaaatttacatttgagttgtttgttgctaagaggtagtaaatgtaagagagtactggttccttcagtagtgagtatttctcatagtgcagctttatttatctccaggatgtttttgtggctgtatttgattgatatgtgcttcttctgattcttgctaatttccaaccatattgaataaatgtgatcaagtcaaaaaaaaaaaaaaaaaaaaaaactcgagggggggtcccgt

SEQ ID NO: 3122 - DNA, 1192 bp, Homo sapiens
ggcacgagcacattttagtgtacatttttagaatatatttaaaacaataagatagtctgaattggatggttgagtaacctttaaactcatctggtaaacctctaatgtatagtagaaataatttgaaagcttttaatgtataatagtacttacttcaggaaaataatttgatgtttcattgttggtctctttttctatattatttcagcctaagtctatcttcataccacaggaaatgcattctactgaggatgaaaatcaaggaacaatcaagagatgtcccatgtcagggagcccagcaaagccatcccaagttccacctagaccaccacctcccagattacccccacacaaacctgttgccttaggtaatggtggagggtgacagcaaatatgttaccaggttttcatactatggggagaaaaaaaactttcttttaagagattatttgaaattcttttggtggaggacagaaggaaagcagtggctatggagatgttttctgctttttgcctactagcttaaagtgtttttatgacaggattccctatgacacagtctgagatattttgtcctcatttctcatttcatatttagccttctctcttctagagactggttccccattcatttagctacggtgtggaaacaatgcaaattaaactatgaacaaacatggaaaatgtgttttgcgtctaggttacttctgttttagaagagagtaccttgtcctaactccttatttcatttaatcatttctaaaaaaataattggtattatttgctaggtatttgcctccaaattaatactagaaggtgctattttaacactgtaaagactcctctgtgtttatccagaagaagcaattttaaaaaagagcaactaggctgggcatggtggctcacacctgtaatcccagcactttgggaggccgaggcaggtggatcacctgaggtcaagagtttgagaccagcctgaccaacatggtgaaactccgtctctactaaaaaaaaaaatacaaaattagctgggcgtggtagcgcatgcctgtaatcctacttgggagactaaggcaggagaatcgcttgcttgaacctgggaggcggagtttgcactgagccaagatcacgccattgcactctagcctgggtgataagagcaaaactccttctcaaaaaaaaaaaaaaaaaa

SEQ ID NO: 3123 - DNA, 558 bp, Homo sapiens
  misc_feature (546)..(546): n equals a,t,g, or c
gaattcggcacgagctgggctgcagttggcgattccgcgcggtgaaagcagccagtgcccagggtcttttcctgagtgcacctgggcctgccgcccggcgatgccatggggtcgtgcgctgcttttctacttgccgcgctctcactgctcggtgtactgggagggtaccctgggaggcgtgcctttattcttccgaaccgccgctcactgagacagtggctagaagtgtctcttggacctgtgagttagccttaacctgttatgcccccagagccctcagtggagcgcccgtactttgccggcatgacgtttgatttcccggtgataatccgacgagtttgacagattgaggtagtgagcaaagttgcccgtcagttggtggccacttgacttcgtgcggaccctggccttgctcttggaagagatagtgttcttagggctggtttcactgtctcttaagactgaarggtggarctgggatatagatgtgttgtttcttttcaaatcaaacctgcttargtcgtcactcgaaggggggcccggtanccaattcgccct

SEQ ID NO: 3124 - DNA, 1226 bp, Homo sapiens
ggcacgagcatgctttgcttacaatggagtctgcagtgaggggagatgctgggatagccatttccatggctctgttatgcaagcacaaatttcatctcctagatggacttcctggttttctcttactgcagtaacactggccttcccttctctaattccttaccccagctgcggcatccctgtgttaactcaggatgccaagtggccctcagattacacttctccagatagctgaatgagtctgctttcactgtgactgggacctgaatgacctgcagtcagggcccagagttgggactctatactaccctgggctctggtctgtaggtttgtagtagccaccggtaataagccaagggctaggctcttgtttgagtttatggccacctggaattttcagtcatctcatgatacaggcgggaggggcagaacagatagattacgacaggtttggtttttaaattttccaaccaagtggaaaggcaagttggtcttatagaaagcactactgcacttagtagctatgtgattttgagcaaaccacataatctctctaggtccattttcctaaccacaagataaagatgttacattgtcaaagcttgccgtagatttggggtgaatgaaaattattccttgctttcatcactacctttatagctctcatcactacctttatagctcatcactgtgcctttttttctttcctaagaaagacatcacatccctctcctctcctcctctgtgctcctgtccctccctccccctagcaaggtccaggcaaagctggagatgaagctgaagatccagagtttcctagaacgcaacttaaggatggctaaggaaagggaagcctgactgctcggtcaggagggtgcagtatctcttgctgggaacacagccagtttccacaatgcctagactgtgtatgtctatttgcacaagattggcttttcctattttggagtggtcagacattttatttttgttcaagattatctggcgttttagacaaatttgcaaaactgtgcttttattgactttttgaataaactttggtattctggagcaaatgtatttatttattggtatgtgcaatgacaaacttggtatttttcccatgtttgacatttatgttatgtttgttagaattttagtgtttgtctaagtacacacatatatcaacaaattaaacttgaatcgtttcaaaaaaaaaaaaaaaaaaa

SEQ ID NO: 3125 - DNA, 2249 bp, Homo sapiens
  misc_feature (1579)..(1579): n equals a,t,g, or c
  misc_feature (2226)..(2226): n equals a,t,g, or c
gaattcggcacgagctcaccgtgctgcgtgacacaaggccagcctgcgcctacgagcccatggactttktratggccctcatctacgacatggtactgswtgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcgctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagamacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggctttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaansccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaaaaaaaaaaaaaaaaaancccgggggggggcccggacctgg

SEQ ID NO: 3126 - DNA, 1232 bp, Homo sapiens
gaattcggcacgagcgcggctctggagccgcccggcccggacatggcgaccgtccgggcctctctgcgaggtgcgctgctccttctgctggccgtggcgggggtcgcggaggtggcagggggcctggctccgggcagtgcgggtgcattgtgttgtaatcattcaaaggataaccaaatgtgccgtgatgtatgtgaacagattttctcctcaaaaagtgaatcccgactaaaacatctgttgcagcgagccccagattattgcccagagacaatggttgaaatttggaattgtatgaattcatctttgccaggtgtgtttaagaagtctgatggctgggttggcttaggctgctgtgaactggctattgccttggagtgtcgacaggcatgcaagcaggcatcttcaaagaatgatatttccaaagtttgcagaaaagaatatgagaatgctcttttcagttgcattagcagaaatgaaatgggctcggtttgttgcagttatgcaggtcatcacacaaactgccgagaatactgtcaagccatttttygaacagactcttctcctggtccatctcagataaaagcagtggaaaattattgcgcctctattagtccacaattaatacattgtgtgaacaattatactcaatcttatccaatgaggaacccaacggatagcagatctgtgctctctgacatttagtctatacgagatactgctggagctaaggagatggcagctcaataaaaaagcagaaagaggttttaagggtagaacaaccgtctccatctttgccaatacagaggaatctggaaaagaaggcgccaaacagatatgcacagatttcttccaaagtcagagaaaactacttcaaagaagcccttctgaattctgtaatatggttgaaagtgtttttttatttctgattctttgagaaaattaaargcagagccaaactgatatcttgtcagagttcgctactgtactatttatgttacaacttagattaattagcataagatatataaaagctttatgtggtcctggaatgtaatgaaatattgtgtctggaattggttccttccggtgggttcttggtctcgctgacttcaagagtgaagccacagaccctcgcgtgagtgttacagctcttaaaggtggcatccagagttgtttgttcctcccagtaggttcgtggtctcgctgacttcaggagtgaagccgcagac

SEQ ID NO: 3127 - DNA, 2624 bp, Homo sapiens
  misc_feature (2504)..(2504): n equals a,t,g, or c
  misc_feature (2549)..(2549): n equals a,t,g, or c
  misc_feature (2616)..(2616): n equals a,t,g, or c
gctatttaggtgacactatagaaggtacgcctgcaggtaccggtccggaattcccgggtcgacccacgcgtccggcgggggcatcgccgcccgcgcccctctaagtgccgggccgcaagctccaccgcagccgcctgcaagcagcggcgcctcggccctcgacctgcgcgcaaagcctgtgctggagccgtcctcccgcggcggggaccgggaccggggacccaagccaatcgaaagctccaaccatggccatggggctcttccgcgtgtgtctggtggtggtgacggccatcatcaaccacccgctgctgttcccgcgggagaacgccacagtccccgagaacgaggaggagatcatccgcaagatgcaggcgcaccaggagaagctgcagctggagcagttgcgcctggaggaggaggtggctcggctggcggccgaaaaggaggcactggagcaggtggcggaggagggcaggcagcagaacgagacacgcgtggcctgggacctctggagcaccctctgcatgatcctcttcctgatgatcgaggtgtggcggcaggaccaccaggaggggccctcacctgagtgcctgggcggtgaggaggatgagctgcctgggctggggggcgcccccttgcagggcctcaccctgcccaacaaggccacgcttggccacttttatgagcgctgcatccggggggccacggccgatgcagcccgtacccgggagttcctggaaggcttcgtggatgacttgctggaagccctgaggagcctctgcaaccgggacaccgacatggaggtggaggacttcattggcgtggacagcatgtacgagaactggcaggtggacaggccactgctgtgccaccttttcgtgcccttcacaccccccgagccctaccgcttccacccagagctctggtgctccggccgctcagtgcccctggatcgccagggctacggccagatcaaggtggtccgcgccgatggggacacattgagctgcatctgcggcaagaccaagctcggggaagacatgctgtgtctcctgcacggcaggaacagcatggcgcctccctgcggygacatggagaacctgctgtgtgccacagattccctgtacctggacacgatgcaggtcatgaagtggttccagacggccctcaccagagcctggaagggcatcgcccacaagtacgagttcgacctggcctttggccagctggacagcccggggtccctgaagatcaagttccgttcagggaagttcatgcccttcaacctgattcctgtgatccagtgtgatgactcggacctgtactttgtctcccaccttcccagggagccctctgagggcaccccagcctccagcacagactggctcctgtcctttgctgtctatgagcgacacttcctcaggacgacactaaaggcactgcccgagggcgcctgccacctcagctgcctgcagatagcatccttcctgctctccaagcagagccgcctgaccggtcccagcgggctcagcagctaccacctgaagacggccctactgcacctcctactcctccggcaggccgccgactggaaggcggggcagctggacgctcgtctgcacgagttgctgtgcttcctggagaagagcttgctccagaagaagctccaccacttcttcatcggcaaccgcaaggtgcctgaggccatgggactccctgaggccgtgctcagggccgagcccctcaacctcttccggcccttcgtcctgcagcgaagcctttaccgtaagacactggactccttctatgagatgctcaagaatgccccagcgctcattagcgagtattccctacatgtcccctcagaccagcctaccccaaaaagctgacgtcttttacagaatgtgggatcctcgagctaagatgagggcatccctcacgttcacacccctggtggcatctgccagccctgttctggggacaaggcgggctttcgtgggagccgtgctcagcctgccaggaagccaagccctacagtgcagaggaaacagaatttcaacgggaagctggtttgcttcataccattgggatctgctggtaaagctgttatttgggtttagggactgatcccttgcagtttacttctggatcaccatgaatggccaagatggtggcagaacacgctgtggaccctgagttagagacaatgcaaatgttggattgggtgtaattctttttgaatcccagatccagtctgtacttgaatatgagcagaggatctacaagaatgctgacagggaaccgtgttaagacccagcacccctattcccaggagcttctggcctgaccatctgcagccaaagcactaacagggacagatatgggaatgtccacctttgatccgcatcctgcacaatagtggtcccaccatggctgccacttttttatactatttggagaaaagaccttgtataaattcgaggcccgaatgactaacgtctctntcacacggaaatgggtacttggtgggcatagagacaatgcaaatntttggattgggtgtaattcttttttgaatcccagatccagtctgtacttggaatatgagccagaggntctacaag

SEQ ID NO: 3128 - DNA, 1684 bp, Homo sapiens
gcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgtgccacggaccacaatgtggacaacaccacagagatgctgcaggagtggctggcggctgtgggcgatgactatgctgctgtggtctggaggcctgagggcgagcccagttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttccctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctaccttggacggaaacaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagc

SEQ ID NO: 3129 - DNA, 3174 bp, Homo sapiens
gcggacgctggrcscaaacactaaggcctgagcggtgacaatcgaggcgagatgatggtcaacagggaatgcctcgtgggagaaaaaagacaattttattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcaggcgggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtyagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttaaaaaacttgtcacagctctgtttttttgcttttccccttcatcctctattagatccttaaagaatccaccctcaaactgtggactaaggatggcagtttgccttaaaccttctgtggaatgagatgggctgtcaggacgtcttcaacccacagtaccccgaaagctttgtgctcaccac

SEQ ID NO: 3130 - DNA, 640 bp, Homo sapiens
  misc_feature (1)..(1): n equals a,t,g, or c
  misc_feature (4)..(4): n equals a,t,g, or c
  misc_feature (15)..(15): n equals a,t,g, or c
  misc_feature (17)..(17): n equals a,t,g, or c
  misc_feature (21)..(21): n equals a,t,g, or c
nggngtgacctatanangtanccttcagtaccgtccggaattcccgggtcgacccacgcgtccgaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttcccaaaaaaaaaaaaaaaaaaaaaaagggcggccgctctagaggatccctcgaggggccc

SEQ ID NO: 3131 - DNA, 978 bp, Homo sapiens
  misc_feature (977)..(977): n equals a,t,g, or c
ggcacgaggcgcgccaaggcgtcagtcgaggagtcaaggcagcaatgaatcgtgtcttgtgtgccccggcggccggggccgtccgggcgctgaggctcataggctgggcttcccgaagccttcatccgttgcccggttcccgggatcgggcccaccctgccgccgaggaagaggacgaccctgaccgccccattgagttttcctccagcaaagccaaccctcaccgctggtcggtgggccataccatgggaaagggacatcagcggccctggtggaaggtgctgcccctcagctgcttcctcgtggcgctgatcatctggtgctamctgagggaggagagcgaggcggaccagtggttgagacaggtgtggggagaggtgccagagcccagtgatcgttctgaggagcctgagactccagctgcctacagagcgagaacttgacggggtgcccgctggggctggcaggaagggagccgacagccgcccttcggatttgatgtcacgtttgcccgtractgtcctggctatgcgtgcgtcctcagcactgaaggacttggctggtggatggggcacttggctatgctgattcgcgtgaaggcggagcagaatctcagcagatcggaaactgctcctcgcctggctcttgatgtccaaggattccatcggcaagacttctcagatccttggggaaggtttcagttgcactgtatgctgttggatttgccaagtctttgtataacataatcatgtttccaaagcacttctggtgacacttgtcatccagtgttagtttgcaggtaatttgctttctgagatagaatatctggcagaagtgtgaaactgtattgcatgctgcggcctgtgcaaggaacacttccacatgtgagttttacacaacaacaaatgaaaataaattttaattttataatatgggaaaaaaaaaaaaaaagggcggccggtaacccattgcgcccna

SEQ ID NO: 3132 - DNA, 3398 bp, Homo sapiens
  misc_feature (3394)..(3398): n equals a,t,g, or c
ggcttaattatacccataggtaatacaaaaagstctgaagacccaaagatgacattactaatgatgtgatttgagggaagctggtaaggttcttctgtggctcctgaaatcacatcattagtaatgtcatctttgggtcttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattaygtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaaraaaaagaagaaagacacaaagaaaataatctaaacaccaaaaactaaacacaattccaatcctttttctgtacctcacgcgcataaatttgctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgcttcaaaaaaaaaaaaannnnn

SEQ ID NO: 3133 - DNA, 2863 bp, Homo sapiens
cggacgcgtgggtgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaattggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagaatagctggctgggagacattctggactggcaggatattgtttcctttgttcacgagaacattgagacatttctttcgatcttggagtctctgtggatcgttatgagccggaatgtgagcctgctgttcaccactgtcactacactcttgaccatcctcttctacagcgggacagcccttctcaattttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgatgatttttcatctcttgccaacatactttgtagatactgcaatctactctgacatatcaggaggtggccatccttacctgacaggcttggcagtggccggtggaagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccctctgcccttccagctgtgcctagcaagcaaaacccaggaaagaagcagaagcctcctggccttacatacagaatgcctggacaagagagaacttgctgcgggctgctttgtattttaaaacacagcttgagagttcagccgttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtattttttcctggtttaagaaatgtattgttaaacttttctaagacagtcactttcaaggaagagggctttcacttttgagtgtgtagttgagtgagcaggaaaaatgaatcttctacccttctcccacaatgtattaaacgctctttaagaaataataaatcataagtataagggtggggtggcttatttgatgttcagttttatattataaccctgggagatacaaagactgaagctcttcctcctcttccttttctcttcacgcttctttacactattgccaaattataaaacttggctgaccacgttgaagtgaaatacttattaagctgctatgaatggtaacagtatgataaaattcatgctgttattaggttttctccttccaggtggttgaagtgaaaaatctcaggtgtagcaatactctgatttgttaaatgtatccgtttcattatttggaacttcttgccaataaggttagttttcagcagaattttgtatttaggtagtattttcccatctcttagcacagtgccttgcacatgactctaaagaatgctttgtttgaattgaattgcaactttaaaaatatctcagatatcacaataaccagcatagtgctttacattttacaaagtccttttgcacatactatttcaccaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttggccaggctgtaggtggtggctcacatctgtaatcccagcactttggaaggctgaggtgggtggattgcttgagcccagggatttgagatcagcctaggcaacatggcaaaaccccatctctacaaaaaaaaaaaaaaaaa

SEQ ID NO: 3134 - DNA, 882 bp, Homo sapiens
  misc_feature (198)..(198): n equals a,t,g, or c
gggcgatarggtgctgtccttggggtgctgtgtatatgggatgatgacgcttatcagcattatctagtcctttccaccccgaaattcgccccgattaaagactgtgttgcattatcagcctgccgaccatgcccgcgggcgtgcccatgtccacctacctgaaaatgttcgcagccagtctcctggccatgtgcgcangggcagaagtggtgcacaggtactaccgaccggacctgatgagaaacaggttgagaagagtgaagttgatttctcaaagtcacatagctttagtgagacgatttgaggatctgaagcccaagctttctgtttgcmaaactgggatcacaagtctttcggtcggagaactggaagtctgggcagagtcgagcagaggagacctgatgactgcctagacttgtgctcagtgctgtgttggggagaactgctacgacatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaaccgccaaagcacatatcatcaaaccatttcatgaatatggtttggaagatgtttagtcttgaatataatgcgaaatagaatatttgtaagtctactatatgggttgtctttatttcatataaattaagaaattatttaaaaaaaaaaaa

SEQ ID NO: 3135 - DNA, 2774 bp, Homo sapiens
  misc_feature (2055)..(2055): n equals a,t,g, or c
  misc_feature (2740)..(2740): n equals a,t,g, or c
  misc_feature (2763)..(2763): n equals a,t,g, or c
aattccccggggggaagtggcttcatttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataraaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacrtgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaaccwatgcgncccggcatggtggctcacacctgtaatcccagcactttgggaggccaaggtgggtgggtcatctgaggtcaggagttcaagaccagcctggccaacatggtgaaccccatctctactamagatacaaamatttgctgagcgtggtggtgtgcacctgtaatcccagctactcgagaggccaaggcatgagaatcgcttgaacctgggaggtggaggttgcagtgagctgagatggcaccactgcaytccggcctaggcaacgagagcaaaactccaatacaaacaaacaaacaaacacctgtgctaggtcagtctggcacgtaagatgaacatccctaccaacacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagamamawaaaaaaaaaaaaaaaaaactcgagggggggcccggtacacaattnaacccggagtttgccaattaaantgtctaatcat

SEQ ID NO: 3136 - DNA, 2624 bp, Homo sapiens
cccggggcgaggactgttaactgtttctggcaaacatgaagtcaggcctctggtatttctttctcttctgcttgcgcattaaagttttaacaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaatttttgatcctcctccttttaaagtaactcttacaggaggatatttgcatatttatgaatcacaactttgttgccagctgaagttctggttacccataggatgtgcagcctttgttgtagtctgcattttgggatgcatacttatttgttggcttacaaaaaagaagtattcatccagtgtgcacgaccctaacggtgaatacatgttcatgagagcagtgaacacagccaaaaaatctagactcacagatgtgaccctataatatggaactctggcacccaggcatgaagcacgttggccagttttcctcaacttgaagtgcaagattctcttatttccgggaccacggagagtctgacttaactacatacatcttctgctggtgttttgttcaatctggaagaatgactgtatcagtcaatggggattttaacagactgccttggtactgccgagtcctctcaaaacaaacaccctcttgcaaccagctttggagaaagcccagctcctgtgtgctcactgggagtggaatccctgtctccacatctgctcctagcagtgcatcagccagtaaaacaaacacatttacaagaaaaatgttttaaagatgccaggggtactgaatctgcaaagcaaatgagcagccaaggaccagcatctgtccgcatttcactatcatactacctcttctttctgtagggatgagaattcctcttttaatcagtcaagggagatgcttcaaagctggagctattttatttctgagatgttgatgtgaactgtacattagtacatactcagtactctccttcaattgctgaaccccagttgaccattttaccaagactttagatgctttcttgtgccctcaattttctttttaaaaatacttctacatgactgcttgacagcccaacagccactctcaatagagagctatgtcttacattctttcctctgctgctcaatagttttatatatctatgcatacatatatacacacatatgtatataaaattcataatgaatatatttgcctatattctccctacaagaatatttttgctccagaaagacatgttcttttctcaaattcagttaaaatggtttactttgttcaagttagtggtaggaaacattgcccggaattgaaagcaaatttattttattatcctattttctaccattatctatgttttcatggtgctattaattacaagtttagttctttttgtagatcatattaaaattgcaaacaaaatcatctttaatgggccagcattctcatggggtagagcagaatattcatttagcctgaaagctgcagttactataggttgctgtcagactatacccatggtgcctctgggcttgacaggtcaaaatggtccccatcagcctggagcagccctccagacctgggtggaattccagggttgagagactcccctgagccagaggccactaggtattcttgctcccagaggctgaagtcaccctgggaatcacagtggtctacctgcattcataattccaggatctgtgaagagcacatatgtgtcagggcacaattccctctcataaaaaccacacagcctggaaattggccctggcccttcaagatagccttctttagaatatgatttggctagaaagattcttaaatatgtggaatatgattattcttagctggaatattttctctacttcctgtctgcatgcccaaggcttctgaagcagccaatgtcgatgcaacaacatttgtaactttaggtaaactgggattatgttgtagtttaacattttgtaactgtgtgcttatagtttacaagtgagacccgatatgtcattatgcatacttatattatcttaagcatgtgtaatgctggatgtgtacagtacagtactgaacttgtaatttgaatctagtatgggtgttctgttttcagctgacttggacaacctgactggctttgcacaggtgttccctgagttgtttgcaggtttctgtgtgtggggtggggtatggggaggagaaccttcatggtggcccacctggcctggttgtccaagctgtgcctcgacacatcctcatccccagcatgggacacctcaagatgaataataattcacaaaatttctgtgaaatcaaatccagttttaagaggagccacttatcaaagagattttaacagtagtaagaaggcaaagaataaacatttgatattcagcaactgaaaaaaaaaaaaaa

SEQ ID NO: 3137 - DNA, 1096 bp, Homo sapiens
  misc_feature (1086)..(1086): n equals a,t,g, or c
  misc_feature (1093)..(1093): n equals a,t,g, or c
ggccagtgggcagggtcacagggcaaggtcccgcgggccgctgggtgcggcgacttccgtgctcccggcgagcgggcggagagcgggggccgcactggggagtgtgggctgggccgcagatgtcatgtggcctgtkttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgcctttaggagggatacctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagcccagactgttcactttggggcagggacgaacatgtgcctcgtgaatttgcttgaaaacagtcaccatcttctacccccatcactgtatagtgaaaaacctgattaaagtggtatctgagaaccawaaaaaaaaaaaaaaaaaaaaaaaaaaaaanggggggnccc

SEQ ID NO: 3138 - DNA, 2279 bp, Homo sapiens
ggtgggcaaggggctcagctcgcagcgcatgcccgcgcacaggttcgtgctggccgtgggcagcgccgtctttaatgccatgttcaacgggggmatggccacaacatccacggagattgagctgcccgacgtrgaacccgccgccttcctcgcactgctcaagtttctctactcggacgaggtgcagattggcccggagacggtgatgaccacgstatacaccgccaagaagtacgcggtgccagcgctcgaggcccattgcgtggagttcctgaagaagaacctgcgagccgacaacgccttcatgctgctcacgcaggcgcgactcttcgatgaaccgcagctggccagcctgtgcctggagaacatcgacaaaaacactgcagacgccatcaccgcggagggcttcaccgacattgacctggacacgctggtggctgtcctggagcgcgacacactgggcatccgtgaggtgcggctgttcaatgccgttgtccgctggtccgaggccgagtgtcagcggcagcagctgcaggtgacgccagagaacaggcggaaggttctgggcaaggccctgggcctcattcgcttcccgctcatgaccatcgaggagttcgctgcaggtcccgcacagtcgggcatcctggtggaccgcgaggtggtcagcctcttctgcacttcaccgtcaaccccaagccacgagtggagttcattgaccggccccgctgctgcctgcgtgggaaggagtgcagcatcaaccgcttccagcaggtggagagtcgctggggctacagsgggaccagtgaccgcatcaggttctcagtcaacaagcgcatcttcgtggtgggatttgggctgtatggatccatccacgggcccaccgactaccaagtgaacatccagattattcacaccgatagcaacaccgtcttgggccagaacgacacgggcttcagctgcgacggctcagccagcaccttccgcgtcatgttcaaggagccggtggaggtgctgcccaacgtcaactacacggcctgtgccacgctcaagggcccagactcccactacggcaccaaaggcctgcgcaaggtgacacacgagtcgcccaccacgggcgccaagacctgcttcaccttttgctacgcggccgggaacaacaatggcacatccgtggaggacggccagatccccgaggtcatcttctacacctaggctgcccgacaccgacaccgccctccctccgtggggatagccgcagccccaggccatcatctgctgctggggyccccccaccacgcggtgccaggcccagtgtcccccaggccgtctgtccactccatgccacctttctcagcatcaggacggggttgccctgtgttcaccacgagtktggctgctggatcagggcagccggggaggtggccaggccagtggccaggccctgtggagacaatccctcaggactagggacagggctgtgccggcctgggccagggcccacggacccgcagctcagggcgcctgcccacgtcgtctgccggcggtgcgccgcgggcgtccctcgcgtctcttcactgcacattgcaatgcatttgcgattcccatttctctgctaggagccagcctgggtggcgctgctcccagagccgtgggtcccagaccttgcgttccttttgttcctgtccgtttatcaggacacgggccccacctgtcacgtgcccgaggccacccaagcccagcctgcggggcgttcccactgcctggatgccggcttgagttctgcgcacgcaggattcagtgtggggacggcccctgccggataggcctagccctggcccaggtggtgagcggtttgcagtgtccgttctcatccacctgatgggcccagataaaggcccccgctgtccagcctccctggacggccctcgcggtccctgcagcccaagatgggactcagaccctgtgccccagagctcccctgccgcagaatggggccccagccggccccgaccgggtccaggagcactgctcgcctgtacatactgttgccctagcccacctggtgccgtgggagccacccccaggtgctggggcacagcccctccccactccggccacgcccccacccaccccgcgtgtttctgccctgtgactcctggaacctgcgtcctccccaaagccatgggaggggtgtcctcctcagaccatgcccccagatgatttttttaaataaagaaacaaatgcacctgcaaaacaaaaaaaaaaaaaaaaaactcga

SEQ ID NO: 3139 - DNA, 2009 bp, Homo sapiens
  misc_feature (1875)..(1875): n equals a,t,g, or c
  misc_feature (1984)..(1984): n equals a,t,g, or c
  misc_feature (1990)..(1990): n equals a,t,g, or c
ggtacccgcagagggcctggaagaggtgctcaccacgccagagactgtgctcacaggccacacggagaagatctgctccctgcgcttccacccactggcagccaatgtgctggcctcgtcctcctatgacctcactgttcgsatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggactcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaaggtgaggccaccctggcgcctcgtccccgatgggaccacaaggctgccctgccccctggtggccatgtgggcaagtacaggagcctgtgggtcgggggtcagagtcctgggctggggctgggcctggggctgtgcccagtgactggcaagaagagttgctgctggaattatttaggaattttgagagccattgtcatactcaaccattattaaaaatcatactgtaggccgggtacggtggcctggaatcccaacacttcggaaggctgaggcaggagaattgcttgagcccaggagttcaagaccagcctgggcaacatagcaagaccccatctctacaaaacaaacaaaaaattgcactagataaggttaaactatatgaacctacaatatgaacctaaaaataatattaaaaaccaaagtaataaacactcagtttatcacttctaattaatttatccaattttactattatttgtgctgaggtcacatgtttctgtgttggagtgcatggaggaaatgcaggatgatgtgctatttacatctcttcccaacaccacattcagggagtggaggtggcacgtagaagctgcccatggtgggagtttgtaaactgtggaaataggaaaacaccacaaatcagggctttccctccagagagcaggttgttcaacatgatcaacacgttactgtccagggacaggccctaggcatggtggtcctaagtgaggggtgccggcaccctggggagactacgtgcccagccatgagctctaggtcccagcggcagctccgactcccttgctcccccagggcctcgtcctcctgcctaagacggagtgcgacgtgcgggaagtggagctgatgcggtgcctgcggctgcgtcagtcctccctggagcctgtggccttccggctgccccgagtccgggtgagggtggggacctgggactcccatgcccaccgccttctcggtgcctaraggggagtttgggtcccgtctgacccagcttccaaacttccctacccattgttcatggggacacctacccccttctgctgagatgctgaaactcatggaagccccaggctggtgggagggtcccaggtcttgccctgtccctccccaacagatgcccgtgtgccctgggcacctggtcaatgtctcaggacagcccgtttctccctctgcagaaagagttcttccaggatgacgtgttcccagacacggctgtgatctgggagcctgtgctcantgccgargcctggctgcaaggcgctaatgggcagccctkgcttctcagcctgcagcctcctgacatgagcccaggtgcaccgagggactgggtgtggggaggaagcggnaatggnggttggagaaaaggggaca

SEQ ID NO: 3140 - DNA, 1006 bp, Homo sapiens
gctcgtggcgctggaccgcatggagtacgtgcgcaccttccgcaagcgcgaggacctgcgcggccgcctgttttgggtggcgctggacctgctggacctgctggacatgcaggccagcctgtgggagccgccgcgctccgggctgccgctgtgggccgagggcctcaccttcttctactgctacatgctgctgctggtgctgccgtgcgtggcgctcagcgaggtcagcatgcagggcgagcacatagcgccgcagaagatgatgctgtacccggtgctcagcctcgccaccgtcaatgtggtggccgtgctggcgcgcgccgccaacatggcgctgttccgggacagccgtgtctcggccatcttcgtcggcaaaaacgtggtggcgctcgccaccaaggcctgcaccttcctggagtaccgccgccaggtgcgcgacttcccgccgcctgcgctatcactggagctgcagccgccacccccgcagcgcaactcggtgccgccgccgccgccgctgcacggcccgcctgggcgcccccacatgtcctcgcccacgcgtgaccccctggacacgtgacagggcccgcgcggcccccgacacgcccctggggcgcagagacaccgggttggcttggggcgcgcggtttgcatgggatggggtgggggcgggctcccctagggacaggtgcctcgagtgcccgtgcctggggtcccgcggccgcttcttcatctcaggaatctctcggaccgcggatcctcagcccccgctccaccagcccgccccagsgcgtgggtctgtttgggaggcctgggccggagcagagcagaggtgatccggcccctgcctgctgggccgcccgggttggaagggagggcagtgtgggcggagatctgctccttcggtgggggcctctggctcagatttggggccaaggaggcctctgtcattttaaagactcgtgtttacagttttgtaaaaaaaaaaaaaaaaaaaaaaaaactcgag

SEQ ID NO: 3141 - DNA, 2760 bp, Homo sapiens
  misc_feature (2754)..(2755): n equals a,t,g, or c
  misc_feature (2760)..(2760): n equals a,t,g, or c
ttccgccttcccagcctgaaagcgcatgcgcagcctcggttccgttgcgtargytgtccctcagtgggacactgcagggtgcggggacaactacgaagatggcggttgcgcgcttggcagctgtggcggcctgggtaccttgtcggagctggggctgggcagccgtccccttcggtccccaccgtggcctcagcgtgctgcttgcacggatacctcagcgggcgccacggtggctcccagcttgtagacaaaagacgtcactctcattccttaatcgaccagaccttccaaacctggcttataagaagctaaaaggcaaaagtccaggaattatcttcatccctggctatctttcttatatgaatggtacaaaagcgttggcgattgaggagttttgcaaatctctaggtcacgcctgcataaggtttgattactcaggagttggaagttcagatggtaactcagaggaaagcacactggggaaatggagaaaagatgttctttctataattgatgacttagctgatgggccacagattcttgttggatctagccttggagggtggcttatgcttcatgctgcaattgcacgaccagagaaggtcgtggctcttattggtgtagctacagctgcagataccttagtgacaaagtttaatcagcttcctgttgagctaaaaaaggaagtagagatgaaaggtgtgtggagcatgccatcaaaatactctgaagaaggagtttataacgttcagtacagtttcattaaagaagctgaacatcactgcttgttacatagcccaattcctgtgaactgccccataagattgctccatggcatgaaggatgacattgtaccttggcatacatcaatgcaggttgccgatcgagtactcagcacagatgtggatgtcatcctccgaaaacacagtgatcaccgaatgagggaaaaagcagacattcaacttcttgtttacactattgatgacttaattgataagctctcaactatagttaactagtatcacatgtttagttggtatgtaaactaatgtatccagaagattggaagagggataagaaatgaaagatcctgatactttaggtttttccctttcctctattttgtaaatataagatgagtattatttaatgatgtatttgcataagtaatgcaaattgtgaagaaggaccagctgctgtttagaaaattttctccttccttctgtccttgattttttttcattaaagtatttcctttttttaattcaaraaaagtttacctttcttatgcttatgttagctatgccagctcttaattgcatccttttctaattaggattattaataaagcgtgaatattttgttttttattatagacagaaatttgtaacattacttctgatttgaaaatgcaattcacaaaatatagggaaatttttattgaagtaaatttgaaatgatggagaaatttcagaagcataataaagttcacaataaggataatactttatataatgtataaagtatatataatataatayatatgtkatataaactgcacattatattcaaacttaaaattgagctttttttttaaaggcccaaaattgtacagtgatacaaggagctatttctaaaatttggcttatgtataatatatttaaatggggaatttcatctaaaacaatgatgtagtatttttaatattctgattggtaaaattaaagaggaaattaatctttatatattatttcttgcagaaacattcattattttattaatattgccctaagtacaactaggcaagtgattgccacctaaatcagaagacgttctaaagtcagtaagaaagtgtgaaatgctagtataaaggttattttttttctttcctaaataactaaagtgaggtgtagattgagccttgatattatttagttaatgttttttattaattaattttggctggactttatttagcttgattaggttattatctgtcaaaccttttaagttgacaacatgactcatatatatacatgtgtataagatgagcatgtgtcgaarcttattcgactcattaatgaggaaaccagcagatagtaaacctggttcaaagtacaattcaagaaactgagtatttatgggcattgaagaaaaaatgttgagataaaattgctgtgcagaaaaaagtgttaatgaagccgacctgactacttaaccttagagacctgctttacaaggttggcccttgattggcatctgggaacttggagttcagggggcttccaccattcccagaactgatcaaagtagcttactatatctaaactgtaaaacaatatagtttctcctgaacacctgctttccttctgggagtctggaattttggtatgtgccaggcagagactacctttgtgaccagctcccagtaaaaaccccaggcactcagtctctaacaagcttttctggttgacagtgtttcacaagtgctgttacaactggttgctgggagaattaagctcatcctctgtgattccactggcggaggattcttggaagcttgcacttagtttcccctgacttcaccccatgtgtcttttttcctttgctgattttgttttgtatcctttcactgtaataaatcatggccgtgagcagaactgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaannggggn

SEQ ID NO: 3142 - DNA, 1310 bp, Homo sapiens
aattcggcacgaggcagcgtcgcgcggcccagttcccttttccggtcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaaaaaaaaaaaaaaaaaaaa

SEQ ID NO: 3143 - DNA, 2729 bp, Homo sapiens
ggcacgagctcaggtaaccttaattctaactacctactaaccatttggatgctggagggagtggataggcccagagcaggaaagtggaaaggggtaaaactaatatgtacaaaatcacttatagagtatgttttctttgccagcccttaatggtagggcttggctgtataggttctattgctattgttctactgttgttattattagttccacatgtttgtccgaagattctataatatttttgtttcccaagtagaaagcaataggttaaattttaaaagttgtttgttttttcatcttcaagttgtcttttcccattccccgcgttgcatgtgagaaagcagtctctcggagggcgcttacatggggactcctacaaggaatattgtgtttccactatcactttaccctcagcactgttgcaggaatagctgcacgtacatttcattctcatgcaagccatttatcatgttccccaccaatactgctgtttcctaactaggcttagacttacacaacccacagctcttagatctattatgtctattgtgttaaattaaacttttataatgtacatcagtttctgtcctaacacccagatatcaccattattttgttctttctgaaaacatataattattagatatgcagtttatacattttatcaaagactggttttatgtgcaattgttaaaatgattgctttctttcctagattagcaagtattatatgccactatataatacatgttcacatgtgcctatagatataggtgcacatgtatagacacatgtctatatcctattaagcctagagatatttttttgtgtgacccatttctccattttctattgttctccaggacaaaggcaagactcaaaaatagtatatgatttacctctactattgctctgtgcacaatcattgaaatatgtatgtataatttttggcatgaaaaagcaatctttcgaaaatgacaataagaaatgtctgttgatcccttgcactaatgaacaatagaaaatattaacagcacttgcagtactagttgattatggcattggctaactcggtttatgtggattctaatgaaacatttgggagaaatggaacaaaatatctccctgagcttaagtgatatactcaaaatgcctgcatgttgtaaggatttttcaaatgctgaaatatatttcattacagccaaacatcagcaggatccccagggtttggatcatttgaaaatactgtgttcgaaagggcaccttaataacattgtaaagctggaaggaaagaggggatatgaacaatagacactttttttaatctcggggaaaaaatccatctcacgttagacttgtttttatattggctttccctcttccctctttctctctcacacaataaaatgcctttgaaatgctgacacataaataatttcctacctaaacatctcagagcctgattccatcaaaaagaaaggagtaaaaagcaagttacagcccagcagcacatctgctttccctgggtccgggggctgccaggagggagcgggaggtctgtccacctcacaaggcaggctctgtcagcttttgtcactccctgatttcttattctttgttaccttttttcgcctgactgatttttacttggcatttaagttccccttagcactgccagattctaaaaggttatattctttttaaaaaagaagagaaagaaagaaggaaagaagacaaagaaagaataaaaacctccgagtgttaactactttttcctttcttcttttttttataaagaatacattctttcacatcttgaatttctgtgaattttagtttccattctttctcctttcaaaccagacacctaaattatacgtcgaagactgttaaaaagttgtttttttttttttaatggaaaatatccaagaagcagcccaggagtatctgacatggtggaatggaatcagttagaaagcgaagaaatcactaaaaaaagttacttctttttttccccaccagttataatcttcaaccttactagtttataacagtttaatgtcctatagaaggatcctccactaaagttataattttaagtatagtcatatagagagatccctaatcccctgggtaatctagatactaaaggtggggaagaacagtcatattgacattctttaatccaaaaccactgtttgaaattagtaaggatattttcagcattcccaaaaacatgttattagcacgttgagctgaaaacgtttttcttcctcagtgagtacagaaaccaaagcagtctgcgtgtatgtctatgtatagactgtatcgtacctgggctcatggagtagtctaaatttaaaacgtcctctcttctacctccaatgaaaatgtttccgtgtgtggcgtctgatcttccaccgtgtgtgtggtcgtctgctggtgtagcgctgtttaaggagcgctgtgtgctgctagtgttccacgatgtgtgtggtcgtctgctggtgtagtagcactgtttgaggagcactgtgcgccgctagtgtgggtttacacttatgagtgttgtcattacatgtgttctgctcttctctccctctcctgcccctgccctgctccatcagagagagctgcaggtctctgctgccgcctagtagttccctgtcacaaagggatgccaaggcttaccgatctgtctgtcaaaaccaaagatgtctgggaaatcc

SEQ ID NO: 3144 - DNA, 1373 bp, Homo sapiens
ggcacgagggctgacggcgcttttgtctccggtgagttttgtggcgggaagcttctgcgctggtgcttagtaaccgactttcctccggactcctgcacgacctgctcctacagccggcgatccactcccggctgttcccccggaggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaaaaacctgtctaactggatgctcattgcctgggcaaggcctgtttaggccggttgcggtggctcatgcctgtaatcctagcactttgggaggctgatgtgggtggatcacctgaggtcaggagttcagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggatagcagttgaagagtgtgtgggtgggctgttgggatgagatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaataaagtgggatatatatttaaaaaaaaaaaaaaaaaaa

SEQ ID NO: 3145 - DNA, 960 bp, Homo sapiens
ggcacgagcatttctgctcctgatctgccctgtcgatttctaaccatcagggctttttcatgttattactgatgcttgtgaacacgtctgctgtagcctgcactcacggaggcagagggccgtgggggaactctgcagcccaagcttgcgccgcgctcgccccgtggcccaggcaggacccttccgcggcctcccagtggcagccacaggtgctggttggtttgctgagctatcacgggtggggtgggcagcgtctgagtccttgcccgagaagcatctgctgtgtgtccacgaggcacctggagggggccagatccaaggcacagggccctgctgcatggctccacatggaagttcgagtcccccgtgtccagccgccggccctgcaggtgcccagcagctctgacaaagcggggcagggccgctggggtgtccctggacagcggggcctggtgggcaggggaggaggctgcaaggtgacacccagtttgccttgcagacgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcggtgagcccgcaggagtggggtcgtcctcgcgacccttgggcgggggctgggcagagtgtggggcgagtctccgtgggagcccaggacaggagtggagtccccgccatgcctccattcaccaggctgccctgtgtaacaaagaaacccctgagaaggaaggttctggagacctggcagggttcgtagggagctttccaatctgatttgttttggcgatttatacaaccaaactccaagcccagttccgaagctctgagccttccatggcctcaggctgggattcaggtgcctggaggtgggggatacccgcacccagccc

SEQ ID NO: 3146 - DNA, 1540 bp, Homo sapiens
ggcacgaggcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgag

SEQ ID NO: 3147 - DNA, 1094 bp, Homo sapiens
tcggcacgaggtcaatcaagtgaaatatcatgtaaactgtccagcagctttgaaagtagagaatgaacaaggccccttccccacccaccctgtggaaagcccgtctggtttggtgtcctcctggacagcgtcttgccggtcacctttggccatctcccggtgcgtggttcagatgtgggtcctgctttcctgccccctccctcctctgtgcctgcctgcctctgctgtgccgggccagtgccttggtggccagtggagtggacaccagctgcgactgcgtgggaggggctggcattgccgctgccactgcagggcttgggcggctgacatgggacgaggcttgcacagctgccagctcctgtctcgctgactttttttatacagttttgtctgggccaccgccttcagtgccacgggccccttgccgttcaggctgctcctcatagatgaacaaggccctgccccgtgtccttaccctttagagctgtttaaattcaaatgaactgaaactgaatatgaaaaatccaggccctcagccgcccaggccatgtttcaagtgctccatggccacatgtggctggtggacagtgcagctctagaacattccatcaccacagagggttctgctggacagtggccttgggggctgttttgagggtccgcctgtcagtctcctggcatcaaagtcattctgccattgtcaagttacagttattttccttttacctccaagccactatgtgcgtatgctgctatgtgtctgtatttcccgctaaacttcctgtcacggagggaagggtgccacaggcccagctcctggagggggtttggatgtctgggtggggggaagggtgccacaggcccagctcccggagggggtttggatgtctgggtgggggccagggcgccacagttccagctcccggagggggtttggatgtctgggcggggctttcttcatgttccatgtatgataacggtgactggggggtttacagagagaggcatacaaatagtgttggagtgttgttttcgctaatataaatgtttgaatagctaaaaaaaaaaaaaaaaaactcgagggggggcccggt

SEQ ID NO: 3148 - DNA, 2539 bp, Homo sapiens
  misc_feature (1283)..(1283): n equals a,t,g, or c
gggtgcaggagtgccacccccagggccctgtcaacctctcttttctcctccatggctgtctgcctgcgtatctgtctctgagaatcctcggggcggtcaggggatgtcaggaggggaaggagccgccctccctatcttgctgctcctcttggcactcaggggcaccttccatggagccagaccgggtggaggggcttctgggatttggtgtctgctgctgccagagcaggaacccccagtctaggacttgggcattttaacagggagaaagtagtggcttcccttttctctctctcctcctttttccctttaagcccacagattcaggtcatgccaaaagctctctggttgtaacctggagacatgtggaggggaatggcgatgggattataggactctccccatctcgggccctgaccctgacccttgccaccaacccaaagacagctggtgggtttccccttggagamaatcctgcgtttgcctgggccggccctggctgccctcagctttcgctgatctgcccggcctggagcctcccatcaccccgcttcttgttgggcctcaggcactggttaccagaagggggtctgggtctgctcaggaatcatgttttgtagcacctcctgttggaggggtggagggatgttcccctgagccaggctgagactagaaccccatcttccctgagccaggctgagactagaaccccatcttccccaccacgccacccctgtgstkgctacaggagcacagtagtgaaggcctgagctccaggtttgaaagacccaactggagcgtggggcgggcaggcaggggttagtgaaaggacacttccagggttaggacagagcatttagccttctggaagaacccctgcctggggtgggactgtgcaggccagagaaggtggcatgggcctgaacccacctggactgacttctgcactgaagccacagatggagggtaggctggtgggtgggggtggttcgttctctagccggggcagacacccagctggctgggtccttcctcagccttgcctcctcctgtccccaaccctttcctttcctcctgcttgcggactgctggtcccctctccttccctccttccagctgtttctagttaccacctacccctgggccgtggactgatcagaccagcattcaaaataaaagtttgttccaagttgacagtgtggtgctccctgcccagcccctccaggtggaggtgctgccacgggaacgcagttgctctgcctgccctgggcccctggcgacantgggagcagggcagtgctgtgaggagcccagctttcccagtcaggcaggcatggcttccgtgttcaggctccctcaccagctggtgacacgggacaagcttacaaaccttctctgaacctcagttttctcatttacaagaggcaaagcatccatcaccttgtgtggattcaragaatgtraggccctggggtgtcctacacaagggaaaggcttgctcagtgagcggtctgcacaccgttagccaccctgccacctctgtgccctgggcaggctccaaaggaaagctctggctgggactgccrggagtctcacacgctcctgttgacattcccagcagcygcccctgaggtcgatgtttgttctgtttttctttttcttttttgagacggagtctcgctgtgttgccaggctggagtgcagtggtgtgatctctgctcactgcaacctccgcctgccagtttcaagtgattctctgcctcagccttctgagtagctgggactacaggtgcacgccaccacgcccagctaactttttgtatttwagtagagacagggtttcgccatgtcggccagggtggtcttgatctcctgacctcatgatccacccgcctcagcctcccaaagtgctgggattacaggtatgagccaccgcaccgggcctgttctatttttctagttaagggaactgaagctcagaraggtgtcaccagcargtgttcattcccatgccagccttgccccccggcttttcccaggcaggctcctgcgtgcccactggctccagcctggtcctctgtctcttggctgcttcactcctgctctttgtcccgactctggccctgcttacaggggccactacctgctggtgcctccataacaagcgtctggcgttgagacccctggcatggcaggggctttggggtctggtttccacaaggcttagccatggcagaacctcgttttattttaactctttgcccctacaaacaaacagcagtacttgccagaaccattcttgggattcaggagctcgggcgactgccttggcctctggccgcacccaggagggtggggttggatctgtgtagttgccaggcccacacctgccagcagggggctgactggatccatgctttactgtgtttaatgggggtaacaggggtccctacagccctcccagytaaamatttggaacaaaacaccagcccttttgtagtggatgcagaataaaattgttaatccaatcaaaaaaaaa

SEQ ID NO: 3149 - DNA, 1500 bp, Homo sapiens
cccccgggctgcaggaattcggcacgagcgagtttttacttccttaataaaattggttttggtgctcactttggcagcacatatactaaaattggaactagacagagattggcattgcccccgagcaagaatgacacgcaaattcgtgaagccttcaataaaaaataaaataattttgttttcccaatctgtgtctcttttaagccccacaggatagaaatgtcctaaaataagaaattaaataagaggggaagccccatgatctgttctggtttttttgggtggtggtggtggtggtgttttttaatgggtctctcaggattccaccagacccacttcccagccgctgtgtggtctgggcctgagaacaccaagccccccgacccgcggcccacgcccacccaccacccagcctcggcagcgctttcccaggattcacatggtaatgaaggcatccatcttctcccagacacacactgggccctgcgaccctcccagggcccacacaatggcccacagcgccgcggccccaccacctgttggattttcccagggaagggagtgagggggtggaggggaagggcagtccgtctcttcccagcccccagccccatttgcaccctggtcgcaagagtcagtcagcgagggcacccatgtcctcggactctcagtccatcctcagcaccctgtttcctcatcctcaaactgcaaggtggttgggaggattctaatgggaatggtagtaaggacacgctcaggaactgtggattgccagacaaagagagcaaaaggctgggcttacaggcgtgagccacaacgtccggccaggctaattttttaatatttttgtagagacgggatctcactgtattgcccaggctggtctcaaactcctatcctcaagcagtcctccttcctcagcctcccagagtgctgggattgcaggcatgagaccccgcacagtctgtttctacagcggcctctctgcggcttcctctcttctggcctcatggagaaaccccagaaagagcatagactctggaattagagaaacagggtttggaattctgtgccattctctccctgtgtggtttggccaactgattcaaaggctgtttcctcatttgtaaaatggagatatatagtcagtggtccttgttattatctccctgctacctgcccccttcccaaacaccagccagtcttctctgctctggccaaattgataatagcttttgtttttcaagcctaaaaccagcttcttccagtttgctcagcagctatttgctaatcatccagagtgacctaggacgtatttacatgagcggaagagccactcggggagagtgctgctgggaatgcctccacagagatgctgattgtacgcatgctgcgtaagcctcagatttttctgttcaggcccaaatgcgcagcacaatctgtgggaaagttgcaacagagaaagcaaaaaaaaaaaaaaaaaactcgagggggggcccg

SEQ ID NO: 3150 - DNA, 352 bp, Homo sapiens
  misc_feature (1)..(1): n equals a,t,g, or c
  misc_feature (258)..(258): n equals a,t,g, or c
  misc_feature (277)..(277): n equals a,t,g, or c
  misc_feature (313)..(314): n equals a,t,g, or c
  misc_feature (334)..(334): n equals a,t,g, or c
ngtgaaatcattcttgagaatgaaatttatcatgcttttacttcttccttcaatcttcccaactactgttggaaatgaatctgagattttagatctacattattgttactttttaacattatgtatcttctgtttcaagaaggcttttgaatgtttgagttaagtttcataagcttttgaaacaagcatttgggacatttacacctgcttaactgatttgcattggatcacttttgtttcatttgccactgtgatatnccccattatttcaactgcntttgcacagttgttccttggtgacttgtttttaggnnctttttttgaagggaaccanatgggggtggattaccgg

SEQ ID NO: 3151 - DNA, 1698 bp, Homo sapiens
ggcacgagggtgaataactgtattggtcgccggaactaccgttattttttccttttcctcctttccctgacagcccacattatgggtgtgtttggctttggcctcctttatgtcctctaccacatagaggaactctcaggggtccgcacggctgtcacaatggcagtaatgtgtgtggctggcttattcttcatccctgtagctggcctcacgggatttcacgtggttctggtggccaggggacgcacaaccaatgaacaggttacgggtaaattccggggaggtgtgaaccccttcaccaatggctgctgtaacaatgtcagccgtgttctctgcagttctccagcacccaggtatttggggagaccaaagaaagagaagacaattgtaatcagacctcccttccttcgaccagaagtttcagatgggcagataactgtgaagatcatggataatggcatccagggagagctgaggagaacaaagtctaagggaagcctggagataacagagagccagtctgcagatgctgaacctccacctcctcctaagccagacctgagccgttacacagggttgcgaacacacctcggcctggctactaatgaggatagtagcttattggccaaggacagccccccgacacctaccatgtacaagtatcggccgggttacagtagcagcagtacgtcagctgccatgccgcattcctccagcgccaaggtactgagtactctaagaggtggggtaataacatgccaactggccaggcacagtggctcattcctgtaatcccagcactttgggagcccaaggtgggtggatcacaaggtcaagagattgagaccgtcctggccaacatggtgaaaccccgtctctactaaaaatacaaaaattaggccaggcgtggtggctcacgcctgtaatcccagcactttgggaggccgagactggtggatcacaaggtcaggagttcgagaccagcctggctaatgtggtgaaaccccatctctactaaaaatacaaaaattgccgggcacagtggctcacgcctgtaatcccagcactttgggaggctgaggcaggtgaatcacgaggtcaggagattgagaccatcctggctaacatggtgaaaccccgtctctactaaaaatacaaaaaaattagccaggcatggtggcaggtgcctgtagtcccagctactcgggaggctgagccaggagaatggcgtgaacccaggaagcggagcttgcagttagccgagatcatgccactgcactccagcctgggcagcagagcgagaccgcatctcaaaaaaaaaataaataaataaatacaaaaattatctgggcgtggtgggggggcacctgtaatcccagctattcgggaggctgaggcaggagaatcacttgaatctgggaggtggaggtggcagtgagtcgagattgcgccactgcactccagtctgggtgacagagtgagagtccatctcaaaaaaaaaaaaaaaaaattagctggtagtggtatgcatctgtagtcccagctacttggcaggctgaggcaaggagaatcgcttgaacctgggaggagaattgcttgaacctgggaggtggaggctgcagtgagctgagctcccactgctgtattccagtctggtgacagagtgagactacacctcaaaaaaaaaaaaaaaaaaaa

SEQ ID NO: 3152 - DNA, 2999 bp, Homo sapiens
  misc_feature (1)..(1): n equals a,t,g, or c
ngagggcaacggggcggcgcgggcggccgggcgcagggtcgcgggaggtgacgcgcggcgaggatggcggcgcggggccgggggctgctgctgctgacgctgtcggtgctgttggcggcgggcccctccgccgctgcggccaagctcaacatccccaaagtgctgctgcccttcacgcgggccacgcgcgttaacttcacgctggaggcctcggagggctgctaccgctggttgtccacccggccggaggtggccagcatcgagccgctgggcctggacgagcagcagtgctcccagaaggcagtggtgcaggcccgcctgacccagcctgcccgcctcaccagcatcatcttcgcagaggacatcaccacaggccaggtcctgcgctgtgatgccattgtggacctcatccatgacatccagatcgtctccaccacccgcgagctctacctggaggactcccccctggagctgaagatccaggccctggactccgaagggaacaccttcagcactctggctggactggtcttcgagtggacgattgtgaaggactccgaggcggacaggttctcagactcccacaatgcgctgcgaatcctcactttcttggagtctacgtacatccctccttcttacatctcagagatggagaaggctgccaagcaaggggacaccatcctggtgtctgggatgaagaccgggagctccaagctcaaggctcgcatccaggaggctgtctacaagaatgtacgccctgcagaagtcaggctgctgattttggaaaacatccttctgaacccggcctatgacgtctacctgatggtgggaacctccattcactacaaggtgcagaagatcaggcaagggaaaattacagaactctccatgccttccgatcagtacgagttgcagcttcagaacagcatcccgggccccgaaggagacccaacccggccggtggctgtcttggcccaggacacgtcgatggtcactgcactgcagctgggacagagcagcctcgtccttggccacaggagtattcgcatgcaaggtgcttctaggttacccaacagcactatctacgtggtcgaacctggatacctagggttcactgttcaccctggtgacaggtgggtgctggagaccggccgcctgtatgaaatcaccatcgaagtttttgacaagttcagcaacaaggtctatgtatctgacaacatccgaattgaaactgtgcttcctgctgagttcttcgaggtgctctcgtcctcccagaatgggtcataccatcgcatcagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgacttggctgtcgaggtggagaaccagggtgtgttccagccactcccagggaggctgccgccaggctctgagcactgcagcggcgtccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgtgcctgtctacaccagcccccagctggacatgtcctgtccgctgctgcagcagaacaagcaggtggtcccagtgtccagccaccgcaaccccctgctggacctggctgcttacgaccaggagggccgccggttcgacaacttcagctctctgagcatccagtgggagtccaccaggccagtgttggccagcatcgagcctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtaagcttgggccatcggtccccactgttggttttcattccttatctgggctgttgtgtggttaattgattgatcattttgaaagctagcacttgactcac

SEQ ID NO: 3153 - DNA, 943 bp, Homo sapiens
cctaaatgcaaacattttcatttaaatgtcaagcccatgtttgtttttatcattaacagaaaatatattcatgtcattcttaattgcaggttttggcttgttcattataatgttcataaacacctttgattcaactgttagaaatgtgggctaaacacaaatttctataatatttttgtagttaaaaattagaaggactactaacctccagttatatcatggattgtctggcaacgttttttaaaagatttagaaactggtactttcccccaggtaacgattttctgttcaggcaacttcagtttaaaattaatacttttatttgactcttaaagggaaactgaaaggctatgaagctgaatttttttaatgaaatatttttaacagttagcagggtaaataacatctgacagctaatgagatattttttccatacaagataaaaagatttaaccaaaaaatttcatatttgaaatggaagtcccaaaacctaggtccaagttcaatagcttagccacataatacggttgtgcgagcagagaatctacctttccacttctaagcctgtttttccccccataaaaatggggataatactttacaaggttgttgtgaggcttagatgagatagagatttattccataagataatcaagtgctacattaatgttatagttagattaatccaagaactagtcaccctactttattagagaagagaaaagctaatgatttgatttgcagaatatttaaggtttggatttctatgcagtttttctaaataaccatcacttacaaatatgtaaccaaacgtaattgttagtatatttaatgtaaacttgttttaacaactcttctcaacattttgtccaggttattcactgtaaccaaataaatctcatgagtctttagttgatttaaaataaaaaaaaaaaaaaaaaaa

SEQ ID NO: 3154 - DNA, 309 bp, Homo sapiens
  misc_feature (301)..(301): n equals a,t,g, or c
  misc_feature (305)..(305): n equals a,t,g, or c
gaattccccgggataaatttcatttcccaaagatgagtaggtatgaaaaataatactcagaagagattgttcttgtggggagaactgcttctacaggatctagctttgattttgtatctttcaatctttttaaaatcaactttaacgaatttaaacctattttaagtgtacaagtaataagtttgacaattgtatgtgacttctaccacaataaaatatagaacatttttatcattctataaaaaaaaaaaaaaaaaaactcgagggggggcccggtacccaattcgccctatagtgagtngtancgtc

SEQ ID NO: 3155 - DNA, 3191 bp, Homo sapiens
  misc_feature (4)..(5): n equals a,t,g, or c
  misc_feature (10)..(10): n equals a,t,g, or c
  misc_feature (32)..(32): n equals a,t,g, or c
  misc_feature (3179)..(3179): n equals a,t,g, or c
  misc_feature (3186)..(3186): n equals a,t,g, or c
gggnntcatntggtaaaggccaagctggtacntctgcaggtaccggtccggaattcccgggtcgacccacgcgtccggcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggscaggcagttgctyartgggcccctyctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgytccctgaccctgaacctgttcgcaacctgcagctggcccccacccagggtgcagtgtttgkaggcttctyaggaggtgtctgragggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccctaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtcttycctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggcttaaaaaaaaaaaaaaaaaaaaaaaaaaaaaaaaaaaaaaaaaaaaaaaaaaaaaaaaaaaaaaaaaagnggggggnccccc

SEQ ID NO: 3156 - DNA, 1220 bp, Homo sapiens
  misc_feature (1197)..(1197): n equals a,t,g, or c
  misc_feature (1208)..(1209): n equals a,t,g, or c
ccacgcgtccgcaaataggtacctaaggcatgtgattttatttttaaataacaaaaaataacccaagtttcttgcttctccaaagtattcttctcatagcttataaaagaaagtccacattgaatagcatggtctgggaacattccttctttattgtgtttatttgaacatgatatgagtttccaagatgaaatgatcaaaaaagataagtaccacaagaaagtttttttgtttggttggtttttttgtttgtttgtttttttcttgagactgagtctctccctgttgcccaagttggagtgcaatcttggctcactgcagcctccacctccccggttccagcgattctcctgcctcagcctcttgaatagctgggattacaggcgcccgccaccacacctggctaatttttgtgttgttagtagaggcggggtttcatcatgttggccaggctggtctcgaactcctgatctcatgatccgtctgcctcggcctcccagagtgctgggattacaggcatgagccactgcgcccggccaagaaagtatgtttttagaggtgtgtgtaagtgcatttgtattacctatgaacaaaattacctgactcttgtcccaggaaagctgtttcgcattttcgctttttgattggtattatccagttctatgtagttcatattattgttctgtctgactctcagaaattacttcttcacgccagtgtcttgttgcatgactttgatgtcacctataggaatacacctcactgcacgtaagtgggtatcttactgtataaaaggtctacatggctttaggttttaggacaaatgtgtagatttatagaccatttctgttggccaggacacagattttgagagctgtgtgtatatatatataatcatgtttgtatttttttcctgaaagttatcaattgcttttgtttaaaacagtttgttttagaggtggggtggggatgtatataacgaggaaaagttatatgtactttaaagtatgtcaagttcttactagtttcctgtactgaaggttcaattttttttatataagtttacttttcacctgctctattctttgtggggaaaaaatgcatctagaaaaacatagtttaaatactgtatataagataatgaaagttagtaatgtccattatttaataaagtttgtaaagtacaaggtaaaaaanaaaaaaaaaannaaaaaaaaagg

SEQ ID NO: 3157 - DNA, 1647 bp, Homo sapiens
  misc_feature (1061)..(1061): n equals a,t,g, or c
  misc_feature (1621)..(1622): n equals a,t,g, or c
  misc_feature (1639)..(1639): n equals a,t,g, or c
  misc_feature (1644)..(1644): n equals a,t,g, or c
acccacgcgtccggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcacagtagtggtgtttgttgcaacatttatttccacaaatgaatttatgaacaacagtgatatttgacttaaagtatgaagtttcagaatcaaaataatttcattttaatacgttcngttaattgtgaatctcttcmatggtaattagcaacactgttcccaggatgcaaagttgggaaacacttatttccaacttatttttttccaagtaaaatattatctctcttcaacatgctttaacttttcagactcacacagatacgtwacagctccttctccctccatatcaatacactaagataaaagaatactgtattttcagcactgagcagcagtgccaaaatctcctgccaagaaatggactgtgtggcattattaattaaatcacccacattgggatgacttccacttttgtaactagagttatctttatgtggtcagagctggacataggcagcatagtcacacagaacatcttatctctgttgctgaattgaatagcatgggatgtgtgcagaggaacatggtgggagtatgtaggttttgtagtcagacagacctgaactcaaatcttgctcattttttagagcacaggatttggactccaaattgagggttttaatccccatgccaccattcagcatcttcgactagttattgaaccttttcctcatggnnaaaagattatagtgtgnagcgngaa

SEQ ID NO: 3158 - DNA, 4023 bp, Homo sapiens
  misc_feature (1049)..(1049): n equals a,t,g, or c
  misc_feature (2758)..(2758): n equals a,t,g, or c
cccacgcgtccgtccaaacatcaggaggcaggcagcatggtaaatgagaaagaagccaggactgggagtccaaagtcctggcttctatgtctggctttgctactaatcaaatatgtgactttttgcaaaccatacctcactaaaccttactttcttcatttgagcgtgttggaccagctgtccccaggaacccccttggattgatctgagaaggcaaggataagtttttcaaaggaagaaaagaggagtagtcagtccgcagtacagtagacacaagccccaggacatctgagtgtctttcagcaagaactctctgtgatatttcactacaatttctctggcaccttgggactctcctcagcccttgtggtggtgggtcttgtttaactagcagttccctccattctatgcctgtgaagaatctatcacctaccatgtgattacagtgcagatttttttttccttttccttttctttttctttctttttttttttttttttgtttgagacggagtctcgctttgtcacccaggctgcagcgcagtggcgcgatctcggctcactgcaagctccgcctcccgggttcaccgccattctcctgcctcagcctcccgagtagctgggactataggcgcccgccaccgtgcctggctaattttttctatttttagtagagacagggtttcaccgtgttagccaggatggtctccatctcctgacgtggtgatccgcccgcctcgggctcccaaagtgctgggattacgggcgtgagccactgcgcccggcctacagtgcggatattttatgagagaggagatcacaactcagtccccaagccctcaacccttaatacatactatcgtatgaaatgcctctttccaaattcagccttttctaaaactcaagatgagaaaactgctgatgaggctcactttctaaaataccggaatttgcaatatagggagaatagtttttcatgtttctttgtttaagcaatagaaagaaaggaaacttatgtcgtttacttttcaggccatagaggttttcanaacaacttgaaaacatgatcaaattagccaaacttctgatagttttcaatgtagtctgtgatcatgggataatttagcctcagttctttttctgaaattgtgttttgaatgtttgatttgacttatttaccatcaaacttgctataaggttattactctaatgaataagcatattcccttaattgggacaatttactattatttctttcataaagtagggcaccattcaccatctatttcctggctctttagttatcaaaatgttaagctcattgctattcatcccggcacagcacttatatgagaggcatgaagctggctgaattctgcatcattaggaatgacacagcctcatcacattgacaccagtgcttgtctctcacaccaatccaaattaagaccaactgaaaatagtcagagtttcctctggagctcctttttgaagagacatatgttttttagtctggtggtacccaaaattgaacaaaaaatgggtgctgcttctcttaataggcaaaactatgctgcaggataatgtattcatgcagggtcttccagccagaccccaaatcatccctcccttcactagaatttttctgtttaattcgatggccactctccacagggatccattctgtgtcttattacaggagatgctcaatgaatgagggacttatcttctagaaatgcagctccgaggtagtctgttgagtgaaataatgaatccattatcacaaaataaattgaaagctgtctgacatttggacaatttttattttgtttcacattgttctgaaaactatactgtttcttttctccctattatttaaataagcaaatgatgaacagattacaaaattgaggacactcgaggtagggaaggagcccctcgacaggaggatcaggacatagtaccaagggcaagagaaacgattcaataaacactatttactatatattttaggcatggttctaggtaatcacatgataagtagttgaaagaactgaaaatgttttatctgcaagaaaagggcaagtgtaatatcttcaaattttagaaagaatgtaaattagaatttgacttaatttggtgtagttcttgtgggcagaaattgaattgaataggctgaaagttataagaaggattttagctcagtattgatactggattgctcatgggtggtgagagttactcatcactggaagagttcaagcaggggccataagaaatctcagggattttataaggtgattcatgctctgggaaaaggatgccttggattattgtgtcagggtacttctaactctaggattctggtttctaagatctggactctagtcttgccactcacctgccatcaagaacatgttcctcatctgcaggacaggaccaagatggctctgtctaccttaccgggttgctgtgaggcgtgattgtgataaaatacataaaggcagtttttaagctctgaagcactagttaaatgtgtagcgtattttaagattctgttgtatgtacaattgtttagcagtctctctctctttctttctctttcttttatcagagatagatgattttccctcttatttccaccagtttggcttttcagggaaggtggcagctggcagaatcccctgacaacaaaaggtacagcaaaaaagtggaggcctaaagaaaacatgtgctagctctttagcccctgaatagntaagtcacatgtcagcctgctctccttcatctgtttgggaggaggcagattagagtcacactgtcatcatgctctttcccctcagaagcagctgtaaggtttttggtagctgtcagtgctagcaaacagtgcttttctcacagaactactggaaagagtcctggctcggaaaacttgctcttgaaagtggcacggccagagcaggggtctctagagggtcgtgccacctctacctgccacaggttccattgtcggtcaggtaagttagaggcagcagttccccacctgccctctggataacagcagcctggggctgctcctgagtcatgtttccacttctgtcttacaggcctcattttcctacccatctttctgtaaaaatgaaagtcaggagtcttatgaaacttaccattattcaatacaggcttttggtttttttctttaaattagatagggttaggtaagaagtagagttctatagaacgttcataggaagcaacaaaagttgatctcttggtctctacaataggagaggattgggctagataccttcaaagctgacttgccctaatattctagtatgaaatgattcgaaggtacacctgcccctatcatgtcaggcagtgagtacagttaaaacattgggaattggtaaaggaaagaaaaaaactgaaaagaaccctttgaagttagacaaactgtccagagacatagtgctaaaatcctccytctttttcttyccacagcttctagaattcctctccagagctactctcaagttatatccaggggacaggcccctttggctccaacccacacgcctgaactttaaggatcattggactatcttctctgtggccarcgcagctctcttctgtgttcacagaatggccatgataggcatgctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttaaaaaaaaaaaaaaaa

SEQ ID NO: 3159 - DNA, 230 bp, Homo sapiens
  misc_feature (26)..(26): n equals a,t,g, or c
  misc_feature (219)..(219): n equals a,t,g, or c
gctgctatggctgaacttttattgancgtgttgtctgtgcagagcgctgtgcacgaggtggaagcaaacgagggaggaaaacaaagccacacccctgcccacagaggatggaacagaagggccgctgaggtcaggaaggcaaggttgccactaggtgttactgtggggcccagatgccgccatgctgttcacccttcaaagggtggcatctcagcccangcagtcctcct

SEQ ID NO: 3160 - DNA, 410 bp, Homo sapiens
ggcacgagccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggaaagtcgtgacaagtgctacctaatccagaaactaacagaagcccaaagggacatgaggaactaactagactgagcgtgaagatggtgctgcctgttgcttctaagctgacctagtgattctgctgagcctacagagtctacctgggttttgagtggacatttaaaaatatatttttcttgagtttaggcttttaaaaaaaaaaaaaaaaaaaaaaaaaaaaaaaaaaaaaaaaaaaaaaaaaaaaa

SEQ ID NO: 3161 - DNA, 925 bp, Homo sapiens
cggcagtggtggcggcggcggcggcggcccgcgccgcagagaataactcaagtcacctgtactggaaatcagtttgctgaaattaatcaacgattcttgaagttgaagaaaaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtactgcccacgctggccgtggtcgtgctcttgatcgtggtgtttgtgtacgtggccacgcgccccaccatcaccgagtgagccccgcagccggccgcggaccccatcggcagggagaggaggcgcgggagggggacgcaaacaaaaaatggctttcatattcagagatgttcatgttgctgagctgtaagcaggagcaccctgtcttctctggtctttgacttgattaaagtatctccgctttcttgggagggaataggggatgttttatcagtgaatgtgccatacaccttatggtccacttcatgtgcctttcagacttcaaarcgcgcgcgcatgtgtgtgtgtgtgtgtgtgtgtgtgtgtgtgtgcttctttttctctcctaaaaatcgataagtagctccacctgaagagggatggaacctctgggtcaggaaacagctggaatccacactcacctcattcccattgtttggatcatgcctctttccaacacgtgttcacaatctccaaagggactgtatttcttctctgtgcttaatgtgatttgaaatatgttgaatcaaagtgaaatatttattttttgaataaaggagataatagccttaaaaaaaaaaaaaaaaaactcga

SEQ ID NO: 3162 - DNA, 800 bp, Homo sapiens
tttttttttttttttttttttacgttttacagtctttaattaagcacataaaactgtactatttaatatatttctccatgaactttttgtgaaattcagatcgcagtgtgtcatttacaaatcttttgtctttcttctggtcatctacaccttttgcacagttcttgaagacaacgtcatcatcccaccttcttttaactttgaagttggcctgaggctgggatgggccagtgagattaaggagagggtttccgctcagaatgttttccatacgaatcctctcttcttcagctttttgttcttgttccttcctggcctgctcttcagctctttcttttttaattttttccagttctgcaagaagagctgcagtatcatcatcatcactttcttcttcaaaatcttcatcttcctcatctgttagagggtcatctgcatcaaggttggcggcaggaatctggtctaaccgtggcttttttgacactgaagaggaggttgtatgttctcgggttggacgatccctatttttctctcttgcagcagctctctctctttcttccaactctctcctgaagtcacggttacgaacctcttcaggggcatcctgagtagtctgtctgtattttatctttgtatgagagggtaggtctctgcttgaatactgctttgaaagttggctcaaatcaccttctccttttccccttccacctctggcaggttcaaaggttggcctggctgctgttgtcatcttttatgactggccgaggtccgatgcagcaggctccgaagatcctcgtgcc

SEQ ID NO: 3163 - DNA, 5230 bp, Homo sapiens
tatgatacgccagctcgaaattaaccctcactaaagggaacaaaagctggagctccaccgcggtggcggccgctctagaactagtggatcccccgggctgcaggaattcggcacgagaaaaaaaaaaaaaaaaagctaaaaaaccttgactaaatctaccatgttttctcatattattaaaaattctaaacgtgggtttttttgttttgttttgtttttctgtttctccctctgcagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacaggtaagatctcttatctctcccttaaatgctctcctgatgaatcataaggttgttttactcagataatcactgtcaaattgctgatccagtacagtccaaaaaagattaatcagattattctgctgtttttatatacgttaaaattggcatgaagaaagtgtaaatttcaaaattatttaaatgctttcaattttctgtgatctatttctcctctaaatacaaatatttgttttgcaacctgacactttggggctctaagttttgctatgttaattaatggttaaatagtctcataggagagtaacctggattttaagaaactcctttgcagaagattaatatggccaaaagctgcccctttgctttgatagctgaaagttgatggaccatgtaattgtgattccatccccattcaaagtggaaatagatcctttctgcataaagcactctactgtcccaggcccactgatttgtagtcataaagaagtaaagttgactaaaccgatttcttttttttggtttatatttcaagcccatatccttgaaaacattgccatattttgagatcattaactagatgaataggaagtttagaatatgaatcttgttttatttccagaaaggcaacatttttaatgtaaaaatatttcctatagcttatatagtttatttaccagttattacccattaatgttcagcaaattagtacataatcttagtactgtcaattctgttcttaggatatttgtttctttgtcaaagggatattgtccatgtcatgaaatattgacaatatgataaaaatgtttgctaaattagaaaaggtgatgaatttggaggaaggggaattggctgcacctgtttctgatatgttcagaagcttaatgaatataatattctaatttaaataaactgtttgattgagaaaagaggtagccacattattgtttagaaatgatagactgttattgacttttggtgtagctgggaagctggagaagaggtagtatgtagtttgcttttgatttcaaaatgccacctcttctgattccagatacaattatcttttggcacatttcctaattagcattaggttcttataaatgaaattttattttacacacagtttttaatggaacttacttttgaacatcacgaaagttatctctagcccttttcatgccttaggtgctgataagcattccgtttatcataagctatgtcattagtctcagcttcctagtgggaagtaaaactcatagcaattctctcagtcatccatgatatatagctaggtggggccagatgatttgaaaattaacatattgttcattttaggtgctttgttttcattttaagttgtttctgcatctagtttgaagctgcttggcataaagatgagcctttctgatagaagtgtgtgagaacatacattgtagagttgcttgatggcatgcactttatcctcattgccactttatcttagtacctcattttgttcctggcattacctgtttcccatcctcttccccctttcctactaggattaaggtcagtaattgataggaagagtatccatacttctattctaataaactgtgtcttttgtagtttgatggtatccatgtggtgagtggatctcttgatacatcaatccgcgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtaagtcttactcacctttcgttttgttcattaaaaatgagatcattattcaagagaaatatggagccttagcatcacaaaaagagtcaacctcatacagaatggttacttcagaaaagtttatgaatattttcaccctgacttacagaactagtctactcttgaggaaatgttttaaactgtgtttttaatatgtaatataaaattgtttaatcacttcctgcatgttcaattgactctacttaacctttaagaacagtgagaagaaagatcttggctatatcatagaagcaacgtactcattatattttttgattgaccattgcattttgaatttgtagtccaattttaaagggctaccttattgaaaaaaacaacagcatccttgatagaaaatttatttggcctccacttagtcacgtgcttaactggaatggagaggaataatagtgcctactaaagtagagaaagaaacaagtgaaaatcactaatattagatgaggtacagcagtgcctcatgattaactttttctatttgttatagcccttagaaagtgtttttttcagtggggccatctgataggcaacattgcagctttttactcattggttttgtctctcctcagagttttggaatagtgactgttcagctttgagtggttcatggtggtggggtaatagatctcttagtgctcatttgtccatcagcagaaggtatgaagttgcactatctacatcctcaccaaggaatgctgtcgttcacacagccagaaaataagatgtttgtctggtagctaaccaagcttcttggaagacagacgctcttgaaagttaatgtttcagttacaaatcactaccagattttcttacatccatgctgatcctaaaatactgaggacatgggtttctaaatatgtatcatttcaaatgttgcatttattgtatgttctaaagtagaagtctacaaattataatgtaactaactcatagccattatttctaaccagtaattaaattcttttggtttttgtctaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaaraaaaraaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgttaamaaaaaaaaaaaaaaaa

SEQ ID NO: 3164 - DNA, 528 bp, Homo sapiens
ggcacgagggctctttcatgcatgcctagagtcctgcatgaaagagcccccctggtgatgcccttggatgctgccaagtccatggtagttttcaattttgccatacttttgttcttcctaccggaccctggaatgtctttggatattgctaaaatctatttctgcagctgaggttttatccactggacacatttgtgtgtgagaactaggtcttgttgaggttagcgtaacctggtatatgcaactaccatcctctgggccaactgtggaagctgctgcacttgtgaagaatcctgagctttgattcctcttcagtctacgcatttctctcttcccctccctcaccccctttttcttataaaactaggttctttatacagataaggtcagtagagttccagaataaaagatatgacttttctgagttatttatgtacttaaaatatgttgtcacagtatttgttcccaaatatattaaaggtaaccaaaaaaaaaaaaaaaaaaaaaaaaaaaaaaaaaaaaaaaaaa

SEQ ID NO: 3165 - DNA, 1463 bp, Homo sapiens
ccccgggctgcaggaattcggcacgagccagggctgaggtaggagggagtctgtccctcgacgcctcctgcgacgccagcccctgagcgatgatgcgaacgtgcgtcttactctccgcggtgctctggtgcctcacaggagtccaatgcccgcgttttaccttattcaataagaagggcttcatttatggcaagacaggacagccagacaaaatatatgtagagttacatcaaaatagtccagtccttatctgtatggattttaagctttctaaaaaagaaatagtggaccccacctacttatggattgggcctaatgaaaagacgttaacaggaaataatagaataaatataactgaaactggacagctgatggtgaaagattttttggagcctttgtctggactttacacatgtactctttcttataagactgttaaagcagaaactcaagaagaaaaaacagtcaaaaagagatatgactttatggtctttgcctatcgggaacctgattattcatatcagatggctgtacgttttaccacaaggtcttgtatagggagatacaatgatgtattctttagagtgctgaagaaaatcttggatattctaatttctgatttgtcatgccatgtcatagagccatcatataaatgccattctgttgaaattccagaacatggcctcatacatgagctatttatagcatttcaagttaatccttttgcgccggggtggaaaggtgcttgcaatggatctgttgactgtgaagataccactaatcataatatcctccaggcaagagatcgaatagaagacttttttcggagccaagcatatattttctaccataactttaataaaactctaccagcaatgcattttgtggaccacagtttgcaagtagtacgtctggatagctgtcgaccaggctttggaaaaaatgaacgtctacacagtaattgtgctagctgttgtgtggtttgtagtcctgcgacttttagtcctgatgttaatgtaacttgtcagacctgcgtttccgtccttacctatggagctaaatcttgcccacaaacttcaaacaaaaatcagcaatatgaagattagaggtgaaagcattgttacttacttgtggaagtcggggacataagatgatcttcacatcccagagcatcatagatagttccattaagtaaaatcagtaagaccaaaccactggaaacctgcattttggaaactttaaaataaatggttaacatggcatttctaagaaggcatttaatccagtatctctagtgtacaaaggaaacttgaagttttcatggattatttttaatgaaatgttttattgtttacaaacggtatgttgctgtgtacctaagagtatagtaaggtcaagaagagtatcaaagtataataaaataaaaattgtatactctccaaaaaaaaaaaaaaaaaaaaaaa

SEQ ID NO: 3166 - DNA, 543 bp, Homo sapiens
  misc_feature (367)..(367): n equals a,t,g, or c
  misc_feature (376)..(376): n equals a,t,g, or c
ggcacgagaaaatattgactcctatctggccttcatcaactgacctcgaaaagcctcatgagatgctttttcttaatgtgattttgttcagcctcactgtttttaccttaatttcaactgcccacacacttgaccgtgcagtcaggagtgactggcttctccttgtcctcatttatgcatgtttggaggagctgattcctgaactcatatttaatctctactgccagggaaatgctacattatttttctaattggaagtataattagagtgatgttggtagggtagaaaaagagggagtcacttgatgctttcaggttaatcagagctatgggtgctacaggcttgtctttctaagtgacatattcntatctaatnctcagatcaggttttgaaagctttgggggtctttttagattttaatccctactttctttatggtacaaatatgtacaaaagaaaaaggtcttatattcttttacacaaatttataaataaattttgaactccttctgtttaaaaaaaaaaaaaaaaaaaaaaaaaaa

SEQ ID NO: 3167 - DNA, 1608 bp, Homo sapiens
gctttggggcccaggcataagtcccttcctccaggacctttcctatttatatgtccctatacaaaatccatctgcttttatacgtagctgttttatcatctgtagcttcatcctatccggaggcacagcacatgagccctggacaggtcccaaagttccaagcagtcctttccgtaaaagcaggggtttgcatgtgctaccaacacatgatacggggaagacccacccagggagcggtttcagtggcgcaacaaagcaccacttttactgttgcctacttctgaccaagaagaaaaaggaccttagtatttagcataaaattccagcgctggatgaatgcagatctagtttggtctgtggctagtttaaatatgtttctaaccacagagratttcatatatatatacatatatatatacacatacatatatatatatatatatgtatgtataaaatttcacagggatatgcttttttttttaaagactgaatgtgttcacsatttagcctgtagatttatttccattttccaaattccagcacacagagatcccagcccctatgagtagggtgtttgtggactacctaatggaatatttttgaggcctggatgaactttgccatatgggtagaggttacagagggaggtgatattttcagctaaaaaaaaaaacgggtggagtttggactgatcaacttgagatttaaaaactgctattccttttgttctytctagcatcyctccccaccctctgagagctcctcaggcttagatagtgaagtgatcaaatgccagtgtcattttgtacttaagttccaaagtaggaacattttatacttttttctgtattgtaataggtagttttgtatgaaatcttttctcctctcccgttgtaccgcattctttccagcattgtgctttttccctgggcttatttgaaaattttactgttttatacaagctcgtttmsyacwttkttctatgttytaccacaagttacaatttgaaaagaaaactattttttttaaatattccattgttaactgaatgttactgtttccactccagcaactacatgtcctcccttcaactgcctgccttttggggaaagaccaccttttgtgtgtttgttttttctctctctttctttccctttctctttctatctctctttatttttctttctttttctttgtttttgagttttctataggaaataaatagctttctatatatgagttgctggggaccttcacattctcttttagaaagctgtggcatgcagtctcattgcaggactcctggaatattgtctggttcttggtatttactgtatgtaagcaacaacttgaaaggtggcaatatggtgtcgatttggactatgaatcaaaagacctttttcaggttctttcactattgtctgggggactcagaacaagattgttctctgtatttattgtttgtccatttaggtaacatctgtcttaccttcctcayagactttgtacagaccaaagcaacaaatatttattgccatgtatagcagaaaatgaaacatgcaacaaaagcactttgaaaaatawawaaggaattgttgagcctgtctg

SEQ ID NO: 3168 - DNA, 845 bp, Homo sapiens
ggcacgaggttccctctccccagagccatcggccaggtaccaaagctcagctgtatggattcccaacaggaggacctgcgcttccctgggatgtgggtctcattgtactttggaatcctggggctgtgttctgtgataactggagggtgcattatctttctgcactggaggaagaacttgaggcgggaagagcatgcccagcagtgggtggaggtgatgagagctgccacattcacctacagcccattgttgtactggattaacaagcgacggcgctacggcatgaatgcagccatcaacacgggccctgcccctgctgtcaccaagactgagactgaggtccagaatccagatgttctgtgggatttggacatccccgaaggcaggagccatgctgaccaagacagcaaccccaaggcggaagcccctgctcccctgcaacctgcactgcagctggctccacagcagccccaggccagatccccattcccacttcccatctttcaggaggtgccctttgccccacccttgtgcaacctaccccccctgctgaaccactctgtctcctatcctttggccacctgtcctgaaaggaatgttctcttccattccctcctgaatctggcccaggaagaccatagcttcaatgccaagccttttccttcagaactgtagcctcctctcactgaaggtgggagctgcaggaatcaggtgcagagtaggaaatggaactaacctcaggaaggtggtattgacagaggtcaggacccacctggatgtcatgctatgaaacattaaaagaaaaaaaaaaaagaaaaaaaaaaaaaaaaaaaaaaaaaaaaaaa

SEQ ID NO: 3169 - DNA, 753 bp, Homo sapiens
ggcacgaggaaaggctggcctctcttcaacatgggatcttctggacttttgagcctcctggtgctattcgtcctcttagcgaatgtccagggacctggtctgactgattggttatttcccaggagatgtcccaaaatcagagaagaatgtgaattccaagaaagggatgtgtgtacaaaggacagacaatgccaggacaacaagaagtgttgtgtcttcagctgcggaaaaaaatgtttagatctcaaacaagatgtatgcgaaatgccaaaagaaactggcccctgcctggcttattttcttcattggtggtatgacaagaaagataatacttgctccatgtttgtctatggtggctgccagggaaacaataacaacttccaatccaaagccaactgcctgaacacctgcaagaataaacgctttccctgattggataaggatgcactggaagaactgccagaatgtggctcatgctctgagtactgttcctgtacctgactgatgctccagactggcttccagtttcactctcagcattccaagatcttagcccttcccagaacagaacgcttgcatctacctcctcttcctccatctttggctcttttgatgcacaatatccatccgttttgatttcatctttatgtcccctttatctccaacttctagaactcccagtttatacctgtgtcactctcaattttttccagtaaagtacttgatgtagtaaaaaaaaaaaaaaaaaaaaaa

SEQ ID NO: 3170 - DNA, 2045 bp, Homo sapiens
  misc_feature (2040)..(2041): n equals a,t,g, or c
gagctctcggggtatcgaggaggcaggcccgcgggcgcacgggcgagcgggccgggagccggagcggcggaggagccggcagcagcggcgcggcgrgctccaggcgaggcggtcgacgctcctgaaaacttgcgcgcgcgctcgcccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagctgggatcatcccattcttctgttaccagatctttgactttgccctgaacatgttggttgcaatcactgtgcttatttatccaaactccattcaggaatacatacggcaactgcctcctaattttccctacagagatgatgtcatgtgcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggactgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctrgaacactgtgatagattaactgtagaattcttcctgtacgattggggatataaygggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtygtttgcaattaaaacaaggtttgcccacatccaaaaaaaaaaaaaaaaaaaaaaaaaaaaaaaaaaaaaaaaaaaaaaaaaaaaaaaaaaaaaaaaaaaaaaaannaaaa

SEQ ID NO: 3171 - DNA, 888 bp, Homo sapiens
gaattcggcacgagacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggcccaccccctaagagaaagaagaaaaagaagttctgttatctgtgtatattgttgcttattgttttgtttattttattatgttgtctttatcgactttgtaaaaaaagtaaaccawtaaaaaagcagcaagrtgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctgtgacaccctcccagagtcaacctcgggtgatgccttctcagagtcaacctcctgtgatgccttcccagagtcatcctcagttgacgccttcccagagtcaacctcctgtgacaccctcccagaggcaacctcagttgatgccttcccagagtcaacctcctgtgacgccctcctagagccaacctcagttgatgccttcccagagtcaacctcctgtgacgccctcccagagccaacctcgggtgacaccctcccagagtcaacctcatgtgacaccttaccggagtaaaagtggtaaacaaaagcaatcagtaccaattccaaaaactgtatccagaaaaggtacattaaaaaaataattcctaaaaaaaaaaaaaaaaaaaaactcga

SEQ ID NO: 3172 - DNA, 1761 bp, Homo sapiens
  misc_feature (20)..(20): n equals a,t,g, or c
  misc_feature (24)..(24): n equals a,t,g, or c
  misc_feature (30)..(30): n equals a,t,g, or c
  misc_feature (32)..(32): n equals a,t,g, or c
  misc_feature (546)..(546): n equals a,t,g, or c
ttcgaaaacgattagtgaangtanaagtancngcagtacggtcggattcccgggtcgacccacgcgtccgggaagatgaggaggtcgctgagagctgggaagaggcggcagacagcgggcaggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcantgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaaraamaaaaaaaaaaaaaaaaaaaaaaaaaaaaaaaaaaaaaaaaaaaaaaaaaaaaactcga

SEQ ID NO: 3173 - DNA, 715 bp, Homo sapiens
cggatttcgagtgcttttctccttacctccaccctcccccatgttttaatgcagccctccaaaaatatttactgagtgtggactctagaccagggcctgtgctaggatacaaagatgaatgaggcaccacccttatcttcgagtagtatatgttttattttattttatttttttcccctgctgcctcccttgagtagtacatgttttagtaaggggaacagacactaaagagtcctggtaatgatgagcaaagtactgcatgagtaagtatctggggggcaagtgtccccactaggactcctgtcagatctggaaaaggcctgaggaatctgatacatgacttaatgcagcgtatacttgcagcctggaaaactaagtaatgacaaaatagacattcttgtcagtgtgagccattctctgagtccmaggggagtacataattcaaaccagaattggtcattttggagtttgcactcttagcagtatacagtggagtgaaatttaagaatcaatttaatttcttttcagtttttatgtacataaaacctgcttactacaagagacccagtttattattttgtgttggttaacattcataagtatatttcatcataataaggctccgtgaaattagtcattttatcatttgccaataaagacatatatctgaaaataaatgttcctgaacctgaaaaaaaaaaaaaaaaaaactcga

SEQ ID NO: 3174 - DNA, 919 bp, Homo sapiens
ggcacgagttggagaaggtcccggacctcatcagccaggtgttggccacctaccctgcagatggggaaatggcggaagccagctgcggagtcttctggctgctgtccctgctgtgctgcatcaaggagcagcagtttgaacaagtggtggcgctgctcctgcaaagcatccggctgtgccaggacagagccctgctggtgaacaatgcctaccagggactggccagcctggtgaaggtgtcagagctggcggccttcaaggtggtggtgcaggaggagggcggcagtggcctcagcctcatcaaggagacctaccagctccacagggacgacccggaggtggtggagaacgtgggcatgctgctggtccacctggcttcctatgaggagatcctgccggagctggtgtccagtagtatgaaggccctgctccaggagatcaaggagcgcttcacctccagcctggaactggtttcttgcgtggaaaaagtgctcttgaggctggaggcagccacctctcccagccccctgggtggggaagcagctcagccctgatgtgggggagaagacagataccccacaggcccctccctccacgtgtgccctctccctgtccttcctttccatgggccactgtttcccttggggtggggggaagggtcatccagcaccagaatgcgcacctcacactcctcttaggtgactaataaagaggcccaaggccagtttctgccttaatcatttctggcaagaggctgtgactggccagtgggatacttaattctgccgtctctatagacctcgcccctggacagagcagtccttccagaccattctagatgagagtcaacactgagcctccacaggctccattccaagtaaacatctgcatttattttaaaaaaaaaaaaaaaaaaaaa

SEQ ID NO: 3175 - DNA, 901 bp, Homo sapiens
  misc_feature (895)..(895): n equals a,t,g, or c
gaattcggcacgagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagaccaggaaatcctagaaaaacataaactgattcaggaggagcaaatcttaagaaatatcattcatgagactcagatggcaaaagargcacaattaggaaatcatcagatatgccgactggtcaaccagcagcatagtttacattgccagtgggamcagcctgtwcgctatcatcgtggagatatctttgaaaatgtggactatgttcargtctttttcttggtccartctaattcttataaacgtttgctttataaagattttttaaaactttaaaaaaacngcacga

SEQ ID NO: 3176 - DNA, 726 bp, Homo sapiens
  misc_feature (726)..(726): n equals a,t,g, or c
gagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagttagtcatgaaagaagatggtgccaacttgtatgttgcaaaggtttcacaagttcctcgaatgaatccaagacctgtcatggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttatan

SEQ ID NO: 3177 - DNA, 1829 bp, Homo sapiens
ggcacgagtggccctgatagataacggaagtgaggaaggatgacctgaaagtggtcaggattatgatgacgtcgagccttggcctttccttcctccttaacttaatcctgggtatgaaattcacctatctgattcctcaaaataaatatatacaactcttcactaccatcctcagtttcttctcaggagtcctctctctcctagagtgcaagttgtctaccagtagctgtacctgcctgaacatccataaatctgacaacgaatgtaaggaatctgagaattctatcgaagatatttcattaccagaacgcactgcaatgcctcgtagcattgtccgtgcacacactgtgaattccctaaacaaaaaagtccaaacacgtcacgtaacctgggctctgtgatttggaatctatttcttgcagtatatgctcatctttatggaaaaagctttgtgggtgtgtgctgtgtctccaaccatgttgtctctatttggaattatggttggggtttgtaaaaagatctggaagatggttttttaaaaaatcctggcctgctgaatgaatagtttctcctgcaacattgtggttaatataataaatattatcatataaataatacttcctgtattgttaagtctatacatcacaaacacttatgatatataacagttgtatagtgaaatatttcaaacatacataagaaatacaaaatgatgatcaaacacctatgtacacatcaacccaactttataaaattttaacattatttcctggagaagtttttccgttaaatttatagatataactgatgttcctctaaaaacttctccaatttcatttccatctcttgtttcctatcataaaacacttttaaggatgcgttgctgatgattctacattcatgttgacattttcactacaaatttatacatctataaaaattatatagaccagcttttcaaatgtttgaaagttggtcaatattacactgtagagatcatgttgtatttattttcataaatgctgaaataaatcttctaattattttagaattcctgaatctatctatgtaagtaaaacttggtccttcatgcctttttgtggttcatactttgtggggctaagtaatattccatcgtaagactgtaccacagttggtttatctatttcacctactgaaggatatcttggtgttccaagttggggcagttatgaataaaactgttataaacaccggtgttgcaaggttttggtgtgaacattaagctttcactttttgtggggtaaatacccaggaacatggattgccggggttatatggagaagaatgggtttagtttgtaaaaaacttccaaactgtcttccaaagtggctataccattttgcattctaccagcaatatatgagagttcctgccgtaccacatccttgtcagcatttgatgttgtcagtattgtgaattttgaccactttaatagatgtgaatgtgtcttattgtttaaatttgcaattctctagtgatttataatgtgaaaagcatcttttcatatggttacttggcatctatgaggtatctgttccattcttttgccctgtttgtaatcagccttttcatttttttggtgagtgtttaaatgttatttgtatattttggataacagtcctttatcagatatgtcttgcaaatactttctcccagcccgtggtttgtattttcattcttgacaacgtcttttgtagcacactggtttttaattttaataaagtccagcttattaattattaaaaaaaaaaaaaaaaaaaaaaaaaaaaaaaaaaaaaaaaaaaaaa

SEQ ID NO: 3178 - DNA, 2198 bp, Homo sapiens
  misc_feature (123)..(123): n equals a,t,g, or c
  misc_feature (621)..(621): n equals a,t,g, or c
  misc_feature (640)..(640): n equals a,t,g, or c
gatactataaggcaagtgactcacgggtgcgccgttagactagtggatcccgggtgcaggaattcggcagagcgccgccggagccgaagtgctggcgcccccgcggccgctgcctccgcggancccaaaatcatgaaagtcaccgtgaagaccccgaagaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaawcccyttgttcagagcatgctcntcaaatcctgacctgatgnagacagttaattatggccaatccacaaatgcagcagttgatacagagaaatcccagaaattagtcatatgttgaataatccagatataatgagacaaacgttggaacttgcccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaacttatgcaaaacatgttgtctgccccctacatgagaagcatgatgcagtcactaagccagaatcctgaccttgctgcacagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatctkgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaaaaaaaaaaaaaaaaattcctgcgcccgcgaattcttct

SEQ ID NO: 3179 - DNA, 982 bp, Homo sapiens
  misc_feature (4)..(4): n equals a,t,g, or c
  misc_feature (30)..(31): n equals a,t,g, or c
  misc_feature (149)..(149): n equals a,t,g, or c
  misc_feature (940)..(940): n equals a,t,g, or c
tcgncccacgcgtccgcggacgcgtgggtnnctaacctttggtttgcggacggtcgggtgtattctccgccgcccccacgccctcgaggtccccgccaccgaaccagcggcggaccggcccgcgcctcccgcggcattcccgcaccggntcgctcctcgctggggcgggacctggcctggcggctctggtcactatgagtgaaacatctttcaacctaatatcagaaaaatgtgacattctatccattcttcgggaccatcctgaaaacaggatttaccggaggaaaatcgaggaactcagcaaaaggttcaccgccatccgcaagaccaaaggggatgggaactgcttctacagggccttgggctattcctacctggagtccctgctggggaagagcagggagatcttcaagttcaaagaacgcgtactgcagaccccaaatgaccttctggctgctggctttgaggagcacaagttcagaaacttcttcaatgcttttacagtgtggtggaactggtagagaaggatggctcagtgtccagcctgctgaargtgtttcaacgaccagagtgcctcgggaccacatcgtgcagttcctgcgcctgctcamgtcggscttcatcaggaaccgagcagacttcttccggcacttcattgatgargagatggacatcaaagacttctgcactcacgaagtagagcccatggccamggagtgtgaccacatccagatcacggcgttgtcgcaggccctgagcattgccctgcaagtggagtacgtggacgagatggataccgccctgaaccaccacgtgttccctgaggccgccaccccttccgtttacctgctctataaaacatcccactacaacatcctttatgcagccgataaacattgattaattttaggccatgcagtggaacctgtcacctaatggnactgcattctgaatggaaaaaaaaaaaaaaaaaaaaactcga

SEQ ID NO: 3180 - DNA, 1609 bp, Homo sapiens
  misc_feature (1468)..(1468): n equals a,t,g, or c
  misc_feature (1567)..(1567): n equals a,t,g, or c
cggacgcgtgggggccgagtctggactagtgtactcctctttgcctttgccactggggtacgctccaacgggctggtcagtgttggcttcctcatgcattctcaatgccaaggctttttctcttctctaacgatgctgaatcctctgagacagctctttaagctgatggcctctctgtttctgtcggtgttcacacttggccttccctttgccctctttcagtattatgcctacacccaattctgtctgccaggctcagcccgccccattcctgagcctttggtacagttagctgtagacaagggctaccggattgcagagggaaatgaaccgccttggtgcttctgggatgttccactaatatacagctatawcyaggatgtctactggaatgttggctttttgaaatactatgagctcaagcaggtgcccaattttctactggctgcaccagtggctatactggttgcctgggcaacttggacatacgtgaccactcacccttggctctgccttacacttgggctgcaaaggagcaagaacaataagaccctagagaagcccgatcttggattcctcagtcctcaggtgtttgtgtacgtggtccacgctgcagtgctgctgctgtttggaggtctgtgcatgcatgttcaggttctcaccaggtttttgggctcctccactcctattatgtactggtttccagctcacttgcttcaggatcaagagccgctgttgagatccttaaagactgtgccttggaagcctcttgcagaggactccccaccaggacaaaaggtccccagaaatcctatcatgggacttttgtatcactggaaaacctgttctccagtcacacgatacattctaggctacttcctgacttactggctcctgggactactcctacattgcaacttcctgccttggacatgacctggactctccagggacaggttggaagccaacttaacccaggggtctgaaagtaaaaatacacattggaactgcctctgctgccctgggatcattactgtgtccattataatctttctctttctctttgaaagctggtcaggaatgggagaagtgtcagacactagagagccccttctggtcctggctagggcaaattttagacaactattttctctgtaagtgaagattgtcgtattccaagtctaaaatacacctggatctgtctagtcaatcaacatagcagagacagtcttaaacctaccattgacctgtgtgtaaatttaaatgtcaatttattgaagtgtaaatttcatcaaaggcattagctgacaggctggtaacagtccacacaagatggtataggcctgaacagtgtagtggcagtaataaagtgggaccattttttccaaatgcgcatgttctgatgtttttatgatgtgaggatttattgaaaactcaagttcgatactctcagtacatgaaaaaaaanaagaagaaaaaaaaaaagtttttgccgggtcctttggttcttcctgggtctgggctcgcctagggacctcgggatggccgcctatcgagggctcgcggnggcggtccggtgtttgcccagggtccaaggtctgtccgcttg

SEQ ID NO: 3181 - DNA, 1382 bp, Homo sapiens
  misc_feature (787)..(787): n equals a,t,g, or c
aattcggcacgagcggaggcgagggaaactragggcgaaagttgtgtgtcgtgttggcaggagggcctagaagggaaagactgtctagtgggacaatgtcatattataaatttggaatgctgaatagaaaattatagattttgatattgaaggaaatgaagcgaagcytaaatgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttkgctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggrataaaaatgattttaagcctcaatgtaaacgaacaaacttagtggcaaatgatggaaaaaattcttgtccaatgagttcgggagctcaacaacaaaaacaattaagaacacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataaganacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgagcaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaaaaaaaaa

SEQ ID NO: 3182 - DNA, 1538 bp, Homo sapiens
ggcacgagagggaagggaagccggaaggggcrcgagagcaaagcgaggacagacagctcccagagggcgaggggtgcgtgtgcgtccgcttctcacctcaggtctcccttcggccccgctgccctccctcgcggctgggtgacagctgggtccggtccgtcgcgggctgcctggggtgcgaggatcgcgcaccccgtcttcgcgcgctgtgcctgccgccccgccccctcgtcccgcccgtcccgtcgcgtcgcgtcccgtcccctcgggtgctgccagccgggtgctgatgcgagtcggtggcagcgaggacattttctgactccctggcccctgacacggctgcactttccatcccgtcgcggggccggccgctactccggccccaggatgcagaatgtgattaatactgtgaagggaaaggcactggaagtggctgagtacctgaccccggtcctcaaggaatcaaagtttaaggaaacaggtgtaattaccccagaagagtttgtggcagctggagatcacctagtccaccactgtccaacatggcaatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagtagaagcttgtaaagccaaaactgatgctggcggtgaagatgctattttgcaaaccagaacttatgacctttacatcacttatgataaatattaccagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagaaraaaaaaaaaaaaaa

SEQ ID NO: 3183 - DNA, 2333 bp, Homo sapiens
  misc_feature (430)..(430): n equals a,t,g, or c
aattcggcacgagggcctccttaactcctctaaccaacagatgagatgttgacagaacctaacatctacttagagatgatgtctcaggggcaacagaagaggcaggtgctgtagggccaggcgggttacctgtgtctgccagaccctccagtagttcagaatagcctcactggcgccgagatgataatgctgtatgcaaacatgtcaagctatcaaagggagctgcctttcggtttcattaattttgttgtgtgcagcttccactgaaggcttcagggcacctgatctcttttgtgtgttgagaaagagcaagtgcttggccaggacacagccctttttcttgcaccctgagacatcctaagacactggctgtttcacctgccccagtgtatttgctgtcttcatcagctctctttctccccctgacatncttgcctggcattttgagtcagcctgagyataatccaaaccgaaatgaaatgctgtctggaaatcttaccaaagaagcacagtcccacttcgtgcttccatctccccacatcccaaggaccaccgcctactttaagagaacacagacaattcacctctataaaggcacagccaggaaaaggagtaggcagaggtgacagcagatcatggggcttctcttgaaaggaagacacctcccagtgatgaaccctcatcatccatttactgacatatccttatgtcaccaggatctgaacgtctatgacactctttcgagctgacacagtgaagaacatagaaggagaactcacccagtctgccaggttaggatgtggtgggggctgcttgggggggtggctccaatttcacttgacggtgtcgagcttctctggctttgaggtaaggcagctacatgcaggtggkgcaagaaaggcagagagcagacagggatcagacacaggtgaaagagcttgcgacttgttggctgacaccaacccagtggccagaggtcaccatttccagggatgctgggaaggaccccagagcagggtctcagcatccctatggcatggtcacagtgggcamccatctctacatgcccccccaacctctgcatcccacccattccattttctacccactaccatgcaccttcattctgagtcaagctgacctgggatcctaggtccccgctttgccaccaggaggtaggcatagggatggtgacggtttctacagcagcaaagaatctgatgtccccatagtcctttgagcgagacctgagcagggctcatacagggagggcatatttctctggccccagggcattttcagtgtggccctgttatgaaattgtttctccccattgtgaagagagggcatccagaaaggttctcagagcctgctctctctgctgtttcaggcttatcattgctactgtagggcgctttgaagggagcagggcttttaatagctcatccaaacctgaccactacgcatttactgatgtaggcagcatggaagtccagctggaaagatttagtaggaagtcaatcctacgtaaatgcatcctttgcttttttggtaaaggaatcctttccatcagtaaacctcagatacagcttaacaattttagtctaaaatatgttccaaaagatstacctcakctctttacataaagcaaatctactagaccaggctgagttttgatagaacataaaccctyctgkttgttggagatatttacmaaacgttggttctttatctaatagggtcacagaatgatcatactcaagatcttcctggggagtcaatggcaaatttcactgggctattttacagatgaagaaggamcataaagaaggttctgggaccccgaagtccacggaacacccaccattacctgatctttggagcttgtcatttggccagtggaccctaataaacgtccacggggatgtggggatagaatgccggagcctggctcgctagggcatccaggttcttccttcctctttgccctgctgtctccaggcaccaagaatctcctacagttccccaaagatgaaccccccattatctcaggtcactctgtttcccccgatctttaccaaattcctgactcagagttcctcccatttgcttctgactctcattttattcttacctctcattttattcttatgatgtttaccatttctcttctcctcagtgtccctctctgagtggtaagagtatgttaataagccagtgctgagaccggagcacgaggcaactgctcaatgttggtcattgtcactgttattaaatgtaacttaagggaaaaaaaaaaaaaaaaaaaaaaaaaaaaaaaaaaaaaaaaaaaa

SEQ ID NO: 3184 - DNA, 979 bp, Homo sapiens
ggcacgagccagaccctatgatgtgtccactctggaggctcctcatcttcctcgggttgctggccttgcccttggcaccacacaagcagccttggcctggcctggcccaagcccacagagacaacaaatccaccctggcaagaattattgctcagggcctcataaagcacaacgcagaaagccgaattcagaacatccactttggggacagactgaatgcctcagcacaagtggccccagggctggtgggctggctaatcagcggcaggaaacaccagcagcagcaagagagcagcatcaacatcaccaacattcagctggactgtggtgggatccagatatcattccataaggagtggttctcggcaaatatctcacttgaatttgaccttgaattgagaccgtccttcgataacaacatcataaagatgtgtgcacatatgagcatcgttgtggagttctggctggagaaagacgagtttggccggagggatctggtgataggcaaatgcgatgcagagcccagcagtgtccatgtggccatcctcactgaggctatcccaccaaagatgaatcagtttctctacaacctcaaagagaatctgcaaaaagttctcccacacatggtagaaagtcagcccctggcctgatccttctctctgtgctgatggtccaggtatgtcctctgatcggtgaaatcctcggccagctggatgtgaaactgttgaaaagcctcatagaacaggaggctgctcatgaaccaacccaccatgaaaccagccaaccctctgcatgccaggctggagagtcccccagctgacttctgctgatcagaaggaaagtccacatcttgcaaccttaagtctcccttagagtggggcttctgctaccctaaaaactttaccccaggctctgtggacataccatcctctcctacaataaactctagctctgaagggtgaaaaaaaaaaaaaaaaaa

SEQ ID NO: 3185 - DNA, 1120 bp, Homo sapiens
aggggactctcaccctctcccagcaatgtctaaagtcaggcatctgaaaaccagcagtaatcctgcctctgaagtttatcaggaaaggagcttaaaagagaaccaaattcagcctgtgttggaactctcagtcccagaggggtgtggtttatagctctccggcctgctgttggacttaggctgtgacccacagaaggacgccagaaagtactcaagacattcacggtgccccggtcagcactcgccatgacgaagacttctacatgcatataccacttccttgttctgagctggtatactttcctcaattattacatctcacaggaaggaaaagacgaggtgaaacccaaaatcttggcaaatggtgcaaggtggaaatatatgacgctgcttaatctgctcttgcagaccattttctacggggtcacctgcctggatgatgtgctgaaaagaaccaaagggggaaaagacattaagttcctaactgccttcagagacctgcttttcaccactctggcttttcctgtatccacgtttgtatttttggcattctggatcctctttctctacaatcgagatctcatttaccccaaggtcctagatactgtcatccccgtgtggctgaatcatgcaatgcacactttcatattccccatcacattggctgaagtcgtcctcaggcctcactcctatccatcaaagaagacaggactcaccttgstggctgctgccagcattgcttacatcagccgcatcctatggctctactttgagacgggtacctgggtgtatcctgtgtttgccaaactcagcctcttgggtctagcagctttcttctctctcagctacgtcttcatcgccagcatctacctacttggagagaagctcaaccactggaaatggggtgacatgaggcagccacggaagaagaggaagtaattgcacaccattttccaagaaccaagaaagaagaaaacacaagagatttttctcatctttttttttttttttctggtggagggaggtggtggaggaacatagcaaagtaggagggacagagagtgatacttaaatttaataagaggttcgtgaaggtaaaaaaaaaaaaaaaaaactcgag

SEQ ID NO: 3186 - DNA, 372 bp, Homo sapiens
  misc_feature (367)..(367): n equals a,t,g, or c
  misc_feature (369)..(369): n equals a,t,g, or c
  misc_feature (372)..(372): n equals a,t,g, or c
gaattcggcacgaggagagagagagagagagagagagagagagacgctcctccatcgggtttggggagggagcactctgggactgtgagacaaggaagcagggccagcagtgagactatgagccaagcaaagagaagtctcagtggagcatgaggagggagcaktccakatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttcttcttccaaaaaaaaaaaaaaaaaaaaaaaaaaaaaaaaaaaaaaaaaananaan

SEQ ID NO: 3187 - DNA, 613 bp, Homo sapiens
ggcacgagctggggcctgtgtgcctccacgccataatgctggcagaactgatatttctctttaggagtctccatgggatacttgcctccgcaggcaccataggagcagtggcagcttggctgatgagctataagccagccttgtttgggttcctattccttctgctgttgcttagcaactggttggtcaagtatgaacacaagctcaccctcccagagccccagcaggaggaagagaaaccaaagacttctgaaaacgactccaagaacagcaaggccgtgaacacaaaagaagtcaatagaacgcatgcctgctttgccctccaggacgagatcctccaacggctgttgttcagtgaaatgaagatgaaggtcctagaaaatcagatgttcatcatatggaataaaatgaatcaccacgggcggtcaagcagacatcggaattttcccatgaaaaaacacagaatgaggaggcatgagtcaatttgccccaccctgtctgactgtacttcgagttcccccagctaatgaggccgaggcgggctggcctctgccgatgttaccttttacctcagtaaaacccagtcacagcctaaaaaaaaaaaaaaaaaaaa

SEQ ID NO: 3188 - DNA, 741 bp, Homo sapiens
ggcacgaggaaaaacccaaggaaccagatagaaccagtgtccctgtgactccacccactcatctggccaccgttgccctgacctgccaggagcctggagaagatgaaggcatccgtggttctctccctccttggctacctggtggttccaagtggtgcttacatcttggggcgttgcacagtggctaagaaactccacgatggaggcctggattattttgagggctatagccttgagaactgggtgtgcctggcctacttcgagagcaagttcaaccccatggccatctacgagaacacacgtgagggctacactggctttggcctctttcagatgcgtggcagtgactggtgtggcgaccatggcaggaaccgctgccatatgtcatgttccgctttactgaatcctaatttagagaagacaattaaatgtgccaagaccattgtaaaaggaaaagaagggatgggagcatggcccacctggtcccggtactgccagtactccgataccctggcacggtggctggatggttgcaagctgtagccgcctgcatggcccctgcagcactcaccagttgcatcttgtgaatgaaggtgcttttctgcttgctgcttcagtcaatccttttgatgatctcaccactttaagagttccagatggaaaaagacaaaagtttgcttcatccggggatgcaggatgcagaataaaccaaactagttactcaaaaaaaaaaaaaaaaaa

SEQ ID NO: 3189 - DNA, 1176 bp, Homo sapiens
ggcacgagcccgtccccttccctcccccctgccctaagccacctccacctctgtcctggacacctcagggcgccctgaaaggaccaggacatgcggctgcgcttttggctcctcatttggctcctgctgggatttatcagccatcagcccacccctgtgtctttcctgaagactatcttctggtctcgaaatggacatgatggatccatggatgtacagcagagagcctggaggtccaaccgcagtagacagaaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggcggcagcggagcatcgtcattcttcaggattgccctactggctctacctcacagctgaaactttaaaaaacaggatgggccgccagccacctcctccaactcaacaacattctataactgataactccctgagcctcaagacacctcctgagtgtctgctcactccccttccaccctcagtggatgataatatcaaggagtgtcctcttgctcctcttccaccctctcctcttccaccctcagtggatgataatctgaaggaatgtctctttgtcccgcttccaccctctcctcttccaccctcagtggatgataatctgaaggaatgtctctttgtcccgcttccaccctctcctcttccaccctcagtggatgataatctcaagactcctcccttagctactcaggaggccgaggtggaaaaaccacccaaacccaagaggtggagggtggatgaggtggaacaatcacccaagcccaagaggcagagggaggccgaggcacaacaattacccaaacccaagaggcggaggttgagtaagctgagaacacgccattgcactcaagcctgggcaataagaataaatccgtaggtcgaaaaaaaaaaaaaaaaaaaa

SEQ ID NO: 3190 - DNA, 661 bp, Homo sapiens
ggatccaccgggctgcaggaattcggcacgagctcgtgccgattcggcacgagcggcacgagtttttttatgactacataatgtttattgcgatctattttaaggcttttcatggatcttttcagctatgcacatggttagtcataatgattgtcattttaggtcagagtttctcagccttagcattgttgacattttggttaattctttgttgtaggggctgtcctgtacactgtagggtgtttagcagcatccctgatctctacctactaaatgccaggagcaacacagtacctccagctcagttgtgacaactactgaatgtctccagacaactactgaatgtctccagacattgcagagaaattgagtctggttgagaagtcactgttttagggcataatttttgggtagactgttagattctttgtgttcgttgtctctggcctgtataactcttcttaattatctgctactcaaatgtatttgggatcagccactgtcttccatttctcttttgctcacagatctactccacagctcttctcccttcaaacactgttcctcagcatcttgttttttgcagccaaacatttcttggagatctttccattggatcagtgttctgaactgcctgcgccggggccgggcggggccgggc

SEQ ID NO: 3191 - DNA, 934 bp, Homo sapiens
tctctctctctctctctctctctgctgtaaagaactcccaaaactcaaatgtatcaggaaatgtaaaggttaagtctgactacaagaaggccaaaattgcaccagcttcctaagtgaagaataatagaataaaacatatagagggcagaaataaaatgaggtgtatctggagaatttcatgatgagcatttagatttagcaatgcccaatgtcatgctgacactgtttgtcatgaccttgtcttcagctagtaatttggggttgtacttttttaaatttaattttgaatgttcttgcatgtttggtacctctctcctcactgctaaagataaattgtttatctgtataacataactacaccaatgtcatttattgtatacgctagtacacaaatgtgtttttttattaagtaatgaartatttgctgtgaaaaatgtattatttgtgccaccgtttatatctgtgttcattttctgtgtgtatatgcgtgtgtattcgaatctcaatttttcttttactctagtttagattaagacatatttagatgaaattttaaaaataacattggaaataggaggctaagttttgttsagtctcattcccttggggggaaattgcttttgccattttattttcatgtacaataacctaaaaaggatctcctactgacttccttcctaattattattgttttacacgaaagaaaggaaatacgttttcaattgagttgtttgaaatcattcactttgtgtagatttcccagactgatgtttcattgtaagaatattacattatagacaggttggccatttcacaagcaactaatccatagttttggaagcccgctttaagagacctgaatatctttgtttttaataaaatacttagagtttaaaaaaaaaaaaaaaaaaaaaaaaaaaaaaaaaaaggtaaa

SEQ ID NO: 3192 - DNA, 1056 bp, Homo sapiens
  misc_feature (1051)..(1051): n equals a,t,g, or c
ggcacgaggcgaaaccgcctacgacggtgccgcagtggagttccaagagcctctgagttcctgccttttttcatctctgaatccccaccattggcctacattgggagtggggcgacctgtgatgctgacgttagaggacaaggacatgaagggattctcctgggccatagtcccagccttaacctccctaggctacctgattatactggtggtctccatctttcccttctgggtgcgactgacaaacgaggagtcccacgaagtctttttcagtggcctatttgagaactgcttcaatgccaaatgctggaagcctcgacccttatccatttacatcatcctcggccgggttttcctgctctctgcagttttcttggctttcgtcaccaccttcatcatgatgccctttgcatccgagttcttcccgaggacctggaagcaaaactttgtgttagcctgcatcagcttcttcacaggggcctgtgccttcctggctttggtgctgcatgccctggagatcaaggctctgaggatgaagctcggccccctgcagttctccgtgctgtggccttactacgtgctgggcttcggcatctttctgttcatagtggctggtaccatctgcctcattcaagaaatggtttgcccttgctggcacttgttgtccacttcccagagtatggaggaggaccacgggagcctgtacctggacaatctggagagtttgggaggagaaccgagctcagtacaaaaggagacacaggtgacagcagaaacagtcatctagcccaggacatggcttctttacccttcttcaagccatgtgagtgtacacatgtagctgtttgtagtcctccccaccctctctgccagtatctgtgcctttgaggagcttcttgcgtgtcagatcaactctccacctccccatactcacagtgattctatcttgcttgtatgtgaaatttgctaaaagtcctttcaactctaaaaaaaaaaaaaaaaaaactcgtagggggggcccggtacccaatcgtccctgatgagtgtaaantatta

SEQ ID NO: 3193 - DNA, 1579 bp, Homo sapiens
ggcacgaggatttggaggggacaaacatccaaaccatttaagtcacagcactttactccgcagtgtgaataacacaggcattctcctacataatcacagtacagttatcatactctggaaattgaatatcatctaatatactttccatacccagattttcttagatttcccaatgatatttcttactgtcctccctttagccttcctctttctccattcaggattctaccattacatttcattttcatgtctcttcagtctctctttagctttgtttttctttcttgatgttgccacttttaggaggccaggccagttgttttgtgaaagatctgttctctttgatatgtttcattttggatttgtttcattgtttttgcatgaatggattcaggctaaacatttttgggcaggactgtttattgtattacctagtgatgtgttcttttcagtccatcatctggaggcacctgatggcagttttcccaatattgcgaaattaagtttgattattttgttaaggtagtgtccaccagatctctccattttaaagacatccttttctctaattactcagtggactgtagagtgatgctttgaaactgaataactaacactccctaactcagtgatttagcacccgttgattttttttttttgcctgaatcaaatattattatagtagttttaaatggtgattttccatttctattcttttgttagctgccattcttctataattttgtctttatattttactgggtgttaagattgctattccagctttcctttgtcttttacaccttttcccattcttttatttttttccatccctttttgtcctgttttccaatagatggatagaattttctttctctggtttaaaggttatacatttgtgtgtgtgtgtgtattctaaaccatttgcccttaaaacatagagatggttattcctgttgattaaaaaaaactcagtaatgttactatcttctctttaataagataggtactttatttcattctgtgttcttgggtgaggtctcccctcacccagtcaagttgatgttaatctagaatttttagttttttaaattatcgatatactttctgtcttttcctttttttttcactctctctgtatttgtgctttccccctttactctctttcccttcattccttctttctcactttcttcttctatttttcactcttgggtagattatcttttagaaaacagcaagatattatataatttactttatattctctttccaaatgattaaagtaataattaaaaatttttgatatgtgtgtatgcaaggataggaatcctcttgtaagtggaagaactctaccacatgcatgagtcattagtgtgttaaacactgggaagtggctttaggtccagctgggtgctctgaagaaggtaggtttcttcagttctttatgttaactgtctccttaccttaaaaaaggagtgaagaatactgactgcagaggttttgtgaggattccggtaacacagaagcatagaactggaaaagaatattaatatttgccaaaaaaaaaaaaaaaaaa

SEQ ID NO: 3194 - DNA, 1005 bp, Homo sapiens
ggcacgagagacagccttgttctacagatcctcccagaaatctctgggccaggtggaacccagggtcagagagggatgggagagaggtttaattttccatgataaataaaaatctataaaataataaacaagagaaaagagattggaaacagccaggttggagcagtgagtgagtaaggaaacctggctgccctctccagattccccaggctctcagagaagatcagcagaaagtctgcaagaccctaagaaccatcagccctcagctgcacctcctcccctccaaggatgacaaaggcgctactcatctatttggtcagcagctttcttgccctaaatcaggccagcctcatcagtcgctgtgacttggcccaggtgctgcagctggaggacttggatgggtttgagggttactccctgagtgactggctgtgcctggcttttgtggaaagcaagttcaacatatcaaagataaatgaaaatgcagatggaagctttgactatggcctcttccagatcaacagccactactggtgcaacgattataagagttactcggaaaacctttgccacgtagactgtcaagatctgctgaatcccaaccttcttgcaggcatccactgcgcaaaaaggattgtgtccggagcacgggggatgaacaactgggtagaatggaggttgcactgttcaggccggccactcttctactggctgacaggatgccgcctgagatgaaacagggtgcgggtgcaccgtggagtcattccaagactcctgtcctcactcagggattcttcatttcttcttcctactgcctccacttcatgttattttcttcccttcccatttacaactaaaactgaccagagccccaggaataaatggttttcttggcttcctccttactcccatctggacccagtcccctggttcctgtctgttatttgtaaactgaggaccacaataaagaaatctttatatttatcgaaaaaaaaaaaaaaaaaa
